United States Patent 9,328,346 (POLYCOMB-ASSOCIATED NON-CODING RNAS) - sequence listing, part 87

SEQ ID NO: 16204 - RNA, 568330 nt, Homo sapiens
agggggagccggagcgcugcagaggcgcgggccggagggcuggcgcugaucugcacccuucucaucuggagagcggaccccuggcugcccggaggcgagccccuucccggggggugggggcggcaacgcgcgacccagcgguccugcgccccacccucccuccuccgccuccagcgcucggcuccaacaaaggggcaggcccgcagcggggaggaggaggaggagccgccgaaggagcgagccucucucgcgcacaaaguuguggagucguuuuuccucggagcagggaagcgggcagcagcagccggccgcgggcuuucucccgccgaggggcgaggaggagccucuggcuccagaagccgauuggggaaucacggggagcggcgccccccuucuuuugggucauuucugcaaacggaaaacucuguagcguuuggcaaaguuggugccugcgcgccccuuccagguuugcgcuuugacuguuuuguuuuuggcggaacuaccaggcaggaagauugcacaaguaaggggcguuuucagucgggugucaauuucucuuucuuucuuucuuuuuuuaaaauuucgguucgugucugcuucuccaagcuuuauuuuuuuuuuuaaauacaucgcaccaccaaacuaacacucgcacacacccccgcgguuacuccgugucaaacuccuagaggagcccuuggccagcucggggugcggcgguggcgaccggcaggcgaggaggcccgcgggcagcagguaagcccaugcauuauugaagccucgggcugguaaugugacuacagcccccgagggaauggggcgggggccgggaggaggauggcucuuucugugguucuuccgccugggaucggcgucccgagcugcuucccaagucccagagucgaagaugggaguaacuuuugcgugcccuuuccucggggccucaguuuagcuccccgcggugcgagagagaaugccggaggcguggagagcucgggcguggagguccuugggauccguacuaguugugaacgauccaaacuuaucugaccagcucugugcugccucccugcuccccuaaucuuccuccccgccggggugacagagucgcccuccgugcaucgcgcggugcagggcgcugggccagugauuugcaagaggggacguggccucuuaggagagucugucacagacacccgggcccggggaaggcggggcuccggcgguguccacaggagagggugggcagaggguggcuguguggucggcggccagcggagcgcuucccagccagccgcccggcggggaacgugcuugaccucugggugguugcugcucccaaggguggggcuccggagaguguggcgcgaucgccaagcucccuggcagcggcccuggagagacugaggggacaggaggaggggggcgccccauugguguguagucccgcgcagucgccggcucuccuuuuccggacucuggggaucucuugcugcaacugacaagguaauucaugccccgcuuuggcccgggguccgaggcugugguugcucaaggccacuuaaaaaccaacaaagcaccaauugaaggcugugcaacuuucagauggcagguuguucaaaggauuuuuuccuccaagccucagauuaugaaagggacucauuccagugcguuuuucgaggaggagggagaaaacguugcccgaccuccgagagagcugugggaccagcacuuuauuuuacaaggaacugcagagcucggguucuaacuccacggccccgcucucugagguguucaggacagggccuccucuuucccagccuucaggucagccggaucaccagggccuugcgggccaguucccccugccgcgguugggagggucagugcagcggucgccgcggccagagcgcgcggagcucgggggaggccggauucccuaggucugagccgacccucccggccgcccggccgggcggcagcgaccgcauccauuccuuuguaaguugcaccggccucaggaagucgaucugggcccucccgguucguuggcggugggcgugggagacgcagccugcggauagcucagggucaggggagagguggaggaaugcgaagcuuguggguaguucugcggugacggacaggguuggcguggaaccauuccccgccccuuuuaccagccuuuaugggaccgaugagacaacucuuuaacucuccuuuggguguuuaccuaaaauuuauuggcucuguaaacaguauuaaucacaguaguauuaaccuucccuggagcgcuuccgaguguaaauggcaguucuuggcacucaccguuuucuuuuacuguguuucaagcagagcagcaaacucuuguccgcuuggcuuccuuuucuacuaucucaaucguuccuagguuuugguuccuauaguaaauuaaugaauaguguuugcauuacacagcauuuccaucauaaugcacacuguuggauauauaugugcuauauacauaaaauauaguacaaaauaaaaauuauauacauauauucauuguauaauuccuaaaaucuuaaaaaauugaaacauuaguuuugucuuuaaggcugucaccuuauguuuauuuuuuaaacaccuuauguuuauuucauacacucuugcuuggugguccauaugacagccggaagcguucugaagggagaguuagugaauaucgacuugacuggauugguuucaguaagaacaucuggcuuuuacagaauaucauuugagggaagggaaaucuagggcagagguaacaauaaauugcauuuguauagggcuugaagcuucuaaagcaacaucucauucauugauucucaguuucucaccuagccuucugugaagaugguguucccuccauuuuauagguguggaagacggagggucacacugggaugcauuguucguggugaaacuuugauucugucuccugagaaccaaagauucugcauuuggcaauuagaaggagucauccuuugccuuaaguguacucaaauuccucuggccauuaauggcaaguaaccucaguggcuaucacuauuuaaauagccuucuguuauucuucuuucuccccauuuuccucuguacucugaucaccuuuucugcuguaucuuugcaaccuguaagggauuuucauuaucaagaagagaaaaauuugaaaaaucaccuugaggagaguggcaagugaaacauuauagugaagaaguguuacugauaaugggcaaauggaauaaaguaguguguaaacaguugacuuuucucuuuuaugggugaauaaaggcuuuggguagcauagaaguggagaucuuggcuaagaccaauagugaagaaaagcauuagacuuacugcuccaaagugauacacuguaguucuuuccaggaaagagaauuuuucccugggcaaacuuaauuuuccaugauaaacuuuuauagacauucuucugaacaaaguuuuugauucuugaauauaauaaaauacacuuaagaauuuagcaaauccuuuauaguuauguacuugaaugaaagaauguaaucauauaauaauccauaaauuuuuagcaguaguagagccuauaaaaaaugaaaaaaguuuuuuagacucucauaaaaucugucagauugaugauccaauccuuuauauccaacucucucucucucucuuuuuuuuuuuuuuuuuuuugagauggagucucacccacucggucgucaaggcuggagugcaguggcagcgaucuuggcccacugcaaccuuuaccuccugaguucaaucaauuccccugccucagccuccugaguagcugggauuacagguguuugccaccaugccuggcuaauuuuuauauuuuuaguagagacaggguuucgccauguuggccaggcuggucucaaacucuugaccucaaguguuagccagguuggucuugaacucuggaccucaagugaucugccugccucagccucccaaagagcugggauuacaggcaugagccaccaugcugggcccaacucucuuuuugucaucuccgcuuauauaacucagaggcauuucaagcucugcaaauccaaaucacauugaugauuccuuucucccagccugcuauccucaguguugcccagcucaaugacucacacuucaccuaauugccuaagccaaaauuggggagucauuuugcacauuuugcacauuggauaugaaucucucauauccaaucaauucccaaauccuauugacuuucuuugauaucuaaauaucccacauauucacccauuucuuucuaucuacucuuguuuagaccacacuuguuuccugcauauaauauuacaauagaaagaauagcacaauaaacacccagauguccuuuuuauuuuauuuuauuuuauuauuuaaaauuuuuauuuacauggaguagagacaaggucucaccauguugccuaggcugaucucaaacuucugggcucaaguaauccucucgcuuaagcuucccaaaguacugggauuacaggugugagccaccucgccuagacccagaugcccuuuaacaaguuuucccacuuacuuuauuuuuuuugagauggaauuuugcccuugucacccaggcuggagaguaauagcacaauuucggcucacuguaaccaccgccuccuggauucaagugauucuccugccucagccucccaaguagcugggauuacaggcaccugccaccacacccagcuaauuuuuguauuuuuuuuuaaguagagaugggguuucaccauguuggccaggcuggucucgaacuccugaacucaggugaugcaccugccuuggcuucccaaagugcugggauuacaggcgugagccaccuugcccggccuaguuuucccacuuauuuuacaauacuuacugcauuuuucugucugucuguguguaugcauauauacaucuacauacauauaucaaccuaaauauaccuauaucaguauagacagauauaugcuauucuguuugaacuuaaguugaagauaccaucacacuucauugcuaaauauuucaccacaugucucuuacaaucaaagacauucuccugcaacaauaccauaauuaauguuaaagaaauuuaacauugauacaauaauauugucuaauacauaguccaaauucagauuuuucaaaugauccucaaauguuuuauuuuaaaauucugaauucaaucaaagauuacauuucauugucaugucuauuuagucuccuuuaauucacaaagcucccccucucccagguaauuuugguuuucaagacgcugacaguuuugaagaaaccaggccauuucuuuugaaaacuagccacagucuagauuugucugcucaugagaagauucacguucaacaucuuggcaaggauauuguguagaugauguggugauuuuccauucaauugcaugaugccccaugauugguuaugugaauuuugaucacuugguuaagauuaggaauuuuuccccaacauauuacuaugaaaaaauucucagacauacagaagaguugcaagaaauuuucauucagcauucauauacccaugagcuagguuccuuaauuugcauuuugcuauauucugccauagucuucacugguuccccacauauuacuguggucuaccuacaagccacaaucgucuuuuuuuuuuuuuuuuuuuuuuuuuuuuugagauggagucucacucucguugcccaggguggagugcaguggcgugaucucagcucacugcaacuuccaccucccagguucaagcaauucuccugcauuagccuccugaguagcugggauuacaggugcacaccaccaugccuggcuaauuuuuuuuuuuuuuuuguauuuuuaguagagacaggguuucacugugcuggccaggcuggucucgaacuccugaccucgugauccaccugccucggccucccaaagugcugggauuacaggcaugagccaccgugcccgucccuugacgaucuuuuaaaaaggccaauuugaccauguugguucccuccuucgaaccaucuacuggcuccccauugcucuucagauaaagacacaaacccuugaccuguucuccaugguccuaucccugguccugcccagcuucuucaccugguucaacagguacacuugucucuuggcugucuucuuuccagaaacacuggcuugugcuccauucuuugacugcuccaugauucuuucugccacuucacauaggaagcucuuaccuuuucucuuucuguuucccuuuuuggcuaauuaaauucuugucaucuuuaaaggcuuggcucaaaugucucuucaagaaagccuucucuaauugcccagggcaggucagacuccucugcugugugcucuuaauacucugugcuucuccuuuguaugauuuguagucugucaguauuguaaugaaauaauucauuauguaauuaauugcuuagugugcauaagcgccguaauggcagaggcuaugucucuuguucauagucauaacaccauugccuggcuuggugcuuuacacgugguaggcacucaauaaauauuuggugaaugaauaguuacuacgaauaacuauauaaaauauauaaauacauuuuuucaagucaguacuuucccuuuuccuuuuagguauugaugucaagcugaaccaucguaggaaguugaaagccuuagaaagaggacuugguaaaguuuuuggauuaucuugaaacucuggcaagauggccaaguauggagaacaugaagccaguccugacaaugggcagaacgaauucagugauaucauuaaguccagaucugguagguaaaggaagcucaagaaagcuauggauuuuuauguauuuagaaaaccuauguuucuuggauugauuugcauuguucuugcaagaacuucuuggaggugaaguucuuuuaagaaacugaauucugacaaaugacuauaauuuuguaaaagguauauguaaaagguauaauaucucugaguguccuauccuuucucaacccaauuuugugcuuagugaaacugcugcuuguagcuaaagguuguucauuuggaagacuacuccauuaaaauaaaauacgaccgaacauuucucuuucuauuuucuggaaauugaagggauuauaugcuuaauguaggaagugccacaguuucuggcaggaaagaucuuucacaguuugauuucauuaccauauauccucacccccaucccuguucauagccauugauaggccaacagguguccuaccuugaaauaucuuaugagccuucucaagguaaaauuuucaccuagguaaucuaauaaaccagacucagacagauucaugguuuucacacgaacaguuaaauugggguccucaggauaccacccccuccuccaaucuuuuuauauaaccgagugcuuuuugacucuggcuguacagaugaaucaacuggggaguuuuaaaaaacgcagaugcauuggcuccauuccagacccauugaauaaaaauuucuguauuuuuaaaaagcuucaaauaugauucugagacaaacucaaaggggagauauuuuugaacaggcagaacacuucucagccuugaaaauuacacagaacuccacccugagugugaacacuauacuuaaguaacuuugaaaaguuacuuugagguauaaaauuacauccagugucacuuuaaagacaaaaaaggaacccaaagccuguuuuugcugugugaaccaucuuuauguucuguuaggagcuuguuucuuauuaugugaaacuguagaaauacacagugaaaauaagaucuaaauuaacugucuuaaaauacacauuuuccuccaugauaccgguguugguugauugauaaagauuuuaguuauuacagauuuggcuguaaauauguagcaacuauuguguagcuugacgggucuuuugaagguauagcuuaauaucuuguuuuaaaauaugcuuugaggauguucucuuccuguaaaauucuuuuuguuuuaaauguuuuagugguauaagguacuacaaaaauguaagggauuauuaauaucaucuuaggaguacggaauacauauucagacauauguaaauauaacagaggaaaauggaagagagacgauuuaaugucuccauacuagucauuuucuauaaauugugaggagguauauuccuaaauaguuuucugagucagccuucauucuaguaagaccuuugauauuuauaacuuguacuuuagccguguccauaaaagaguaauuaucuaauuucagaaauaccguguauauauaaugaacauauaaacucccaaacuauuuuaauuuaaaauuaucuuuuaaaaaggcugaugaaccuaaaauauugcuggagaacaauuuggcaaaaaugauaacauguuuuuaacacaugcauaucaauuaacugaguaauucuguuucuagaguuuuucccuaggcaauacauaaaaagguacacucaagaaauugaucacaguaucauuuauaauagaaaacauuguaaacaccaugaaaaucuaauauuaggaauugguuagaucauuauuucccaaaguauuucgaaaagaucaaaaguucuaggauuguuaauguguaauucacaaaaggauguuauggucaaauagcuuuaggaaauaguuguuuaaaccuauuauucuguuucuuuacucuagcacaucugaacagaucauacaugaucucaguagagguaacuaaauuaggguauauccauaaaguagaagauuaagcauucauaaaaagugauacagaugugugugauguguguguguguguguguguguaugaauauagaaauguguucuugauauaguaaguaaacaaguauguauuauaugaagucauuuauaugaaaaauguuuuuuaaaaauuuagugaaguauacaauaaauguuaauaguggucaucuuggcauuugagauuauuacuuuuuuuuuugcugauuuauauuuucuaaaguucuucaaugaacccacauuacugaguucuuauauuuuuaaagauuaucaaauugcuuagaguguuuagaugccaagguuaugacuauuacuuuuuuugugguggcaucuacuucaaaacacacugaaaauuuaguuguuacauagcucagauaugaaucacauucuuuuggcugaauuauguugcaaaagccaguagauaaauuuggauuugaauggacccauuagucccaaucuggcuuccucuaagggacuuuuuuugauucuuuuaaggcaaaugcuuacuauacagagguaauauuucaugguacucuaaaacuuacauauuuuaagagauuuuuaguuuagauuaagucauaggaauugucuacauaucauauauguauuuuaaagauccucugucuacaugcuguaugccaaauugguugcuuuuccauuuuuuaaaagggaauacuuuccuuuaggaaaauuuugauccucaucugcucuuccagguuucuuuuuuggggggaaauuggaugaaaguggggggacggagagugugguuucugcucuccaaauccucgaguuuggacaauccaaaaggcuggcauaauuaaauuggcauaauaaaaaugucuaugcauuuuauguuaaguuauugugauuauuuuuauuguccucacuuaguauuacuuuguuucaugccauuuugaauauuauaauuuuuuaaauuuuauaauuuuaaagccauuucuaccaucuaaacagaaauaggaaguugucaaggguacguaaugaaguaguuucauaaauacaaagccauguauuuauuuaugguuguaguauacuugccuuggguuugggugaguguuagaaaggaacuggaaagaauuugaucuauaaugaccaaggauuugguguuggguaaaaguagaccugucuuucucuaacuuaaaagcacauaugccaaguucaucaucaaguacuguauuauuaacagccuuaauuaguaggcuuuagaaaguucaacaaguuaguaaauauuuugaaacaauaggccaagacuaagaauuuuuaaaaagugaaauuuauugccaguagagugugugaugcagaaaguacugcuuggaacauuuuaaacaugaaauaauaaaaugguuugggaugcauauacaaucgaagaauauccucacugcuauuucauucaauaauuaacauacauuaaagcuaguaacacagaauaagucauccuuuucuguugcugucaguguuguugugguuuuaucccagagcccuguagaaagaguagaccucagggcuaaggacagugugucagcuggcuccauguggaguucuugacaguuugggauuauagacucucagcugggaaagaacuguuugaugaaugaaauaguugggcaagcuucacauuuuuggauaauucaauguguucuucaagcgaccuugggcuggaagccuguguguaacaauuuuaucauuucuuccuuugcauuuucucuucuugucuaaucuuaggaucuaauuguugagggaaccuuaaacgcccuauaacccagccauuccugugaugugcucacccagucucuguuugcacaccuccaaugauggcaucucacugcugcugcugaugaugacgauucuagcaacuuacacuaauugaacacauucugugugcagauguggugcuaacaguuuaauccucacaaccgccauuuugcagaugauaaaugugagccauacugaagugauuuguggcacuggacuucuuucuauuucuccaaaggcccagugugucuuccucagggccuuugcacaucucucuucuuccaucuuugccuggcugguuccuucuugucauuuagauguaggccuaaugucaccucuucagagaucuuccuugcugacuuuagaaaguagcucucccagucacucuugacugcaucucuguauuuacguucccuguguuguucuuagcacucucugguaccuuuucugguacuguguguucauuaauagccuucccacuagaacagggcuccccaacucccagggccuggacugguaccaguccguugccuguuagggaccagguggcacagcaggaggugagugguggcugagcaagcacuaccgccugagcucugccuccugucagaucagcggcagcauuagauucucauaggagugagacucuauggugaaccgcacaugcgagggaucuagguugccugcuccuuaugagaaucuaaugccugaugaucugagguagaacaguuucaucccaaaaccaucccccucaucccuuggaaaaauugucugccaugaaacuggucccuggugccaaaaaggcuggggacugcugcacuuuaauuaacuccccaagagcagggaccaauacaucccugguacugagcccaaugccuggcucauaauaggugagcaauaaauguuuauucaaugauaaaggcuacagagucuggaagugccagagcuggcauuugaacucagaugaucugacucuagaaacccugcauuugaccucuauggagugcccagucuccuaacucacaagacauuuuauuccauugcugcucggugacucuucuucauuuugugccuaauucugucccuuacacauuuugcacuguauuaauuguauuuauacagcucuucuaucucuuuuuuuguaguuuucaggggugggacccuggacugugagguagagcuccucuggaccccagguuaguaucucagagcccugacaagggaaggccaauuguaagagacacagccuacugcuucugggccaguugcauccuuucuugauuuuuggcucuagucucugucauucucuguugaguuagcaaaggggaaaauaccagaggacaaacaguccuuuggguggaagauagagaaauggauaauguguuucugacaugaauuccuuuuucucuuuucuucugacuacugcucaaggcuuuuaacgagcugaaguuaaaaaaaaaaaagguaguggauuucauaaggacugacauuuggcacaguguagguccugguccgaugcccagauagguaucugugguacugaaagaguugguugaggaguguaggggaaggaagcaaaggguugguugaggaguguaggggaaggaagcaaagagagaccagugaaauaaaaauaaaacaaauuauuaaauaugaaauauuauaccagguuacauuuauagcaagccuccugaaaaucugcuauguuuggaaaguaaacuugcuuaacaagauucaauuuuaugaaaauucugaggaggauuaccuuauuuguuuaucuuucugaggccuuucuugaggaaagacagugguuaaguuguauuuaggcagucaucggucuauuucuuucuuuuauguuuaaagcaguaucugugaggggauuuuucuaaacagcucaagggacugugaaaaaauaguucauuuuuuguuucuccugaagcuuuccuuggcuggaauaccugugcuuugaagggaggucuuugagcagguuuguuuuuuuccaugagcccuggggauuuguagugauagacaguaacccugauggaaauucaacucuggcagagaagggcagcuauucuuguccugcuuguaaagauauucuccauguuguuaccucauuaugcugaaguagugcaaucaugagaaaguuuuuuuguauuaaugugauucucaugaccuguuacuaugguugugaaacuuuuagaggagauccauucccgacuggaaaacgugaauugcugaggaugauucuaagcaaaggaaguacguuaauuauauagacagaacagagaacucaauuuuauugaaccuuauuuguacccagaaguuugaacuagaugcugauaugaugauuuuucugggaacaagucaacaugcaagacuauuugagcagcuguaaauauuaguuaaaauuuaaucuaaagcaauggagaaaggguacucugcugaagugguuucagaugcauuggcuggauuuuuuuuucuccccuuaaauuguguggaggcauagacauuuacuauguuauauuuuuaucuuuuuauaugccuuaacuguuuaauaauaaauagacuuauuucaauauuugaaaugugaggcaguaugaguucuuaauguauacuuacucucgagaugauggcucuuggacugagaaauugaaaccaggucccaguccuuucgcuuuuacuuccugugacacuggauuugcacaugucaauuccaggaagcagguaguuuccagcauccaugugguuuuccaaucuuugcauuugugccuuuaaacaaccaaauaccugacguuuauuaauauccuguggggcucuucuaucagaagcacauucucuuggcccgguucauaagggaaaugucuguguaugcgcaucuggcagcuaagauuaagguuuacagugguauaaccucaccuucacuuuuaagaaauuaaguuuaaaaaaaaugcagaucugucuuucauagcaguggagcucaacaacacauagagcaugagagucacauuuuuugugugaauauuuucgaaugagccuuuuuugguauguggacggguggcuaguuacauucaguucaauccuuuuaacauuuaauuauggaacaaaaucuuuuuucaaaguguagagaaaagcauauaagggcauuucugauguagcagaggaauccaauaaaaaauaugacuuugugucucuaaagugguacagcuuugaaauuaacacaucuguauaauuucaaaaguaugaucucuuuagaucuuuuucuuuaauuucauagucuuaauuuuugcaaauuucuucaacuccauucucuaauuaagauuuugguauacaauauuuauaugcaaaagauuuuuggugcaggaaauaacauuuugagguugauacuaauugauuuguucacuugccccucaaaggcuacgugugagucauguuauuuaacauugauccagucaauauguagauuuaugcacaugcuuuuauuuugaaaacuagguuuugagcuucucacauauggaguuccuaauucaagcuuuaugucagaaccacccuucuggguccagacucagauaugugggguggggucccagcaucuggaguuuuaacaaguucugugggcuauucucuuuagugcucuuaauuuauagacaaggaaggcagguuuaaaagucauagaaccaaagugaaaaugaucugcauuuuagaggagcaaggaaagcuacaacguuuauuauuucuacuuauaaacacuucccuuuaaauaauuugaaaagauaauagauuucaugauguugggcauuuuuucuuuuacacuguauuuugaagaguuuggguuguguugggugaaguuaaaagugaggaaagugggucaggagagugaugaaaccuggugcauuucuuauuuuggcccauugaaccagaagaugauaccaauauaucuagugccgacauauuucuccacugcgcuccuuaguuauugcugcaguguguucaaggucuucuugcugugaguguaacaucacaucuugaacucuuuuucuagggaaugcaucagcuuagaguccgcugaugcauucauuauaaaaauguauuguguauauuuucuauuacauuauuucaaagacagacguguuuuugaaucauggugggaaaaaaacuccucacauucaaccucuaugcuaguuuucuuaucuuaagggggggugguuagagaaauguauuauauauguauuaauauuugccucccuguuuuuuaauucuaaauaggugacauauuuaauauaacuaugcuugcuuuugaaauaauuugccuaccauucuuuaaaaugagugaauuuuaaaagauguauagugauuuuuaugugaagaugaauuaaagaguuaagugacauagaccaccguagcauuuucccuauggaucuguaaaaacagcccaaaagucuugugauuuuuuuuuuuuuuugagccguagucuuccucuugcucuguugcccaggcuggagugcaguggugccaucucagcucacugcaaccucugccuccuaggaucaagugauucucccaccucagcuucaugaguagcugggacuacaggugugugccaccaugccuggcuaauuuuuguauuuuugguagagaugggguuucaccaugucagccaggcuggucucgaacuucugaccucaagugaucuacccaccucagccucucaaagugcuggaaauacaggcaugagccaugguucccggccucuugugauauccuuauauucaguuaaccaaaccaaaucaagucaaauaacaaaccccaaaccuuuuauagaccuugaguuauuugcagaucuuugggguuauuuaccugucuuuugagcuuuaaucuuuuaccucuuugaagauacaggaagggaucuuuauuucuucuuugauaaaauaaccuucagagugacuugagauacggaauugcuucuuuguauaucauugugugguauuugagaucacaucucaaaauuuaaugagaccugcuccucaggcaguuuuaagauuaaggaucaaaaagggagccacuggaaaggugugaguggcugguaaucuauguuagaacagagacuuuggugcagagguuggccauguucauauguggaguaaguuuucaugaaacaggaggaagccuuuucuuauuugaaacuaagaaacugcaaaauaaaaguaauaaaauaccccgaagcaaauagacuuuaaaacaacauuugguccuaaguuguauaugaccaauuucuuaaagugauuguuauauugccaguuuugaaauuauauuaucuuuuaaaauuuaaaauguaaauauugucucaggggugggaggaugaaucuccaucuuauuuaguguuaaaggcuccuggacuuacccuaaagcccagcuuuuucgguggggggcucauaaauaaaacuguguguguucuaguuuacucuguuaccucaucuaguuccuuuaggugauuagaaaaugccguauuagcaaauauaaaaagguuuacuuuuguguuuuuacaugugaaaucaauggccaguucuauaauguuaacauaucagacccuuaauuauauauuaacucccauuuugauaguuuguauagaaaaaucagaguugacuugaauuauuugaacuugcauacgcuuuuucaagauacguaacguguuguaaauuagaagaguguugguguuuucggaacacaugcauaugcuugcugucucagggcagccuuguugggcauuuggugucagacauaccuuauucugagggccuuggcaucaaggcagauugcucagagagggggucucucugcauauaugucuaagggagacauuuagggaagucucaugccauccuaucuuucuuucuuucuuuuuuuuuuuuuuuuuuuuuuuuugagacagggucuugcuccauugcccaggcuggagugcagugacucaauuucagcccuccgccucccagguucaagugauucuucugccucagccucccaaguagcugggauuacaggugccugccaccaugcuuggcuacuuuuuguauuuuuaguagaaguggaguuucaccacguugccgaggcugguccugagcuccuaaccucaagugaaccgccugccuuggccucccaaaauacuggauuacaggcgugagacacugcucauggccaccauccuacuuucuaacagcacugccccacccucccccucgccccaaaaaccaccaugaaggaggcagagggcaccaggugaagacugcccaugguccuuuucuuaccucugugacuucgcuuguuuuguguucugggcuugauuguucuccuucucccugcguccccaguuuugcaaccuccaucuuuaaaacaucagcaucagugccaccagguguucugcucucugugcuaucugcaugccagaaucaaucuuucccacguguucacucuucauuucuguuuguggcccuucuggcuuguguaugucuauaugccuuuuuucaucugacuuucugaugcuagccuuuagcuuagucuccacacacacaguaagugcuuaacaaagacuuguggccgugugcaguggcucaugccuguaaucccagcacuuugggaggcuaagguggguggaucaucugaggucaggaguucgagaccagccuggccaacaugcugaaaccucgucucuacuaaaaauacaaaaaucagccaggcgugguggcacucaccuguaaucccagcuacuugggaggcugaggcaggagaaucgcuugaacugggaggcagagguuguagugagacgagauugugccaaugcacuccagccugggcaacagagugagacucugucucaaaaaaaaagacuugcuaugccuuuuaaugguuuuaaaaauuacacuugcuuacauacauaccucauucauucagcaaaugguuauuguucauucauuguuagaugcugggcucagagauaagcaagacccaccucuguucuuaagaugcucucaggcuaguuggaaagaaagacaucaauaaacauccccacacaaaccagggacacauggagggaggaaggaugucuugcuuugguuggaaugaggguagguuugaguaagagagcgugaaagaggcaaggaauuugaggugugccuugaaggauguguaagaggcaacgcuguggacagugugggaagaacauugcagaugaugagaaaagagcaaggcauuugaagucugucccugguaacugaguguggcugggguaauggggaugaugggagaagcuggggucagauuucgaaagcccuuuugaagcaggguuuauuugaucuuucccuguaagaagccacuacaggauuuuaggugaguuaaugacuagcucagaacuguuuuucagaaagauaacuuggcuggcagcaggaaagauagauuuggaagguagcagaguuagggggaggcagggaacagguaagaguugugaaaaaauugagguuaaggaguauaaggacuuggaccagagugguacaagaggagacugagcaggggaaaggaugugaaaagugguuagcaguuaguaacagggugugcaaagccucaauguaaacuucgccuuugugggauuuguuaguuaguaacaguauguuuaaagccucuagguaaauuucaccuuugugggacuuuuuaguaacaguaucuauaaagccgcaauguaaacuucaccuuggugggauuugcuuuauguuuucaaugagguauguaguuuuucaaaucguacuguaauucagauuuucaacacuuucgguuauuagcuuuuucucuagaauuuucuugaucaauuucuuaaccguuuacaguuacuucuacuucuuacugaaguugacuacugcuguuuuucucacaguaccucuuggucaguuuauauggggaacuucaaauucaguucagcugcaauaggaucuguauuuuuuucuauauauauucugagagaagggucaugcuuuaggaaaaaguugaugaaaaugagaaaagagaugguuuauucaugucuaugcaguauacuauuaacaguucuuugaaaaaguagcaaagaaagguaauguuaaucucaucuuaaaugaagguaaaacucuugcacagcuaagagaaaaucuauauacuaaaagaguuuggaaaacuacuucagaggaacuuuaauuaaagaguagucuaaugugaugcugugaagauaaugccauccucuauuaguaauuucagcuucaacaaauaggauagaauaaaugcaaauuaaaaauaaauuaggagcagauguugagaaauaucuuacauuuagggaauucuuaagugguagaagggcccuggaguucaguuaauaaagcugggaugcucagaaauuauaauaauucagguaacaaaugcuuuccuuaaugugaugcucugcuguggagguuuugggaauagaagaaagaagaggcuguuauugucauacuguuuguaaguucaucuuucuuuacauucaguggauaacuaaaaucuacuauauaugcugauauuucagaaauggugguucccuuaaccuucaagaaaaaacaaaagcucucauuuguaaacacuugcaagcauucuuggguugucucuuggugguacccaaguuuuugcuuuggccgguaagagacuuuugcauaguacuuuguugccuugccucuacaacauguuaggcuuguggauuggcgcauggugaauaagacacaguuccaguugucgacugucugucaccuagagagggcagguacacaggaauuuaagaaaacagauuaaacaggcaguuacacaguuguaaaaguaaaaacagcacagauugcugugugagcucacgggagugguaccugacaucccagggcuucaaggaaggcaucuuggaagaguggauaucuaagcugagaucugaaagaaugaguggggauguggggaggcuguuaagacagagggaguugaugacaagagguuuggaggugagaauugugagguuuucaauauggcuaaagcaggaugcuggagaaugaagcugagaagaguguuauaagccaucuuuaggaguuugaguuguauccuaagcauaauggugaaucuuugaaagggcuuuaaaauuaaaaaaauuuauauuuauauauuuaucauuuuuaaaauucugaaguauucaaucuaaaaaaauguacaggaaaugauauaucagauaugcucgugcccucauuugaaauuuaucagcuguuaauguuuugacuuuuuuuuuuuuuugaaauggaguuucacucuuguugcccaggcuggagugcaauggcgcgaucucggcucacuacaaucuccccuuccuggguucaaacaauucuugugccucagccacccgaauagcugagauuacaggcauauaccaucaugcccagcuaauuuuuuuuguauguuuuguagagacaugguuucaccauguuggccaggcugguaauguuuugacguauuugauuuagguuguauuuuaaagagcuaauuaugucagcauagauaaaucuuaaaaacaauuugacuacaaacaaaaaucagguugcacaauguauugaaugguacuguauauaaagcucauauaccugcagaaauugcccugcaguguuuauguauucauauuauaaauauauagcaaaauacaaaaauuuuuauggaaauuauaaacacuagauuucuuuagagauagugagagaggagguucuucaguuuuaucuauaauauuuaauuccucaaugaaaauagaaauagaaucuuaaauuaauaugaaauaaugcugauuugugaacugagugaugacugucuuaagcccaguuccuuggaaguaggauuugagacagagauuugugugcacuugagaacaauuccuguuaaugaaagaaaugagggaagaaggacugggccagggaaaagcugaaguguaguugaguuacagcagggccaccauuggauccauagggaaugcuggugcugggauggcccuucagagauuucccaacuugaggcaauguguugagccuggggaccuuugccuugaccaguaggcuuuuggcugacccugggaaggaggugaggugaaaaucugggcaagguaacuuggccaagggcaguuccuggacggaugcucagcuaugagcccucagcugcugggggaaugaauuugugcauugccuugccugaaaggcagaucuggauaggagauucacugcagucauggaccuuguaccauuuucuuuugccuauuauugucuauuucuaugucugaaagauaugacauauuaaauaaaaaaagcuuccaauuucuaggagcaguauucaccgaacuacuucccugacacauacauaccucacacccugcacacaccacacaccacaaaccguagcuguaauaucagguuacauacuuucuguuuuauuuucccuuuucucuguguuuuugguuacuugagauggccuccucucucucacuccugguuugggaaggccuugcuuccucugaaagcuugugagcagagggcugaucugaucagauuugcucuucugaguggugcucuagaagccacguggagcauggaugguguggggugugugcuggaugaggcaagccugggguucuggaggaccuuuggguggcugucacaguuagaggauaagagguauugaagccaaaacugagauugagguagcugggaaggaggagaggggagaguuuagaagcuuuagguaggaggcagaccugauaggacauggugguggucuucagaugaugggugguggaugggauggagagagaagccugguuuuugacuuuaacacucgcaaaugaagccuuucuuucuagguuuuguggagagggcagugcauaaggggauaguaagugaaguucuagauugaguuuugaggugccuggagauaucugggaaaaauauguaauauauauauuucucuuacauguaugagacuggcuugggcuggggucugcccuugaaaacuggcagcuggagucuugaguacuuuccugagucauuuuuugagcucuuugcaagauaauguuaaaaauucaagaggccgggugugguggaucaugccuggaaucccagcacuuugaaaggccgaggcgggcggaucaccugaggucaggaguucaagaccagccuggccaacauagugaaacccuaccucuacuaaaaauacaaaaaaaaaaaaaauuaccugggcauggggucgcgcaccuguagucccagcuacucaggaggcuaaggcaugggaauaauuugaaccugggagguggaggcugcggugagucaauaucacaucacugcacuccagccuggguggcagagugugacucuguugaaaaaaaaaaaaaucaagaacuguugcauauuuuauuuaucuuuguauuuucugagauauuuuugacugacccuaaaaugagcaucuggaugguagaugacggcagcggaagaugaagaauuaagaagugguuuuugauuuguaauauuuuuuaguagauauuauuaguugaugccgcaguuguugacuguauuuaucucccaagggcauaggaagcccccuugcagauauuacucuaccuagccugacuggguguuuggggagggagagaagagguuaacaauaaauccugcaauaugugcagaaguuuuuacacuuguguuucugcauauuuucuuagaaaaaggguccacaguuuucauuauauucucaaaggagaccuaugacuuaaugaaaaguuaagucuuguuagaggaagagugacauauuauaggguuaugucuucauaauguuucuuuuuuucugaaauuagauuggcaguccaauacgcuggcacgaacugagggucucacacuuuugcuguaacucaaauucugguccuuacuuuacuucuacugccuuaaagccacucaaacaaaagaccugauugcuagaauuagguugagaagacacaaaguuugaagggcaaaauuucugauaauguuugacccaguuuugcauauaauguauuuuuauuuguugaugaauauuucccuuuuguugcuaaaaguggcaaauaaucagacauagauuacuaauuaacagucugccucaguuuuuuuuuuuuuuaauuaaugaaacuugggcuucaucaagcucagguggaauggauaucacagugcuuuauuuuuucugacaucaaaagaaauuucuuugucaaaguguagacauguuuguugugacugccuuuuguguggguucuuuucucccagcccucuccuacuacaggagagagagauaauggcccuuugcuccucauuccgcauucagaccagauuccccagcugcaaucuccugccaucggauugcaucaccaacucaaccuaauuggugagaugucacucccucccuccaccgcucacucucauuucucagugaguuuagcucugucacucucucuaaaaguuacucuuguuuuagugauuuggguguaaacauugaugauccuucuaauacucuguccucuuaauuucucuaaguucucuuucuagugaucuugucucccagugugguggguauauucuggcuagaccaggucauuguuuaugguggcagccccucugucaucugaauuuaagcgucccauuuuuucgguacuagcauggcucacugcaaccuccgccuccugggcuccagcaauccucccacccucggguagcuggggcuauaggcaugugccaccacgccuggcuaauuuuuguauuuuuuuuuguagauaagagguuucaccauguugcccaggcuggucucaaacuccugggcucaagcaauccauccaccucagccucccgaaguguugggauuacaggugugagccaccaugcccggcugacuuugccuacucuugcccuaagaaaauugaagcaaaccaaagaggaauccagaaacuucaauaccacaucuauccucaaccagaacccacccaaggccacccuaaccguguacauuguacccauccuccuuuacuuacucaaagucaccucccuucucucuucugcaucccuaugauuuccccuuuaguggauccgcuuacaaacaugcuauuguuuuucuucuagcaaaacuuuacuuugaucccaccugucucuguagcuaccacgccauuccucugguccccuuuaugaaagagcuccucaaagauuguauguaccaacauuugcaguucgucuccuuucauucccucuuaagaccacucaaaucaggcagacccccuaccaguccaguaaaacugcucuugucaaaguuauuagggaccuccuuguugcuaaauccaguagccuguucucaguccuuaccuuauuccaccucucaauagcaucaacacugcugaucacucccuccuccaugacucuuucuucauuuggcuucuaggacaccccacacgcuccugguuucccacccauuaucuuuugcugauucuuccucuuaacguuggagggcccaggacccaguccuuggaccuccucucuguccccacuguugccguuugucaucucaccaguauccugguuuaaauacuaucugaaugcuggcucaaauuucuaucucuagcccagaccucuuccucugaacugcauacuugcauuuccaguuguuuacuucacaucuucuauguucagaucugaaaaucugaacuccugaucucccguaaaccccaaagcugaucccacagucuugcuugucucagauaaaggcaaugugauucuuccaauugccccaguuuuggagucaucuuuguaguccuuucuuucucguauacccacauccaaugcagcagauccugcugguucuauuuuccuaauacugaauuuauacagaauccggucauauuuuacgaucuccacugcuacuguccuggucuaggggaccauugcuuuuucuggaauugccuccuuacuugucucucugcuuccucccuuggcccauggaggcuggucugaaccccacaguagagggauccuuuucaaaucagaaguggauauguugcuucagguuuccaagucugcagugacuccccauuccaguuguaauaaacgcgaaagaccuuacagugaucuacaggacccuguuuauccugccuggcuucaucuccccuuacuaguuugugcucauuauaugaggcaggcaccucccaggucagggccugagcccucuucuagcagauaaccuuguggcuaacucccuccucucagagagcuacugugccagucaauuaaaauagcaaauccuucccucauuagcccucuccacccacuuuauccuguuucauuuuuucccauagcacuuacuggauuaugcugauugucuuuuuccacuagaaugcagguauuuugucuagguugaaucacuaguaucuagaacagugccugacacauaguaugugcucaauaaauacacgugugcagaagcaaaucacauuuuucauugcuuuccacaagugugagccugggcuacauagugaaaccccaucucuacaaaagauauaaaaauuggucugggugcaguggcucaugccuguaaucccagcacuuugggaggcugaggcaggcggaucaccugagguugggaguuggagaccagccuggccaacauggagcaacccugucucuacuuaacauacaaaauuaaccaggcaugguggcucaugccuguaaucccagcuacucaguaggcugaggcaggagaaucgcuugaaccugggaggcggagguugcagugagcugagaugagccauugcacuccagccuggguaacaagagugaaacuccgucucaaaaaaaaaaaaaaaaaauggcugggcaugguagugcaugccuguggucccagcuaccugggaggccgagguggggagacagggaucacugggcguggcgggggguggggggcgugccuguaaucccaacuacuggggaggcugaggcacaagaaucgcuugaacccaggaggcagagguugcauugagcugagaucgugcuacugcacgccagccuggauaacagagcaagaugcugucucaaacacaaacaaacaaacaaaaaacaaacaagugugcaaucccugagaaaaauaucaguucaaucuuuguugaucuuuauugucccgauugauuagcugcaugucagccuuugacuguguuucccagaugcucacgacagaucgaucacuugauguuguuuucaacaggcagucaugaaaugagcagacugaggucaguguaguauagauauuugucagcgugguugccaacugccuuuccucuucuaagauugcccuuuauugugugauuauauuacauuuuuaguuggcaugaaaaugcccauuuagugaaaugaugaggaucuuccugggggaagaauucuggcguaagaagcuuucuucagauuacuaagcacucuaaaaggucccagguuauggggcucuggaaaguaacgaugcgaauacuucacuugguuaugugauuuuuauuuuugccuuggaagucuuucugcaaacaagucuuccaguggaggcucauuuuaggaaugugacgaugcauugcugauagguaggauguggcuuucuauacagcagaguuuggggggugggacuggcaggugaguagcucaacccaggcuucugaggguccuucaugucuuuuggaacacaauuugaaaaucacugcuuuaauugcuaaauucuagaaaaccuggaugcccuauuuaaaaaaagagcuuagcuuagugucaaagaggaacuagguuccaguuuuagcucugcagaucaccagcugugugaccuugaauaugucacucaagcugucugcacaauuaauugauuuguuuguaagguaaggaguauggacuagaugaccucacacugaucacuuucuaagcuccagaaaaccuaauuguuaaugcuuaauugugcgagcugugcucgggaagggcuguguucuaguaccuucuuccucaucacugucauuucaguauuaucuacacugaucuucacaaauauucugcacacuuggauucuaaccugcaauauugcuguugggguuauagaaauauagauuauaugaugguauuuaggguaagcauuuuuaucucuaaaaugaguuagauaucaaggauggcaugguauuagauuacacaauauuugaaaagaauaauaagaaaaauccugcaggauuuaaaaaucuuauuaguacucuucuguagaaauacuuuagggaaugguucagacaguaucaggugcuguggguguaagcauggccaccugcuagcucugugaaccuggacaaauggcuuagcugcucugugccugaguaaaguagagauaguaauagcaucaaccuccucguguuguaaaaaguaagugaauuaacauauauaaagcaauuuggggccaggcgcgguggcucaugccuguaaucccagcacuuugggaggccgagacggguggaucacgaggucaggagaucgagaccauccuggcuaacacggugaaaccccgucucuacuaaaaauacaaaaaauuagccggccugauggcaggcgccuguagucccagcuacucggaaggcugaggcaggagaauggugugaacccaggaggcggagcuugcagugagccgagauugcgccacugcacuccagccugggugacagagcaagacuccaucucaaaaaaaaaaaaaaagcaauuuggaacauagaagcacucaagaaauguaagccguuaccuccauacaaauaauuauuauaauguggguuuauuucuuuccagucuuuuaaaauaagcauguaaaaauaguuuuaaucauauugcacuaggaagauuuguuuuuguuucuuaaauauauacagaauuucccuuuuucugcuucuuuauauuuaauaacaagacauucuaggauagacuaagccuuuucauggcuaauuguccuguggaauucuuuuaguuuuucucuuccauguuuauauauuugauaugauuuucugguagaauucuugaaaaaauaacugcaucacacaguagcucuccucucccauuuuauuuuauuuuacuugcugaggcuggauauuauauucuuuuggcugaagucaccauaguggauucauacaacuaauuuccagccaguuuauguagaucauuugcaaauguauuaguuacagagaggcuccagggguguaccaaagaaaccucaaaauacaguggcucaaauaaaaucagaguuuauuucuuucucuccuuacaguucagaguuggugggugauggagggugggaagguggcuccgcuucauauggucucucagggauccugguuccuucucucuuguucugccuuuccaaaguguuguuccauuuucuugaugaggcuugccccucaacacuaugucaaguucuaguccaaggaaagagaaaagagaaguaaaaaauaagcaauuuuuuaaaacgugcauggcccucagguugcauuccugauuucuuuucacaucccacuggcugcugcuuagccacguggacucaucuugcugcaagggagguugagaaauauggcuugugcugagcuagaacuguggggauggaggagaagagcagguuucugauacugaaaaaaaaaaaaagaaaagaaaauagaaaggagaauggauaauaauaaauauacauaugcuuugaucacaauuucaugggccaaguuugaguuuggaauuuuccaaguccucagauucuaugacagaacauggugguggagagagcugcccccuggcuccaguuugcagacuuuccccuuugucugcccaugcuggcuccauuuggcacugggaagggcuuugcacccaaguuuguggucaguuggccaagcacccauggucucccacucuuccccacuugcaaacaguagugugguccacccuugcuugggaaagagcccagugcucauuugagcagugaguacuaggacccugugccucuagaccgugcuuuaggacuugcauauccccuugguccucugauuucucuauuucugggggagagauggggauggaagaggguagagugaggcccucuaaaagucaggauuuaaggcaagguccuugcuugucuaggucuacaggugaugcuacaaagagaauguuacauugauucaguucuuaaaauuuucccuuuuccucaugcuucuguuucauuaauauucauauuuacuuuuuauaauauacauguuaugucuuuaauacacuaggaguagaauauuuguaaugaaauggagugcuguuuuaauggaugagaaagguagggaggggcucagagagggaggcuggagaauauucacuuauuuagcuuaauguuuucaacagcuuaaaaaaagagaaaaaacaaccuuugaguggcccuugugauuaaauggcaguuugcccagacuagagggagccagcguugggaauaaaaacuaagauucacuuugaaaaucuagaaaaaaaaaaugacuacacaagucauaagaaugugcuugauggcuuggguugucugagugcaagugaaguagggcgcaggccugguuuccgcauucccugucugcucagccuuuuagcuccuaaccccauccacucccuagagcuggccagcccagacccaggaccuggaugcugaccucuucagggcggagcuguugcugugcucagacaucgugacaacuuguugaugggaaauguagcugaaagucuagcacaaaaagcugcucuuggguuggccagcgaaccuccuucaugguaaaacuccccaucccuuauccaaauccuugggaccagauaugcuucagaauuuaugauuuuucuuuuucccauuucagaaaggcuauggcccauaugcccuauguuacauaaagccuccagaggaguuugggacaguacccuaucauccaauaucuucaucauucugcagaaaauguaugaauauuuacacuaaguggaacacaaacaggguuauaaauagccucaggucaguucaggucacguuuugcugccaaauggguuauggaaaaagccuuugguuuccagagcuuuucagauccuggcauuguggauaagggauugugcaccugguauggugacugcuuucucaguguccauuuggugccauuuuacauguauugcauuugaaguacucacaacaaaaauaccuauguauauauauaccucucucuauauauuuuuuuccuuauuuauuuauuuauuuauuuaacagcuaaggaaacagguuucaugagcucgaauggcuuacacaagaucaagaggagaugaucuccuuugcaaacagaggccaggacccagggccugggcacuuagugggcuauaagaguuucuaauuugcuuguuugaagcauuggaacauaagccagccugcagaauccuguuucacauuuaaugguagcugaaagacaauacugcaguaaaagugccauaggauguaauuauccuaacauuguuucuuaagaaaagacaucuuaaguucaaccagcggggucaggaaguggggucccuggccugaacaguggcuuaucuuccuuccuggauggcuggcaggggcaguaggucagucagggcacuguuccaggacccaguggcagugugggcagcacuguggugagaugggaagagaggaaggaagguucgggugcuugaugugcauugaaggggucagggaagggggaauuggcuacuggcugagguucugacacuaguuggacagggcccgaugccaaacucuuguucuuguucucaccuagaaauugccauuaguuagugcugcugcugggcauuauuuuaacuuagaccaaggcagcccuuuugcgugggcaauuagauaacggcgcccacucuggagagacacagucugauggacacacuacuucgugggcugugccuuugugcaaagcaaaagguguucuuuccuccgugccgcugugcuggcuggauuucagcgucguuuuucaccuuggccucgugccuuuaugcaguggacagauuucaggcagcuuggcauuaguaggaaucuaccugaaaagcacuuuauauguguuugaauccuuggcaugaucuggugaugaucuggcagaauagguauuaccaugauuugccagaugagaacgucauggcgcugugaacugcugaaggucgccucggcuccauugcuaucuggacaggacuguucccuguacacucccucuuucaaaauggaagaggcagcuagaggauuucaggauacauuucccucaguuguuuccuucugcacuaccuucucaucuuucaugguuguauuaaaaguggggccuggcacaguggcucacgucuguaaccccacacucugggaggccgaggcaggaggauuacuugaggccaggaguucgagacuaggcugggaaacacagugagacccugucucugcaagaaaacaaaaaaagucucuaaaaaacaaaacaacggauagacugauguugguuccuauuuggauauguguggcaauugguggcucuuacugaccccauagcucucauucaggugguuugugugauagugggcacaauguuguugccaauugaguugaaaaugcugucauguugaaagaaaacaucggaaaugagagggucuggguaaauauauuaguaguauagcuguugcuuuguuugcagucucuucacuuacauuacuuucauuuaaaauuaaccauaaucuguuaaacuuuuacuuccaauaauguauggguucaggagucuuagccaaagucaauguuuuucacaggaaguaucuggauauacauuaacuuuuaaaauuguaaccaguuaguuucacuauaaaaguuagcaaagugugaaugaauugaucgcuugcuaaucuggagcacacaagggaaauuaauuuuagauggagaaaauauuuccuaaaauaacagagggaggcagagagcuagguguauguguugggccuuucaaauauauuauuucauuuacucccuaccauaauuuuauggggaagauauaauugucaguguuucauagaugaggauaugcuuguuauuaguuaggacuuagaguaaguuuuuuaucauauuuaaaaaaugccccaucuaauucugaauucuuacagagagccacauaggaaguaggauuuugaaaaagcaaaaaucaacaacaaugcagagaggaagaaaugaguggauugguaagauaaggccauggguaguucacagaaacugcuugcuuucucuaacaugcuugcucccuuugguaaacuuuggaugcauauuugucucaaagugucauauuagacaaagcaauaagaaaaugguuaguuuuaagauugacauaauucauaaauucucacaaauacauuugaugaaauaaggcaguuuguguuucuccugguccugaggacccccaaaacucagaaccucauaaauaggacagcgaaugauauggaggaagcuauuucuucagcuacaugugauaaucuagaugaauagaacucucauuuguggcaucccauauuguaaaccaguuacaguacagaaaaucauuuuaaaaaaagagagauugcaggaaguucgccaacgauuugccuuaauccugaagccaauuuaaacauuccaaucugauauauauauuuauuuuaguuuauuuuuuuugagauggagucuugcucuuuucggagugcaguggggccaucucggcucacugcaaccucugccucucggguucaagcaauucuccugccucuaccuccuaaauagcugggauuacaggcacccaccaccaugccuagcuaauuucuguauuuuuaauagagaugggguuucaccauguuggccagguuggucucgaacuccugaccucaagugauccacccaccucggccucccaaagugcugggauuacaggcaugagccaccgcgcccagccccaaucugguaucuugauaaauuaccaaauuguuguaauagagauuaguaccuucucuuaccuuucuuuuuauaaauuaauuuuuuaaaauaguccucagacuuuccugucaaggaacccuuugauaguugaucauauugcaugguacuuuuuccauugcuuuauguaaauuucugcucucacagucaguaaaucugaacauaagcauuucuuucugggcuuuguucuguccuuuccuuuccuggaaauagcuuccagaugggauuguuuucuuuugacaaaccucacgacuguauguuucaccauuuuuugaccuauuaucucuuuuugaguuucauuuucggcuuagguacucugcuuguaggauuuuuuuuuuaacacccugugauauauacugaaaauacuuugcacuguuaagagccuguacaauaauacuguuaacgaugaagugcuguggacuucucuguaacucccaauucuucaaaggaaaauuuuccuucaguguauuccaucuuucuuacuucuucaaguuuauuuagggaauaccaagaaauaaaguguugcuuaguuuaauuccuuuauaaugucuuuauuuuuauuuauuuauuuauuuucugagauggagucucauucucuugcccaggcuggaaugcaguggugggaucucaacucacugcaaccucuaccuccugggcugaagugauucuugugccucagccuccugaguagcugggauuacaggugccuaccacuacgccuggcuaauuuuauuuuauuuuauuuuugagaccgaguuucgcucuaucgcccaggcuggagugcaguggcgugaucuuggcuuacuggaaccucugccucccggguucaggugauccucaugccucagccucccgaguagcugggauuauaggcacuugccaccacgccuggcuaauuuuuguauuuuuaguagagaugggguuucaucauguuggccaggcuggucuugaacugcugaccucaagugaucugccugucucgggcucccaaagugcugggauuacaggcgugagccacugcaccuggccuauaaugucuacugaaaauaaaucuagcugggcauguuggcucauaccuguaaucccagcacuuuggccggcguaggcaggcagauuguuggagcucaggaguucaagaccagccuuagcaacauggugaaacuccucucuacaaaaaauacaaaaauuagcugggugugaugccagcaccuguggucccagcuacuugggaggcugagguggagggaucacuugagccuuggaggucgaggcugcagugaacuauggugguaccacugcacuccagccugguugacagaaugagacccugucucaaaauaaaacaaacaaaaauaaauuugcuuaaaauuuuuuugaauuaaaguuaauuuuuauaauauuuaguuagguuuuuuuuuuuccucauuauucuuucacauuuuuccagguuaagguacaugaauuuuacucuuuuaauguuguggcccaggguagucugucugccaaucaggcuguuaaguugugggucugacauuuuccuuggaaaugcuguuucugggcauguuagacuuucuguacuuguguguugccuuuuggcagagacuucgacacuuaaggauuuguugauaaaaugacaaauuguuucaugaggcauuuacuugguacuagacauuuagaugauuguuucucggaauaacuugguugacuaacaucuuucugcuuccugucgucaugaucacuucugcaaaggacgaagccuaguacauuuucugguagaaucuuauauaccauaagauuuaguugaaacauuguauguuucuaucuucaguuuuuggucccaaguuauuuuaaguaauuuuuucuuuuucuguugcccaggcuggagugcaguggcgccaucucggcucacugcuaccuugaucuccugggcucaaaugauccucccaucucaaccuucagaguagcugggaccacaggcacaugccaccaugcccaguuaauuuuuauacuuuuuguagcgacaggcuggucucaaacuccugagcuccagugauccaccugccucacccucccaaagugcugggauuauaggcaugggucaccaugcccagacuuaaguacauuuuuuuuuuuuuuugagacggagucuuguucugucacccaagcuggaguguaauggugugaucuuggcucaccgcaauguccgccuccuagguucaagcaauucuccugucucagucuccugaauaguugggauuacaggcacgugccaccacgcccggcuaguuuuuguauuuuugguagagacgggcuuucaccguguuggccaggcuugccuugaacuccugaccucgugauccgcccgccuccgccucccaaagugcugggauuacaggcgugagccacugugccuggucuuuaaguaaauuuuuaaagguguaaauucugcagacucggauaaaaauaauuauucuauugugucuuaacagaucguuauaauugugaagauuaaaugaguucaaaguauuuggcuaauauuguuaggggcuguugcuuuuguuauuauuauuacuauuacuauuacguccuggcuucauuccugcucucucuuucccucuuugcaucauugccucugacuaucuccaggcugcugauagugagaggggccgucucccaauccagguuaccaggucuggaugaauggacucugacccacuuuucuggccacuggaauuuugccuuugugaauauuauaaauaguaauauguauacaaagaaugauuaugaaauaaucaauuauaaauugguuggaaugugucugaugcucagacauacacacacaauuugacauucugguuagauuucucugugcaggaagcaagggaacaacagagcagugagaaaucaaaggagagaaggguauucuggggcaaaggacaguuuccauagguagaauuacagagguaaaaccauuaaucaaaaaaaacuagugcaccacucacucgauuuuuccaccccuuccuuucagucguggucugagcuuucgcauucagguugaagaugaacuagcaugugccucauuuaauacugggaacuuuuauuuaccugagucugcuuuuugaaaucuguuaaguguugaguuucuauuugcaccuuauucaccagauuuacuuauugucuuucccugcuaauggggauggaguggggggaggugcucguggcaggcacucagacaagcucgcugugcagcaguggcucugagggcacagcuguuuggaaucagcugaucauuuucaagcaucucuagcucaucauauuaaacacaguugcacacguuuagugguugcuuaauuuuaaccugaaacacuguaugaaauaauuugauguauaagaaguauuguagugauaagaagaguagcuuaaugguuuuucauguuuucuaugccagccacuauuuaaccguuuuacuauuuacaaacacacacacacacacacaaccauauacacccauaucuggguauauguguuugucuauauacauacauauaugugcauguacacacauauauaaauucauuugauccucacaauaacccuauaaaagaggcacuucuauuuucgccuuuuuacagucaggaagccaaggcagagaguggguaaguagcuugcccaacacggguaaugagggacagagguggaguuuaaacccaaguagcugugccauaucuuuuuuuuuuuuuuuuuuuuuuuuuugagacagagucucgcucugucauccaggcuggagugcaguggcgugaucucggcucacugcagccucucccucccggguucaagcgauucuccugccucagccuccugaguagcugagauuacagguguguaccaccaugcccggcuaauuuuuguauuuuuaguagagacaggggguuucaccauguuggucaggcugguuucgaacuccuggcuucgugaucugcccaccucggccucccaaagugcuaggauuacaggccugagccacugugccuggccuuuuuuuuuuuuuugagauggaguuuugcucuauuucccaggcugaaguauaguggcgugaucuccacucauugcaaccuccgccucggguucaagcgagucuccugccucggccucccgaguagcugggauuacaggugccuacauucacgccuggcugauuuuugcauuuuuaguagagaugggguuuuaccauguuggccaggcuggucuugaacuucugacuucaagcgauccacccgccucggccucccacaguccugggauuacgggcgugagcacccggcugcccauacucuuaaucacuacccuggaguaguucucagugcugagccucuaacuccaagcaaaugauaauuaaauaauuaccacaauaugcccaaaguuauuuuauuacaagcaaauuuaugaaaugaugcaguuuuuuuucacauggaaacugguuucuuuuguuuaccuuggauggauguuuguuugggaguuggcuguuuucauuuguuaaauaaauauuuuaguuggguguuuguguagcaagugaucuugguggcucccugcaguguguccugcacuggugagcaccuggugagcauucacugaaugugucugauggauuuaccacacucaucugugaaccuguagcucagcuaaucccccuaaaucugugaguggcccuucucagcugcccugcaggggacuuuguggagcaggaauuuauuuugaccagcaaacuacccuugugacucaucaccaagagcuucuaucauucucuagcaggauuuggaaauuaaagacacuuugacucagaaauaucuuccacacagggacucauuaaaugaaacuaacauccuggugggcaaaguguaggagaaauaguaaaaguggauuucggccgggcgcgguggcucacgccuauaaucccagcacuuugggaggccgaggugggcggaucacgaggucaggagaucgagaccauccuggcuaacacauccuggugaaaccccgucucuacuaaaaauauaaaaaauuagccaggcgugguggcgggcuccuguagucccagcuacucgggaggcugaggcaggagaauggcgugaaccugggaggcggagcuugcagugagccgagauugcgccacugcauuacagccugggugacagagugagacuccgucucaaaaaaaaaaaaaaaaauggauuucaugggccauuggaagucacugucuuaagcagugcuuuguaccuggggacuccauccauguguaaaggauuagugagcaggauacacauagggaaauguguagggagugugugauucugaucuuuuuagaggcaaauccaguuuaaauguggagaguggcacuauuuuggcuuccuagcaauuccaggucuaaugcuuacauuuaaguaacaaagauguuugcauugaugaagcauaaccuuggcaauucuuaaauuuggggauuggauugacuauauauaugcccuucaguaagcuauuaaaucaucaugaccacuagguaaaugguggauuaacuacuauaaagauuauuuaugaguauuccaacaucauucaucuccauccccuuaucaagauuaauagacaaauuauuaucauuugaaugagagccagaagagcccucccucccuccaauuaaugaugggcuggaaaagagcaaggagaucacuuuuugugauaaucuguuuuaaauguuaggggauuuuaaacauucuuacaucagaauccaugaagcacaacauuaauauuuauuuugcuuaaaaguuugcagucauuuaguagcaauuacuuuuaucuuuuccuuaagcuuucucaaaaacauuaagguuuaaagaaaauaaaagaacacuuuauuaaaauuucucucuuucucuuccuuguucucucuuucucuugcuuguuuuuuuggucauauauuaaacauauaucacgauaugggcaaaauauuuuuuacaagcuucuugacugccaggggauuaaucaaacuggcuguauguguccuuuuaaaccaaguaauuugggcgaaagcuugcaauuuuaugaauaugcuggaaaaucuuaccuuuauuagcuugagaaguuuucuccauccuuagguagccaaagacaauuuuacucgguuuuguggggaacauugguaucagaggugaaguucuuucugaucugcaagguggccuugaaauuauuucuguauuucaccauauuacuaucaacaacauuuguuuuccuuucagccaggaugagaauugcuaucuguuuucagaacuuggaggcagaccuuuaggggucagagaaagcugagcauuuggguucuagaaaccuuuacacuggguguauuuuuauuucauuguuaauaucucgauauagauuugcuuuaauacauauaggugaacuuugagcuucuguauuuauuuuggcauacauuuuuagagauuaaauuuauuuaaauuuuuaauaaaacauuaaugcaauuuaggauuuuuaguacaugaaguaaaaguaagucugcaucgagguccccaaaaagcaacuguaauuuggcuguauugauuuaccaagucuaaaguaaaauuucacauuugaaaauaaaggaaaggaaauguaauuuuaugcuaugacuauaaaauuucucucuauaggaaaucacugcauauuucaaauuggacuuaaucauaaagagaauaauuaacugacaguuacagcugauguuauuaauauuacuguaaaaagucuggguuuggccauaaaguauuuagcaagacuaccuuuuggaauucaagacuaugagaaccacgucuugcuugcacacugcuccaugugaaacucagugccaggcucauggaaaugggaccauuuuaggagucuuccuguguauaaauuaaagagagcagaacuuacaguuaaaagugguagagcaauuuguguuuaucauugcuugcugucauguugcuacuauaauuacaauaagagaacaaaaaggaauaaacuccuguggucaaauggaaguggaaaugaaauaaccauugauggggaagaaagacgaugguggaguggcuuucuuaugcaucucacagauuuugcaagcccucugauugaaaguugccaggauuguuugagguugguucaggggaaagugggagaaguuugaagcugaaaacugagaguuugguugagaaucuuuaaacagcacacuuugacucucagagcuuuccccuucuuccucaccugcacaggagaacagagauuuauauauuuuuucuggaaaaacugaauuccaacuugggauccuuagcccagagagcauggcaaggcucugaauagacaucaggaagauuaacugacaccaggaggugccccaguuccugaagcuauaccugucugcuauagcuugaagugucccccgaauuucauguuuuggaaauuuaauccccagugcaacaguguuuggagguggggccuaaaaauaggugauuaggucaugagagcucugcucucuuucuugaauggauuaaugucauuauugcagaaguggguuaguuaucuugagaauggccuuguuauaaaagugaguuugacucucucuugcuuacuugcugucaguguauccugcccuuucaccuuuuuccaugggaugauguagcaagaaagcccucaguagaugccagugccaugcuuuuggacuucccauccuccagauccuugagccaaauaaauuucuguucauuauaaauuacccagucuguggcauucuguugcaguagcauagaauggacuaagacagccucccaucgcugaucagccaccaauuaaagagugcuuuuacugggaguacaguauaguuacagcacguaaauugauuaccuuacuuugagcccaccaguugguaggugacacccaagccuaugcauuguugagccucauuuugaaaugggaggggcugcuaggagucagcagauguuugaaagccuccaccaguagaccuuauauuaacacaaacaaaaggaaggagccacuuaggggaaauaggaauguggccuguauccucagagaaguaggaaaauaauugugucuuugaaacaagaacagaaugugauaaaaaaaaaaucagagaauaagaaagagaucuuggaaauuaaaagugugauaucagaaauaagaucucaaguagagauuggaagaguggauauaaaagugauaaguaaaaaaagucuuauagauaaugucugacuugcaaucaggaaggaguuuauaagcauaguauuuagaaaugcauaaucuauugucagaagaaacagauaacagaggaaaggggaugcccaagccugcugcauuguguuaucaucuuauuuuauugaaaacaaacuuaagugcauuuauuacuuggauaaaaauugagaaauauauaaugagauagacuguagaaaucauuuuauuaaaacauuuuauugauaguacagaaaaugcuguacuguuacuuuuuuuggcaauuucauaaagcucugugaauaacauggucccuuaguuuuuuuuuuuuaguagcccucuuuucucagcaccaaauucuugcuguuguuaggcauagucauccuaauauuuuuuauacuuucugccaggccugagaagcuucauggcuuuagaaaucaucuaaaucaucacauuguguguguggcuguaaauauccaaauuauuuugaggcaaguuucuccucugaugugacggccauguauuuuccauauugcugaugaugaugggaguguuuucucugagacauuuuacacuugugguauauuuagcucacuaguaaugaauuacaaaugcaaggaacuuggaauccugaaugaauacuaggagcgagccgacuuucaagcugaaauggucucuuuccaacauuuucuggcugauacaccacuuuuaauaguaaguggcuuccuucugcucuucuccaucacuugcaaccauggauggcuguugugguaacacggacccucacagaaucuuagaucugguagaugcuuuaaggggccaaccaguccaguuauuuuccccuaucccugaggaaucccacucaaggagggagaaaaugauuuucucaagaugcaccuguuccuaugagaugacuagggguccaaacuuggcauucuuucugcgucucuaggccaccuggaccugaaggacaguucugacuuuccuucaaaucucaugccguuguugaugcucgucugguggauuuguaccugagaagggauguuucgggagggauuuuaggcuucugucugcugugugaagccgaggggguuuugugaauauucuguaagagaugugacgccuguggaugaaagcagacagaucaggccgaccuuggcuuggagucuaaguuuuagagacagaaaacagggagggggugaaggagaggggaaaugggaggaggagaaggaggaggggugccaggaucauuucuuuuccuguuacgcauuuuccuuuuggcgggagagagugagaaagcuccugaauguaacuggagcugcugaacugaacuggucagaaccuguccuaauuuguguaaaagaaaugcugugguauuuauucuuccagagaagcccacauaacgcaaccagggccugcuggcugcccuugagguucugcagagcuugguuuuggugucuucucugagccuguuuucugcugaggcagccccuggguguugcccacuggccuaacucccuccaggcucggccuuucgccucucaucaaagcucuuuuuucccuggauuuuaaugguuggcugauuaaaguaguucauaguaagguguuaauuauaacucuuuccggugguuaugugcauauauucacagaguuguuacagaaguaaggggacugggcugcucaugguggcucaugccuguaaucccagcgcuuugggaggccgaguggguggaucuccugaggucaggaguucgagaccagccuggccaacauggcaaaaccccgucucuacuaaaaauaacaaaaauuagcugggcaugguggcggguaccuggaauccuagcaacucgugaggcugaggcgggagaaucacuugaacccgggagguggagguugcagugagccgagaucacaccauugcacuccagccugggcaacaagggcgaaacuccgucucaaaacacaaaacaaaacaaaacaaagcaaaacgaaacaaaaaacaacggaaguuagauggggcugaauuuccaacugcuaggcuagaacuaggacaacacugugagggaaaucggaguguaauacauuccgcaaccccaccugucuacuaucgcaaccccaccugucugcuauccucccuuugcaagcccagggccuugaugguucaaggaugagucuuucuagaaaaaagggagagaaguuucuuuccuuuuuuuuuuuuaaacaaaagaaaaacaaacauguuuauuaagauaugcguagugcauacacaugggaguacccagacaugaguaauucaaaggguugguuagaacugggcuuaucuagcaucuuaacaaaggaacgauaacuuuuuagagaggugaugaaacaaaggaaaaugacuuuaagcuuccagguguuaccagaaguuucaucaaaucaagaauauucuuaggagugucaggggugucuaauaguugagcuguuaaguaacucuuaaacuuguuaaugucucuugggaauuucuucuuuuagaguuguuuuguauuaaaaccaaggaaauaaauaucuuuauuuguuuuaaaaauaguaucuuaauuuauuaauuuuguuuauuuugcaaagucuuuuuaaggaaauauuauuuccuuuuacaaugaguaaaaauacauucauucagaacaaaauauaauuguuucuuggugcaucagauguuuauaucucaugauagugaucuguuaauagaucaggguuuuuauucuuuaucuucauccccccuucauugcccccauagacuccuuuggcaguuuagugaagccagacaaauuuuuuuuugagacaaagucucacucuguugcccagccuggagugcaguggugcgaucuuggcucccugcaaccucugccucccagguucaagcgauuuuccugccucagucucccaaguagcugggauuacaguugcaagccacuguacccagcuaauuuuuuguauuuuugguagagacggaguuacaccauguuggccagccugaucuugaaguccugaccucagguaaucccccugccucggccugcaaaagugcuaggauuacaggugugagccaccgcaccuggccuuuuuuuuuuuuuuuugagauggagucucacucugucacccaggcuggaguguaggggggcgaucucggcucacugcaacuucuaccucucggguucaagcgauucuccugccucagacucccgaguagcugggacuacaggcgcacgccaucaugcccagcuaauuuuuguauuuuuaguaaagacaagauuucaccauguuggccaggauggucucgaucucuugaccuugugauccgccugccucggccucccaaagugcugggauuacagauaugaggcaccgcacccagccugacaaauauuuuuaaaugcauaaaauagaguacaugguauuccaugcauacaguuaccaaaauacugaaaaagucugugagagaguaguauuugcuguuucauuaguguguucaguaagaacuucuagcaucucuaaccucucuacucuucugaaauaacaacgagccaaaugguauuuucaagauaccugcuagaguuguaaggugaugugaaaaugguuaugauuuuugcuggugacacagucaaagcuaccacuaauaauguguuuugugaucugccaucacaauggaaggaaaugcaaauuucuguuagaggucagugaaaagaucuaauugcuuuuccuguccaaguucauggacccccugccugguaauaaccccugauaaagaugauggcuuaaaaugaguauuuguuuccuuaaaccucagcaguggcagcagugugccacagaguguuucaaaagagacaacaauuuuaaauggaaaguagucuugggugaaugccccauauggcaggcacugcacuggguguaguugacaaaacugaugagcucuaugauggcaucuggccucuugaguguguagacuaguacgagaaccagacaucaaauugcagagcauacaaauaguuguuuaacugcuuagaggguagacauucugcagugcugucauggcaaaucacucggggacuucauagggaccuggaaugagugauaguuugaguggucagggaaggccuucuugaggaaucuauucaaguccauaguucaaggugguggagggcacuggcugaaggcagagcugugugcaggcucuaagcuggcagaacuuggcccacagaaagccugauugaggccggugauugggagugaagugagcagagggcuguggauuaaaauuggcagaaagaugcagucugcauuucacucaguaguauuucuuauccugauugaaggggcaugguuuaccucuuaguuugagggcauguauuauuuagugcauuaauggauggaucccuaaaagcauuaggaauuagucuggaguauguagguugaaaaauagguuauaaaauugaugagaacaagcucucuugcaagaguuagaaacauaaaaacaaauuuuucuaaagcuaaauuccuuaacauuuuuccucacucagauuucuauuuggcuugaaucuaaggaaaaccugagaagagaggaagugcuuggcuucucuguauaccaagcaguuucaacagugguguuuguagaaaugcauaccuugcuguuccuaggcagauaaguguugucacacgucuucagauuuuaaggcgacaggcuccacaccuggcagaggcucagacagagcagaccaggauugggcuauucacagaggcaggaaugugaccauucugguccgggcaguuggggaggaacucaucuauccacgguucccauacuguuuggcccuguuuuucaauuugacuccaucaaagcacauucuccagccgagggguacacaucccuuugugacuucagaaaucaugcacuguugguuugggagucuuaacuacauuuggaggacacgcugagccgacgagaaauggaagugagaucugaauccacaaacggagacggcagacagucacaggcagguaaagacucauugagaauguggcuacuuaaauuuuguccaccuguucauugaaaggaagccgaggcaugacucuccgccaauaauuagugugaaaauuacugaguuaacagauucuaaauuauuuuguccucugggugaccuaggaaguuuuuaaaagacguuuuuucuaaauaaugucaugaaauaagauaguuacauguaaagaaucuaacaaggucagucauuaaaaacauuuucuaaauaugauuuauuuugcuuacuaaccuuguaaaucaucuaggauaggaccacugucagccucagagccuggcacagaacuuggcacuuaaugcguguuuguugaauaugaauggauuggguccagugucuaaugauacgcuaugaaaguuauuccaucacuucuccgugauggaaaaagauuuaccgaaaagugucuguuguaugaaagucauaugggguagaaauuaaacuguaaaugaguuaaggagcuguaaccuuggcgcuauuccaaaucuccaacaauugaguaguuaauuagugccccugcauccauuuaauuuguccauuuaucucuugguucguucacugucauuuauuucucucugcuggugccaaguuacgugauaggcugcugggaggcagacaagcaagaucucugcuugcaggcuuucaaacgcagcgauucagcagcgugguaagacgugugcucaugauacauacuaugugcugugggaccacaggucaggaaggauaaacucccggaguuuugcucuuccucagagggucaaggaauguuucccagagaagugacuugcaaagugguagagaggaauguggaagggaagaauuccaggcugaggagaaaguguuuggaaaggcaaauauucagugaaucauauggugagaugccauuuucaaauguauaaugcaccuccuugcucacuguccaucauugccccauccagccacacuggucagcuuucagcucugggaacaaccucuguuuacagggucuuuccuccaccuggaauaccggcccccagcucuuggcuaucuccuucuccuccuucugggauugggcauuggaugaaauugcaccugcuuagagaagccuguccugacacccaccugaaguagauuuugugcuguugucuccaccauccacacuugucaccauugcucauugcuuuuguucacuuguuuguuuacuuuaguguugauagguccccaagacugugcucuccauaugggcagggaccaagguugucuuguucacgauuguguccauagugccuuguacggugccuguucuguagggaugauagauccuugugaaugaaugaaugagugaaugaaugaaugaaaaggcggagucacuuaaaagaacaaaagcauuuguaauagacuugcuauuccuguuuauucuuugaaauuugagguaauucuuaacuagccacuuaggaucuccauuaagaacccuagucaagaccuuuggguauuaccucaaaguaaaacaaagugggaguauuuuggaucuuuggaaguuaacuugaaaaaaucuaaggauucuuuaaauugaauauauagggaagagagaacuccuacucagaauacuuaaguuacaaacacaagaaaaauucauagauuaaaaaaauugaacaaagaguaucauuaagucaaaccguuuuuaauaguaauuuuguaaaguuauuuaugacacuauuuuuuauguauauucucaguucucuaaaaccugauaauuuuggugauuuacucuuaucugugcuuugaacacuuuauucuuauaauuaauaucauuauuuuuaacuuacugaaaccuuucaacuuacguaaucaguaauguucucaugcugauauuaaccuuuuauuuauuuauuuauuuauuuauuuauuuauuuauuuauuuauuugagauggagucucauucugucacucaggcuggagugcaguggugcgaucuuggcucacugcaaccuccacuucccggauuccagccaauucuccugccuuagucucccaaguagcugggauuacaggcucccaccaccacacguggcuaauuuucguauuuguauuuuuaguagagaugggguuuugucauguuggccaggccugucucgaacuccugaccucaggugauccacccaccucggccucccaaagugcugggauuacagguaugagccacugagcucagccugauauuaaccuuuuaauucaauacagucuucccauaacagaccuucucccauugaugggcucauuuuuauugcucuuuguucucuacugauucugucaguuuuuagagcccauaaaauagcuucauuucuauaccgucuuauucacauucagauuuuucauauagcaugucacacacaguauaagacauuuuccauaacauauuaugaguugaugauuucugucauguugaagaagaucauacagcaacacuuaucuuguaaauucucuuauaaugccagguaaaaaaaauguuaugugaaauggcacauugaaagaaaggaaaaucuaaagguggauugcuuaaaugauugugauuguuuuucccauuggaucuucugcagaugagaauucccugcauagaucacccaagggguggcagaucgggcuucucaguuucagccagggguggacgguuugcaucuccugauguguucaucaacaacaugaugaagccaguguccuuggcuacugauuccaaccuuuuguucuguucuuggagaaauggggaaaaagauacacuuauauacuaguguagauuuugguuaucuuuauuugugaagaaaauuuuuuguuuaccucucauuuuauucauucguucaguaaauaucucauuuuauucauucguucaguaaauauuuauccacccaccuacuaugugcuaggcacugugauagucacuagguauuaaaaaaguacauugaugaucgaugcuaagauuauuuucaaacuauuuuaagagaggacuccuaaauuaaaagaaauuauguaucaacagacaaaugcccuuuuauuuuuuucccuacaaaauugcugcuggcuagagaaugaugaugauuugcacuucugacaucauugccuaauguuggguuucugugccugggcucuuuaugcuguggaggcaaauggugcuuugagugucuuaauuucaccggaaugcugcaccuguugcuggcuauucuugcauaugaaauccagacccuagagucacuugcuuucauuuccuuuuccuccucccucuuuccgguguguguuugggggggguggggguggugaggcagggugggggcagcagauuaguagcuucugugaagaguaaccaccuuccuguuccgucaaggcuaugauuuuagcgcccccgggagugguaguguugcgucacucugucaucugucgccgaaagacucauaauccgggcagccucaagaguuugaggcguggguuugugcccgaguuugggguucuaggggaggggugaaguggaacaggcuuucagcagcugcugccgccaccugauaccuggaaccuuacugcuauugaggaacauguauuuccucuuggcuucauuugcuguuuggcuaugacugaggaagacaggagguauugcauaguaucauuuacuuucauaaacauaacuuugacaucucuaggcuucauguugguucaggcaaugcucucgaaagccagggagcugcuuugcaagaugcaugcuauggcugaaggaacggcucaauagcugggagcuggcccugagguuuaaauccacucacagcacgaauuugguguuuuacuuuguguccugaaaccucaauaaccucauuuuucaagugagaguugaaauauugacacaacuuaacuuuuaagaauuuugaaggcaucagugaaaauaaauugaacgaacuuugaaguucagagaucucuaaaagugaauacagaccaaauuauauccugaugaucaaguaggaacauccguaguuccaguacuauaguucauugacaaccuccagaaaguuacgguagucuaacauuccuuauuuaaaaccaacuuugccauguuuaauuuauuuauacuuuuauagauagacagauuuacuacuggacauucucuggcagagaaaaauuucauggaaagugaaguuuaaugugaaauggcacauaagugguccugacuugcaaacucaggaauggcuuguugaccacuguccuggaauaagagagcccagcuuuguucuugucuuauuucuggaucgcccuuucuccuuuguaccuucugacauuguuucugaguucccuccucccaucugccacccgcuccuuugcaacucuguagagcauuuuaauaacagguuguuugugccugucuugccucugcagcacucacucccaccuguuuccucagccucugacuucuccuuuccccuuuuuggcaugcucugaccugccuccguaguugaacccgauuccugaggcaaugauauggcaggucccucaacucuccaucuauagcacuugccuugccuggccugggaaccggcucuuucacugcuguacugcauggaacagaguaggcacugcuuaaaccuaucagcugccuggcucucucaaaugcucuuuccaggaacucuggcacugugaacccacugcugaaucucguggcucauaaauaaacucucaagugauaauugugacuugaauucucuaguucuuaccugaccaccucuuaauaucauccuggaacugucuuuauaucaucuuggaaacccuggagcugauuugaaauaccucuggucaguuccucagcaucaguucugucuaaugaacaccuauauucuucauugucuccucacucuuggcucuaaguugucacaaguagaugauuaugucucauucccaaguagagauaggacacaugagagugggugggugugcccauaguuuagacaggacuaucuuugugugguaccagcugcggcaggaucuacagaugacucacacauguuaauacccacaucuucugaguggccaacauccucagauuugcaugugggcauuugcaagaggaagcacacagaugcugugaucagggcugagaugccuacaggugugucugcugggcugcggcaggugguggccaguggaagacagguuguagguagggaaaguguugccucauggagggugauccugauauggugggaacuucaauccagacuccgacaucgccacgggcaagcugaaugacaguaaacaaccuucagggcuuggggacgucagcacacucaccuguggagagccagccagaagacaggcaguggcacaaguuuucugagguagagauugugacuguaggugaccaaggaacaaaauauuaugaagaccacauugggguucauaggcugguggcccuguaggacacuuggacacauuuuuuuuccugccaacaccaaagaauaauuucuaggugucucuucuucacaccuucccaugaagcuugaaaguucuagagcucacuagaaacuagaaaaauuuuccuuacuaugacagcaagugugcuucgagaaaacucacuugcugaccuuuguuccacagcccagcagguugccaccugauuuauaaaaacagauuauggagacaguccagaaaaauuacucccucuuucuuuuuuuuuuaaaguaauauuuuaaaauuccuuucuuuuugaaguauuuggguuguuuuuaucaauuucguucacuguugccuuaaaugacaauucuugccucccugaagaacucuuggccuucauuccugccacuacagugagaaguucuaagcuggaagggccaucccagggaugacugcuuuaagcagccagucauguaggguugcgccuguggcccuggcagauuggacccuguuucuaccaagugguggcaucacuuggcuuccauguaguguuuuucuguucuccugcagaucgcugucagccacuggaggccucacccacuggguuccagacagcugccacuucuguuuagaagcaacacugccagugagaaacccugccacacacaacacacacagacacacacacacagacucacacacagagacacacacacacagacacacacacacagacacacacacacacaccacacacacacacacacacacacacaugugagaggagggccacccugggaggaaacccugaauucuccccucuuagcacacuccuucuaucuacuccuucuaucuccugguagagggagaagcugugugccccuauuacuaccucucuuuaccuccucauuaagggcuuuggugcgauuauugucucccuuuuaaucucacuacuugcaugcagcuuucuugagaaagguuauaauuuaauccugaaauacaacuucuaggaguuuucuuuuuaauucaucauuccaaguaggugucuuugucuguuuccacauuagaaaaugaaaccaauacuuaaauaugauuucccugcuuuuauuggcagcuauuuaagaucuaugucugaggucuggcuccgugugguuuggaauacuuuauuguuauuauuauuauuauuuugagauggagucuugcucugucucccaggcuagagugcaguggugugaucucagcccacugcaaccucugccucccugguucaagugauucccaugccucacccuccugaauagcugggauuacaggcacacgccaccacgccuggcuaauuuuuguaguuuuaguagagauggagucuuaccauguuggccaggcuggucucgaacuccugaccucaggugauccacccgccucagcuuccuaaagugcugggauuauaggcaugagccauugcgcccagccuggaauauuuucuaagcucuuugaugauggcggcuucgauuuaacucucucugacuuaauucuguugauuauaaugucauucaaucccauuaguauacucauauggaaacaaaggcaugauuucagauuuuauuuauaucuucaugcuuuggaaaaacaauuucaugagaaaucacucagcccaugaaguaccauccuugacauuacuuuuuuggguuugcuuguuuuuaaaacaguuuuuauuggcuuuugcuuuuuauaauuuuuugaaccauaccaacagucgcauaaugaguauuuuuagacaugugcuuuuaaaaucaugugaaaauucuuuuaaugucaacaugaagaguuuuguuuauaaucauugcugugaucaagaacugagguagaauuuccuagcuggacacaaauggguuaaaaaaaaaacccgacaugcucuuugauuauuggauaaguuguauucuaaacaauauuacucugaugaagauauuaaggggaguuaauuagauugugagacucuugaggacaguugaugccuuuuucauuuuugcauucuucuugggugccguguaguugaucaguauagucaugggacuuaguucugauuguagggagcugugugaacugcaugaagcagacgagacuccauccucgcaugggaaaccuuuaaggauuuugaagcugggcaggugcagguuaauagaaagaucacucugggcucuguaggagagugauuuggagagaagagccccuagaggcccagggaacauugcagguggcucugccaggagaccagguagaagauguggugagggugggcgggagauggaugaaacuguggauuucguagguacagauucaucauccuucaucuguagcuacacuauugaagaagaccuccgaaaaccagaagguguuuuauuuguaguucauuuggcaagaaaacuugaguuugaccugaacucauuugguguugaagccugacuugaacagcugggacucuuuuaaaguccuuauguaugucaggcauccuucauaaacauauguauuuacugcagggcuauuaauguguuugauuaggggaaauugcccuggaucuugcuguuuuuuguuuucacuguaauauaugacuugugcuauauaacuuuucucaaaugggaagaguucugguucagcagcaccucuggcccuaggguuuuggaaaagagguugugaaacucuuugacauguguuuacaggauaagguugaugaaacugacugauaagaaauggaggcaagaucuauggaagaaaagaacauuucuggaaagacucaaaaguuaaugaugacacugccucauuaacacugaagggaaguagaacuuuaggaggggucagaaauauucauuagauaggcaugauucauugaaaaggaugcaucuugaauuuuugaaguauugcuuguaugugaucuuggauugaauuguagaccagaaaaagggggcaauugcagaaauuugaaaaagaccuauagauuaguucauagauuugcaucuaugugaauugucugguuuucaucauuguacucugguuauguaagaugguaauauuugaggaaguuggaugaagggaacaugagaacucuguguacucuuuucuuuuuuuuuuaaccacuucuuuuauaagucuaaaauuauuucaagauaaaacuuugaaaaauaagaaaaagagguguuugucauaucagggaacaguaucauucaugaugcuuuuagguagagaguaucuaugagcagaagucuaguuuucuaggagaauucaaagucuagaagugcaaaucgaguagaauuucagucaggccuucacccccucccaauuuuuucuuuuuaaaaaagcugaccugguuucuauuguaagauuaucuuuuuauauucugaucugagaaaaaugcuugacuguagcguaaucauauaaagaagaguucuaggccaggcgugguggcucacgccuauaaucccaggacuuugggaggccaagguggacagaucgcuugaggucaggaguuugagaccagccugaccaacaaggugaaagccgucucuacuagaaauauaaaaauuagccgggcaugguggugcccacccauaaucccagcuacucgggaggcuguggcaggugaauugcuggaaucugggaggcggagguugcagugagcugagaucacaccacugcacuccagccugggcgacauaacaagacugcgacugcgucucaagagaaaaaaaaagaagaguuauaaaauggagagcucaugggaagugccauaacuuguccuuugcauuuagucucccugguguuggagggugugguuuggcucuaguucuuguugguagcucugcagggcgagguauaguuguauuaguuaggacugacaguuauaauaugauguucaaagccaagaagguuuacagauaacagggaagaaugaagaagauguguacccuucauggccaaggucagcuugccuggauuuuguggggcugaugcugcuggguguauauuuccuccguggagagaggauuaguuucugaauuccuuugcuucccucucuaacuucaacauuaccuccuguaguuucagcuaauuuguucuguaauucucucuccacuccaauucuuucuuuccuuuuuugaugagaguagaccuaggcuggcagccaguugcuauugagcuauaauagagcuagugguaugaacaaaauuugauuacugcugucaacacuagauugaauaagaaagcgcauacccuagacagauacuugcaacauaaauggucuauugauuucacaagaacuagaaaaugaggccaccguguaaucuagcagaagaauggaucugugaauagaguggguccugacauugcacaacaguuuucaaaagcgccccccuauugaucuuuuuagaagaaucuucagauaaacugauuuuagcuucugauuuuccucaccaucaaguguuuacagaaacuucaaugaagccuuugcacuuguguguguucaaugguuugcuuuuccuacauagaaucuaguuuggaaguuauauuggcuguuacagaccuuguuugcuccugagcuaucaugauauuuccacuuagcuuaauaugaauguuuuagaaguuucccacuauggaaaguucuauuugacauaugaaaguucaacggucaauuucauagucagcuccacggcaagaaauaaauaagacaauggauuacagaguauagccuugggacaugggaaauuuuuuagaagauggaugagucauauuauuaauacauguugcaaggcccaaggccuuacaucaaaaaauaaggaaaaaaguuuuuauuuuuuaaaguuaauagccuucugauauuuucuuuguuguacuuuguauaguuuuuguucuguuuaguuuuggggggaucaaaaaauaaauccuaagauagaauguuuuaggaaaaagguaauuaacaucauuguacaugaauuugcucaaacacaguaaggucugaaaaaaaaagaucucuuugauguugauuuguuugaauaauuacuauucucccaguacugcacuuuugagagggaaggagaaauuguugcuagugucuaaauuuuaacuugucuuccuuggcuaccuucaaaauuugagauccuuaaucuuaaaucacaucuggucuaacaauucuuccuauaaacaguuaugacuauuuacugacaaaaggcugcuuuuauugugccuguuucuauuucagaggaagacacauaaagacagguggaaagaacugauuuguaaagauugaaaugucauauuuacauucagaauuucauuuccuuaccaguuuucagaagaacccuuugguagaggaagcagggccaacuucuuucacagccucuuacuauagauagaaguaugaaggccagcaauauuuagcugguaugaacccauacagcuguaccaggaacaauguugaaagucuuugauuccuauuggaaaauagccacuguuaaagauggacaccuucaggaccucacuucagcauuguagccaguauccguucugacuagguggugcccacgccucacuggcuguucuguauuuugaauauuuaguccugauucuagaaaugacauuuuugggcuauggauaaaagauggguuucgauagccauuaaggaaaugcaaaucaaaccacagugaaaugucacuucauacccagcaggauggcaauaauaaaaaagacaaauaauaacaaauauuggugaggauguggagaaauggguauccacauacacugcuagugggaauguaaaaggaugcaacuuuggaaagcugucuggcaguucuuccaaagguuaagcauaggguugccauaugacucagcaauucuacuucuggguacacacauacacacacacacacacacacacacacacacacccgccacacccaagagacaugaaaauguaugcccacaucaaaaacguguacacaaaugcucauagcagaauuauugauauuagcugaaagauaaaaacaacccaaauguucaugaacugauaaauacauaauaaaauauggucuaucaauacaauggaauauuuuaaaaauaaaugaaauacccauacauaauacaacaugcauggacuucaaaagcauuaugcuaagugaaauaagcuagucacaaaaaaccauauacuguaugauuucuuuuauaugaaauguacagaauagguaacucuauagagacuggaaguagauuuuagugguugccuugggcuaagggaugggggucgauuguggugaugguuguagaauucuuugacaauacuaaaaaucauuaaauuauacaguguaaaugagcuaauuguauaauauaugaauuauauaucaauaaaguuugaugcaaaaaaagaucaauggguauugacuaugggacaucaucuguaucacugugcuuuucccggucucccucccugugacaguccuagaagacaggugaagucagcccguccauuuuacagauuuggagacugaggcuuagagagagagagagaguauuuugccagagucauacagcuacuagucuaaggaaaaugcagagaugaggaggaggagcauaggggagguacuguuaguuucucuuuucuguaucauaguacaguagcaggaugagagacaccuuugaauucaaaccuguguguauccugacaaagauacauauucuaugaaaagucuuugcuaauaaguagaagauuucuauuucacaacaagcaagaaaaagaaugagagaaggacuagaaaguagaugugaucauaugaauaaugauuuuccuugcuuuuugcauguaugugguggacacaugcagaagugacagcaggaguucgagaccagccugaccaacauggugaaaucccgucucuacuaaacacacacacacacacacacacacacacacacacacacacacacacaauagccgggcaugguggugggcaccuguaaucccagcuacuugggaggcugaggcacaagaaugacuugaacccaggaggcggagguugcagugagcugagaucaugccauugcacuccagccugggugacgagugaaaaaaaaauaaugauaauaaagagagcaaggugaccacaaaagagaauaggcuggaaaaauuugucuaaaugguggccucuucucuuauagcugcauaugguuaaguuuauuuuuucccuaguagcgaauucuaagggaugaagaagaaauccuuuucaguuuuacuuccccaagguguguauaacuacuauagugaaauaauaaguccaauuuauucuuugaaguauaguuaauauguaacgaaacuccuaaggccaguuguauacccagggcaaacgccuucuaacaucuuuauuuaucuacgcaguggguagggagguggguggagugccccuucccagcugauacugucaaaacaggaagcaaaguuauaaucucugucauaggaacaugaauagaggcccuuaguugugacuauuaaaaaaacaaaaaaccugccuaaggaguuuucacugacuacaaaguguaacuuccucucugguguuuagaggaggugggguuagguuuagucagauccucucaugggaaaaauaaaagccaccaaaaaaaaaaaaaaaaaaaacccaaaauaacacaggacaucccagugugcaguucgaaggcugcuuuuguuguccacuuccuccacaucuuuuuccucaucaucuaagcagauguaggugaugagcggccuggcagccaccacguuucauuggaaaaagugcagauuggauuugccagggcauguagcucuccaggcuugcaagcgauuaccagguaaguuugucaacuugcacgacucccagccagugagguuuucuuaagaaacgucuaugaagacaggguucuuucauucaguuuuguuaaguaacaaagcuuaggaccaggcuggugacgggaacagacagccugucuuuccugcugccacgucuguuguggacccucaagaguagagaccaacgcugucugcuucacacuucucuucaggaagugauaauucaccagaguuauuaguuucuuuggaagaagccuuccaggaucccuauauuugugguagcaaauaugcuucacuuuaccucccuguauuuucaaaauagcuuacucugugcuguuuacugccaucuagagaagaagccuccuuugugguguugaguauugguagaccucaucccauauuguauuugauuuacucuguuggcuaaaaaggcauuuuacuucuugaaauauuuaguuuugaccugagaaaggggagaauaaaacguuuguacuuugggggacaguaugagugcugggguuucuguuucagugcaggcuugucuaugagacaugcauaugcauaacuucaugcagggaaagugucgugcacuuuucucucgcugaaguuuacuuccggggugacuuaguuuuucugaucaguuuagauguucauaucuuguuuaauguauacauguguguacugguuguaugagcuuuuggaggggaaaaaccccaagugauguguuuuauucgaucauacauaucaugcaugaauguugucacuaugaaaaaacuuugagacugguugguuuucuuuuucaauguuuuccuuucuuguggaauuacucuuucccucuuaauguuuuccuucuuagcuucagugaaugaggugguaagggguuguagcguugucucugcagagcaaauucaaaccaaaaugauuggagcagcccauauuuucuuagugaauuggguuucuugaacaaguggcauaggagacuggugugcuacaauucucaucauuaacuguuacuucuuucuuaaauaaccaugugaucccaacacaacaucaaaauaccucucagggaccugaauuaaaacuccacgcgggccaggcacaauggcucauaccuguaauccaagcacuuugggaggcugcggcaugaggaucacuugaggccuggaguucgagaccacucugggcaacacagggagauuccaucucuacaaaaaauuuaaaaaucagccaggcaugguggcaugugccuguggucccagcuacuuaggagacugaggugggaggauagcuugaaccuaggaguuugagacuagugagccacgaucaugccgcugcauuccaguuuggacaacagagggauaccuugucucaaaaaccugcauaggggcagcaauugcaggcuuguggccuuucgaagauuuccuuugauugucacuaaauccucucucuuuccccaccauuaagagucucuguggucagcuagucuucaucaaagggucuugcuacaaagggucuaggguaaccuuaaugauugaaaucagaagacagcuagaagaaaaguacaaacaaaccuuuaaauaauaagcaggcuuuggccgggggcgguggcucacgccuguaaucccagcacuuuaggaggccaaggcaggcggaucaccugaggucaggaguucuagaccagccuggccaacaugguaaaaccuugucucuacuaaaaauacaaaaauuagucgggcgugguggcacgugccuguaaucccagcuacuugggaggcugaggcaggagaaucacuugaaccugggagguggagguugcagugagccaagaucacaccauugcacuccagccugggugaaagagcaaaacucugucucaaaaaaaaaaaaaauaaaauaaaaaagcaggcuuuuaaaugaguagcuacaguguuaaauauauuuaaaugcugugcugguugaguucugguucauuuagauaacauucuuuccugcccuaugaccaaucaaaaggcuuuaggaaaauagcauuuuuaaaauuaaaauguauuucagugcauguuauuuuaauaaaaauagaaaaccaauguguacaugauuuccaauuucacaagggccuagauucuccucucaucaguugcuauugaacugauuuuuuuguguguguccauaguguaggcucuuuagucaucuuguuagaaauaaggacauuaaauuuaauguuaaaaauaauauuuucagccaggcacaauggcucaugcuuguaaucccagcacuuugggagcccgaggcgggcagaucaccugaggucaggaguucaggccaggagccuggccaauguggugaaacaucgucucuacuaaaaauacaaaaauuagcugggugugguggugggugccugaaaucccagcuacuugggaggcugaggcaagagaaucgcuugaacccgggaggcggggguugcagugagcugagauugcgccacugcacuucagcccgggcaucagggcgagacucuguuuaaaaaaaaaauagaucucuaucucuaucacuaucucucugucuaucuauguaucaucuaucuaucuaucuaucuaucuaucuaucaucuaucuaucuaucgaucucuaucuuuauccagcuguaucaucauuuucacuagaugcuaacaauaauauaacugagauaaaccaaaguuucaaaacaagcuugaaaaugugaaaugaauaauuuggaggcgggacuggccauuuaggcaucuaugaaggcccagaugacucaugucuggaaauugccacugcucaggaaaccacuccugggagcccugcucguuuugccauccuuccugcuuucuugccugcugacaggacucuaugucagcuguuuccuuuuuagauggaaggguuaaaagauucacuacuugggucccccauuagaaucaccaacaugcuugugccccacagucagagaucgugacuugauuggacugaggcccugcucuguagcuugucaaaagccagccaaggguguccaauguggaggguacaggggaauguauucgucccccacuagacugaaagcuccaugggagggaguagaggcagcuuuguuacugcugccuccuagcaccugaaugugugccugaugugcagaagaggcucaguagcugcuuguggaaugaaugaaugaauuaguuccuuugaguaacaggaaguuggaagaagauuggacagaggcuuaguuauggucuuugcugauguaggagagugugcuauguuaggcugaacaguggcugucaucuuggaagacacuccaggaaaaggucacaggggaacagguggcugaucugggggaaugcugaacagaccucucagaagagacaaggcuccagggcagugguguccuuaugaggcaaggcagguugagaacuuugggaaagagaauuucaucaggggcugagugugugugugugaauguggaugugaggccagauggggacacuccugggagaaucuccugaacuguggcuuauucuuuguuuuuuuuuuuuguuuuuuuuuuugagacuaagucucgcuguguugcccagccuggagugcagugacacagucuuagcucacuguagccuugaccucccaggcucaagugauccucccaccucagucuccugaguagcugggacuauagguaugugcucccauaccuggcuaauuuuuaauaguuuuucuguagagaugggaucucacuauguugcccaggcuggucuugaacuccugagcucgagugauccucccucuuggccucccaaaaugcugggauuacaggccugagccaccaugcccagccgugacucacucuuaaaggagcucaagucuuuuguguuggaacuccaggagguugacgaccacacucaucuauucagucagcauuugcuagguaccuagcacacgcccagcucuggggagguauggggauauaaaaaugaaggugauuugauucuucccccguggagguuaggaccuggaaaggauggugugugaagugaaugcuagguuugcugguggcugaaaggaaggaacguugucaucuuugucauauguuagggauugccagacccaccaguugacuauauccaaauaaaggaacacagaauuuggagugaucacagggcagugagauuugucugggaagauaucuuaggacucgugaauuuuuugcagaucuuaauaauuauagagaaaaugaguaggugguuaggaagaccagguaacuauaacuuacagaggugagagaaugagaauuguuaaguugggagaaaaagaguagaaagagcgacaugugaaagaaaagaaucggccggugcgguggcucaugccuguaaucccagcacuuugggaggccgaggcgggcagaucaccugaagucgggaguucaagaccagccugaccaacauggagaaacccugucucuauuaaaaauacaaaaugagccgggccuaguggcgcaugccuguaaacccagcuacuagggaggcugaggcaggagaauugcuugaaccuaggaggcagagguuguggugagcagagguugcgccauugcacucuagccugggcaacaagagcgaaacuccaucucaaaaaaaaacaaaaacaaaagaaaagaaucuuggguggagaaaaugagaaaugggauuaacaugguacugagcaguucuuuuuuuuuuguuuugagacggagucucgcucugucgcccaggcuggagcgcgugaugggaucucggcucacugcaagcuccuccucccggguucacgccauucuccugccucagccuuccgaguagcugggacuacaggcgcccgccaucacgcccggcuaauuuuuuguauuuuuaguagagacgggguuuccccguguuagccaggauggucuggaucuccugaccucgugauccgcccgccucagccucccaaagugcugggauuacaggcaugagccacggcgccuggcccugagcaguucuuuaagggaugagacuuggcccucaagaucuggguuuccauuaccccugccaucgucaggguaagucacugaaccucugagaaggggacucccaaccaggaggaucacaggaucucccaaccagggaggaugccccgggagaguguggucaggauucaugauguuacacauuuuaaaguucuuugcaagcuauaguaauaguuccagguaaauaaauggaauaauaaauucuguaaaaauuauaaaaaccuagucuguugauaaugggcucuuuuagguagagucuaggguaggaaaucaaacauuauauucaucaugguacuugaaauauauuuaagcugaagcugugcacuccaucauguuuuugauauauuuuuccuuggcauuacuugaaaggcaugcucaugaaacuggauuuggaucuguuucauguuuucacuugcguucucugaccccuacuuagagggcaccaggugcuuccuauucuaaccguuugcaaauucaagacuugguuggagggccauucaggggacuggugugggguuagauaggaucuggacacagcgacucccucgcuccugcuccaguauuuugaccuuaauuugaacaguucaaugaacuggcaacugaagucguuuuuucccacugaacuagaccuuucauuguuuugcagaggaagaugacucauagccagguucuaccauugugcuaaagugaaauuuuagucuaggacuaaaggaacacaggccaaacuuucugucugagcugcagaguauugaaacuuagauugugagcugggcaggaauuccuguggcccucuguguggaguugcucucaaggaaaaggagcauuuaaauacguuuuugacuccaaauuuaauuuuuaguaauauaguucaaauguccuuuaaaauaucuuaaguaaucagacuguuuucuaaaaaaaaaaaaaauguaaugcaaaaugaaaauucuacaaaguagaaaacugucauuuccuuccucucuccaaaaccauuguuaauaguuucguuucuucugcuacccuuguuuucuaugaauguaaaaauguaugccucuaugggugagcauggcuuuucuuuuuugaaccaaaauugaaaccauccugauuuaguggcaucccacuuaaaacauuauuaaaaacuaccuguguacauguaucuucgcuuacuugggcaauugcuggggcaaauaugcuuuuacuguuaaaucgucaucuacaacagaugacauguagagagaugaaauguagucuauaguuguuugaacuugcauuucuuuuuuuguggaacugaacuucucugcauauguuuauuggcucuuuggacaaauucgucagugauuuggcuuuucaugcauugcucauuuucuuuuguugcuuggaucccugacuuuuauacucuuaaugauuccaagggaaauuccuacaaaauggcagauuugggaggacuuauuugaauuucuuuugaguucuaaaaugguuaacugcuaccuuaaaagauagauauuauuuucagauaucuaggacagagguuugagucuuuggacuuagauucuauaguauuuucuuucuuuuuuuggcugauauggaagacgucaucaucccaaacugugcugagacuaguaguuauuuagauacacuauuuuauuacauuuucguauacugauaaauuauuuccauauggaugguaagucccagauuuauuuaugaaaaaaaccauuuuuuauauauuuuauggaacauggaguuagcagaaagaugcuguggaguuaggcuuaaaauuaagcccuaacuauucugccuccuguuuuggggcuguugucagucuuuaaagguacaucuuuguaaaauuuuuugaacauaacuugacagauugcaagaaggauuauaauaaauggugucuguuuguguuagaguauuucaagucaguacaggaaaaaauacauuuagaugcuaagugaagauaagacauuaguuuaaaugaggccccguaugcaccaucauauugaaaauuuaccaguguguccucguccuucaauuuagauucguuagugauuuuucacaucaaagcauugaagcuguaauucuauguuggguucauuuaaccacagauccaguaaauggcaggaaauagagagcuauacaggacagcaaauggccugcaguuguguggaggauaucuuuguggcaagaugccccagauguuuugcuguuuucaaaguuugcuaucauuuguucagaaagguuuucauugcuugcaagcaagcaggcaagcaaaggaaaagggcacgcagccgccuccccuaugauucugugcucuuugccuuugaugccuuauauaaaaagcuuuauuuagucugcagagagguuauuucuccaaauagaggugaacugucauaguagucuggaaacgugauagauuucaguugaaugccgcugauccaaauacucugaaaggcugggcuguguggcacuuguaagauaggcaccuugcacagauucuuccaggucacuugcacauaucgccaguagaaauaccucaucagauagcgauccacuuggcacucugagaagcaacuccuaucacaccgacacugcuacuuuucuccuggcucagccagucucuugcugggaaccugcugccagaguuagucacuuggcuucugcccuggccuauuuucuuguugacuucuggauucugugccuuuagcuucuccuuggacucauuggccauuacucucuuucugguguuaguagcuccuagacuguguuugacagaagaaauuuauuccccuagcaaauucacuuucuacugagguaacucuaacccacccaugcaaucuagcaucugccaauacucugagacccacugauuguuaaucaguauuuauuaucuaacucugaguaacgaguguuauagcaggaaaaguagaaucuuuuuuguguguguacgaaugugguuuaagggacuuuuggggauagaggagaaauaaacaccuugaaaugaauuauuauauuuuaccuuugcccaugugaauucuuuaaaauaauuauuaaauucucacuuugcuuauaugcauuaaaaauuucauagugaugguauuuaaagagggagguuauggacauuuugcaaguugguugaggcaauaguucucauuucccuuuucaugucccacgggacaugucauaucugucugccucccuccuaugcauuucuccugcuguugcaaggagaaucuuauguuuuaugaugaaaauuuauuuggugacuaagugaagugugcacuauucuuuuaaaaaguccuugagauugcauucuguauauuugcugaauuuguuacuaggccuuacgcugcaacauuucugaguaaucaaaucuaaauaaaaauaaaaggucguucaagguaaaucuaugucuugauuacugaaauaaaguauugacauuuauuucccauaauuugggaaguuauucaguaaauaauauuugccugguguuuuauaaugaaucauuuuuaucauauuggguuuguguuaggaagacugucagcauugauuuuccaguaguuuucuaaauuuucucaucuauuuauguuucuucuucuucuuuuucuuuuuuucuuugagacagggucuugcucugucaaccaagcuagaguguaauggcaugagcuagguucacuguagccucgaucuccgggggucaagcaguccucccaccucagccuccugaguagcugggauuacaggcaugugccaccacgcucagcucauuuuucggauuuuuuuuuuauuuggguaagagucucgcucuguugcccaggcuggagugcaguggugcgaucucagcucacugcaaccuccccuucccagguucaagcgauucccuuaccucagccucccgaguagcugggacuacaggcgcaugcuaccaugccuggcuaauuuuuuguauuuuuaguagagaugggguuucaccguguuagccaggaacgucuugaucuccugaccuugugguccaccugccucugccucccaaagugcugggauuuuaggcgugaaccaacgugcccggcccuucugauuuuuuuuuuuuuuuuuaaauagaaacaaggucucacuauucccagguuagggucuugaacuucugggcccaaguaauccuucugccuuggccucccaaagugcugggauaacaggcgugagccacugugccuggcuauuuauguuuccuaauuacugcagugcucauguuucugucagcuucaacuaugccacacaugacuaggaauuagaaauaagaaaacaguaaccagccuggccaacauggcaaaacccugucucuacuaaaaauacaaaaauuagcugggugugguggugagugccuguaaucucaacuacuugggaggcugagggacgagaaucgcuugaaccugggagucggagguugcaaugagcugagauacugccauuaaacuccagccugggcaacagagcgagacugucuaaaacaaacaaacaaacacacacaaaaacaaaaacaaaaaaaccaaggagccaaaaauaaaugacucagugaacauuuauugagcaacugugguuugcugggugcugcggucguuguugugaaggugcugggauguuuuaaaguugguuuuaaacuuaaggauucuacuuacuggcagccuagaaccacugcauaugccuugcagagaugaugauggacacuuguguccucaccugugcagugcaggcacaucagugaagagccuuagauucucauuuugcaacuguuuucacacuuggguaucgguuucuagaucuaaagcaguaaaugagaaaggcagugggugugaaugcugcuauaaacugacacccugacaauaacgauaugcuuguugacaggcugauugcagaggagaugaaaaaauaaagggcagaacaaaaaagucucaaagcucugcccccugcgucaguaggaagcuguauuuugcuacucaaguagacuaacauuggagaaauaauuagcaagugaaaaaguucuuccaccgaaaggacaaugcaaguuaaggcagguagucugguuuucugugcugcagcauccaaccacguucuagaauccuguuuucauauuuuguuggacccaacuggauuaaaacaaagccccuuucucuggcuggguaguggcccgaguuaggcaguuuccagugcucuaauugguacuuuggagccaguguccagugacuuucagaagcaggguaaauguucuugguauugagcaguucucugcuggaugccgggccuguccucaugguucaugcugcccuuagaucaucagccauucacuccuauggucggucaaggacaccuucucuaggaauucucugcugacuuccaaguguggguugggugccccucuucucugcuuucuccuucccugcuuggauuaaauucagagauucuaagaugucuucaucugucacaacauucaugauggauguuacccaucaguguuuuugaaaacgaggucuaucucugcacgguguugaaagauagguggaacuuaucuuuuaauaaucucuucagguggucauuguguauguuugagaaccucuccuuuagaccaugagccugaagaaaguccuguucuugucuuugaaucuuuaaaccuucccuagcuccuggcacguuuuuuaguugcucagauuuuuuguuguaguucagugaaugagguagaauucugguaauuuuuuuguuguuguucggugaaugagauauaauuccuguuaaaaaauguguggaaagcagguaugccuauggaauccaaauccagcaaugugaucaaaagccgcuugaaggauuuucgaacauuuuucauuucuuucuuuuuuuugagacagagucucugucaccuuggcuggaguguagugguccaaucucggcucacugcaaccugggcucaagggauccuccuaccucagccuccagaguagcagggacuaaaggcaugcaccaccaugucccacuaguuuuuguauuuuugguagagauggggacucccuaugcuucucagguuggucuugaacuccugggcucaagugauauaccugccucugcuucccaaagugcugggacuauaggcguuagccaccaugccuggcccauuuuuucuuauuguuuuguaaaucaacauuaugugaaaccuaaaauuuaauauggauauacaaaaauagcuuuuuuauuuucuugcccaagaaaauaaacuguaucuuuauuauuuauauuuuugccguuuugaaauaagccuuuuauuuuagaauaauuuuacauuuauagaaaaguugcaaagaugguauguaaaguuccccaguuaccacuuuuugccacuguuacccaguuuuccccacuguuaacaucuuguuacccaguuuuccccacuguuaacaucuuacauuacuauguuacguugaucacacuuagugaacugauaucaggauuguuauuauuaaaggcuuuaagaguuauuguugaagauuuauaaauuuauagaugaaauaauauuuagaacauaccaaauuuugaauuagaaauauuuuaaaauuugaauucuuugauuuuaagaauuaaaacuuuugaauucuuauauguagucauaguugggaauauauccacaaagcaaguagaccaauucuugugagaaugauucugaaacagguuuuucaguugucauuagccuucuggaaccucaaaagggggaagguuacuuucaaaggcuaacauucauuuaaucuaucuguaguacuccauaugaaugacaaucauuacuuaucgacaucucagguuuuguuagauaugauauuuguuuuaauuauuuaugguauauucaggcagaggugcuauucaaaauauuuaacagguuggcauaggccucaaccacccagacugcuguucaaguaaucagaagggaugcuggcuggugaaugugucaguccuauuaacugacacauuucuauuaaugucuaaaauguccuaaaaaugucuccagauauugccagaugucucguagguggcaaaaucacuucugguugagaacuccugauauaaagcaguuagaacaggcuggcacugcucuaguaacugcuuucuaaauauucacuauuauuauuguuguugguaucuuucauuuguuauuucugauaacuuuuaaacauacacugcuuagccccagcacuuugggacguuuagguggguggaucacuugaggucaggaguucgagacuagccuggcuaacauggugaaaccccauuuguacuaaaauuacaaaaauuaguugggugugguggcgaaugccuguaaucccagcuacuugggaggcugaggcaggagaaucacuugaaucugggagguggaggcagaggcggaggcugcagugagcugagauugcaccacugcauucugucuugggcgacagagcaagacuccgucuaaaauaugaauaaauaaauaaauauauguguguguguguauguguguguauauauacauauguguguguauauauacacacacacauacuguuuaucaagacauauuaggauuucuuuauaguuaaaucaccacaugcauaaaaaauaaaguuacauuuuuuuguaagauuuacucagaauuuguuggagacccauagccuguuguaggaagaaauguaaguucuauuuuugagggagauuuucagccuuuuuuacuugcccucaccugccauguuccugacacugcagccucgagaaagguuugagacuguuggagcacauggguguggaauuuguagaccacuuguucuuccagacuuccucacacccacccauagccugcuuuuaguugauaguggcucagcaaggguaggagccuguacuuuggcucauaccaaauuccccucauuuccgcacgaugauauguuauuaguauucugaucccuguuauuuguuaaguuaagcugugcuucaggaaucucagaagaucacagcauuuuguuuucagugacuucauuucauaauauaugcucugggcaggugagacuagacuuagagacauugaagcccaacaauuuaauauccacaaauaguguuuuauuuguagucuuccuauccuuuccucuucgguguucuagaaacagaugcuuacauuguguaaacacuccuucuguuacugauucuaugguauccauuuuccuauuaacaggaugaagauuuuguuuuuucauccucaagucuacaagaacggaauagucagugggauaugaggaucagauaaaaauccccccacuuuagaaucacugaucuuaguacuuccugcagaaacucugacagccuuauuuuuuuuccuccuuugaauccacguagguguuuuugggaaacauuuauuugcugauauugguugguaauaauaauuguuauuuuuauuucaaauaagaugcugcugguaaaauuauugugaagucuacucaacuuaguaaacuuauaucaaaagccagguuuuacaucugguagaacagagauagucaauuccuugcuguagggagaggaaggguaggagccuguggcucccuccccgccaucuuguccccaaccauucuuauacacuaguuugauucaagcacuugagcuuuggagccagacugccugaauuuggauucagcuacuuuuaccugggcaaacugcuuaacuuuaaaugucugugcucuuugcugaaaaauguggacaauagaagcaucuaucuuauauggauauuguggguauuagacuauaugguaguccauuuaagaaacguucaguaaauguugcucauaguaacagcaauaauguuacuacuccuaauaugacugcuacuuuugauaaauuuagaauaacaguuuaaauuaccauauauauuaaaacuaugugacagucuaaauuaucuuaacaguugaaauaccauaacaguguguauacacacacacauacauacacacacacuuuguauaauggagcugcuaaaaugaaucagguuuagcugaauugaaauuugauucuuuuugccuauuugcuauaggugauagugagccaugaaauaaguaaaauacagaaggagguagauacaacauuuagauuuuuuagccuuacgugaaacaguuauggcuucagaauuuaaagcaccaacauuugguggggucccauggaaauuuuuauuccuaauuucuuaauauuaaccaucuucuucauauucuauuaacucuuguguuguuuaaaaaacauuccaguauucuuucuuucuuuaguuuuuugagaugggggucucacuauguuacccaggaaggccuugaacuccugggcucaagugauccucccacuucagucuccucagaagaagauuccaguauucuuaucuucauuguugagugcuuuuucuuuuaaaaauugcaauaacauuuuaaaaauuagaaaagaaagaagcauccauuucuauuucuaccauauuaauacaacaguaacuuucauuuguuauuuucccaucuagucuuuauacucauacuuaaaaauaauuggaauuauguaauauuucuaauuuuaguucugguguuuucguuugacauuacuucauaagcauuuuccauuuuuuucuguuagguaguuauaccaucauuuauuuaaugguuuuccuguuuuuguuuuuaguuuacuucuaguuucaacauuauggauaauaguacagcgaaaauuaucuuuauugaucuguaaaauggagauaauacaaguacuccagggcuguuguaaggauuauaugaggggauagauauaaggcagguuuguccaccgugagacaguuccauuuugcuguggaagcuguccugugcuuuggggaugcuggacagcauaccuggccgcuuuuccccaguggugacaaacaaaaaugucuccagacauugccaggugucuugcaggggcaaaaccacucccagcugagaaccccugauauaagucaguagaacagccuggcacugaucugaugagugcaguguaaauacuugcuacuauuauuauuguuguuggcaccauccuucauuucagguauucauuucugauaaauucccagaaauagaauuuaugggaugagagguuaguuuuaggguuucugauacgcccuucagaggacuguaacacguuuaacgucaucaguuuauacaaauaugccaguaucucugaggcccagccaguauugaauugugaguacccaaaauacuguuuugucuucaauuucuguaauuacuagccaugaugagcaucuauuauauuuuuuuuauuugcauugccacauuugaagauucugguaaaaaccuuugucuacgcaucguuuuuuuuuuuuuucuuuuuuaguuacucugccauucaacaguuaaaguugaaauucaucccucaguagcuaagccuguauuacauuucaucgcuugauguuuaacagccucugaguagaacauugauugagauccuuuuggauuauuguguuuuucccaguguugcugcauaauaugaaaccuuccaaaauuugaauauaaggauaauuuuguggaaaagaauucaacuuuguauucagugauauauguccuguaacagaaaugauugccucugguuucaguacccuuuuauuucucuuuucuuuucuuuuuucccuucccuucccuucccuucccuucccuucccuucccuucccuucccuucccuucccuccccuccccuccccuccccccuuccuuccuuccuucuuuuuuccuuuccucucuuuucucucuuuccuuucuuuucuuuccuucuuccuuucuuccuuucuuugugucucacuuggucacccaggcuggagugcaguggcaugaucuuggcucaaugcaaccuucaccucacggguucaagggauucuccugccucagccucccgaguagcugggauuacaggugccugccaccaugccuggcgaauuuuuauauuuuuaguagaaacgggguuucaccauguuggccaggcuggucucaaacuccugaccucaagugauccauccaccuuagccucucaaggugcugggauuacaggcuugagccacugcaccagaccugguuuaaguacccuuuuggagauaaccccaauccuagcuguagcagaggcugcuauugaccccacucccugcugucaguacuucuggugcacugggacuuccagcugcccacaccggcaugccuuugccugagggcauucucuggcuggaaaguucacacucagggcuggcaggaagugucagcgcccagcaacccauagccagugacugcugcuguaguauaaauucuccagcucucuugcaucucaggucgccuacuuuugagaugaacauuuuacacugcaucuccaaguucccaguuggguugugaucgaaugguaacuugcuugauaaugaccuuuuuauuauuggccaccuuuccuucuuugucuccuuucucuacucccuagcaguguuuccugggaucacuucugaaauaaacuacuuauauuugaauccuugucucagggucugcuucuugggggaaggaccaaacuaagauauuauuagccaacuuuucuuuugacuuugauugaugaaagaagaggaaagaucagaccaggagaacagaaauauuuugaagaccuuucuguauaaaaaguaaugaauuuaacuucaccgauucaagagacaggacaguaaauauucuuguuaugcugcuucccaggguguccuaagaaagagucuucagauuguacuaugggauuaaagccauggcagauggcacuuaaugucccugacuaaugugacuuuccacccacuuucuuuacaccauaguuugacucaggggcuugcuggauuucagaaagacuagcuuguaguuuguggcuaaaaagacuggcugauguuaggaagggggagaaacaccuuauguguugcucuacuaauuuuguccuugauuuugagcuaauuauuaaugcuccagggaaaaauuuuagcuuggcaggcagggaaauauuaguuucaauugugagcuuaauccagagggcuauguuugaguuaaaaccauccaggagucuuccagggaaguccagaaucuuccagggaagaccagguggaucuauuucuggaugcuaaaaggggcauugcggggcugauaaggaaauaagucccuuguucuuuaaaaaaaaauuauuuauuuauuuaucuuuuuuagagacagugucucacucuguuacccaggcuggagugcaauggcaugaccauggcucaugcagccucaaccuucuggguucaagugauccucccuccucaguuucccaaguagcugggaccacaggugucugaaaccacaccuggcuaauuuucuuucuuucuuucuuuuuuuuuuuuuuguagagauggggucucgcuauguugcccaggcuggucuugaacuccugggcuuaagugauccuccuacuuuggucuccuaaaagugcugagauuacagaugugagacaccucacccagccagaacugccuguuucauuagagagacacaagucaauuccuggaauuuuuuuuuccuuuuugcugccacuuucuuacuuaaaagaauaaaaaucaaagccaaauucaucauaguaaucauaauaauggcaacaacaacaaaaaaaggaguaaaauagaguugugaauguuugcuuuguuauuaaacauaucaacucauuggagcugauuuauauaaaguuaaauccugcuagaauagcuggauuccuuccuacauggguggggugggaaugcugagauccuggugugggcauuccaugccaggguagaaauuuccugcucaggcacuuagugaaggagccaacugagggaggauaggugaugugcccgcccauccgguggcacccagugaccugugcacaccaccccccaucugcccaggacccagccauguuguucauuguacccuuuucagacugcugaccuccaggagcacuugucuuaaagucacauagcuguauuuuuccucuccagaaaaauuuugaauguauuuucuaaauagcugaggucauugcauggucuucagugaacuuagcuacaagugaaugugaccuggagugacccagagugagugcuggccagcauagguuucacauuuucugugugaaaguucuucuuuuguuguuugugauuaauaacuggaugggauauaaagccaaaugauuucauuguugaacacagacuugaaggucaugagaaacugccuguucaaauuacacuuugccaagacauggaaaaaggucugcaucaacaccugaauaguuuuagaaauacgguagagaaggaaaaaaaugacaugccacuuguuaugugaugugaaaguugauuuccacgcgaugcaauaucuuggguccuuacaacaucugaccuaugaggcugaugaguuugcacugagucaggacuuuaaaacaaagguguauugaggaccuacugugugccaggucauuuagaaugaguuuuuaugcuaaguaauguguuauauuuaugcuuauuuuguuaagugcucaguuucucuuagguuuuguauuauguggguuugcuauuuuuuaaaaaaauauuuuuaauuuuuuggguaugguuugcuauuugaaauaugauuuugaauaaguuucucaguacauagcacuuuuaauuuuauguuuuuaaaagauuuuuuaaugguuauacauaauaauugauggacacacaauaguauuuaaaucuaaaaauagagaaaccauggcacacaaaacacaguaucuuacagaacuguauuauuugcuucuuuucuauguguuuucuaggcuuuugagucagauguuaggaaagagucuguccaucuuuaauuuucucacuucgagaagcacugaaauauuucuauacauauguccauugguauagcgaccuaacacaacuuuaaaaucauuuugaaauugacgcacagagagcuugguuuuccagaacuggugagguguaagaugguugaggacugacuuggccuggucggaccuguuucuuuguagcauuauuacuauuuguuuauuuuccaccugggccuuacaucuucccucucaagacagcgucuaggucccaacucaguugguaggaauuugugcaguagcaaaccugcagaugggcagagauacaaacucacucaacucacauuacagucuuucccugucuaaaacaaacaagaaaacaaaacaaaaaagggagagaucauauaggcguguauauauacaauauuuuguuauagauaaggaacaaaguaccauaugaauucaaaaggugagggugggauggguuuagagcugggagagaaaccaucuaaagccuucaugaaaggggguaccauuugcuguggauacugauggcaauguuggggcuggaggaaaauguuccagguagagggcacagaauuaauaggggguagcuauaaaaagcaugcugaauaccaugcuagguaggcauuuagcccuguagcauauagauguaucugaauuuaaaggcagugggugauguucggagguuuggagcauaagauauuuugugaucagaagaaggugaaucugucagagguguuuaggaagcaaauacaaggguagauaguaugggagguuauuguaguaccuugagagaaugcuauugaggaccuggauguugagguugguagccugggaauaucugggcucuguugaugaauuaaauugaguuauggcaaagcucucuucguggauuucaauauuugcgauuccacugcuuaaagcugagcucacucuucuuuucgguguaacugugauggaaggaacuugcgugugagagucucccucuuguugggucugugcuauugguuuguugauuaggaacucaauugguaccugcagaaauugccucugauugggaccugcuucuccccacugucucccuuauguuucccccugagagguaaaaggagugauuugggucaaauguccuuuguuuuggguugguuugugugggaugacuccugguguagauuuugugugugggugcuaauguacuuauagccagcuggggcuagaagcucaggcacccacagcuuugcucuccccacuucgcguuuuuacuucugauuuucuguuucccaauuugugauucacaggcagggaugacugacugagaagcguugcagaugaguccguguauuuguuucauuuugugauuguuucaaauuagcacaaauuugauggcuuaaaacaacacaacuuuacuaucuuacauuucugaagguuagaagucugacacgggucuuacugagcuaaaaugaagguguugacagggccauguuccuucuggaagcuccagaggagacuccuuucccuggucuuuuccagccuccacaggcugcccauguuucuuggcucauggcucucuuuagucuucaaaaccaacaguggugggcugaguccuucucauguggcucguugcucgcucugcuauucaacucucuuccuuuuccacuuagaaggccccuugugauuucacugggcacaccaggcuaacccaagauaaccuucuauccuaaagucaguugauuagcaaacaauacuuucaucugcaaccucaauuuaccccuugcuguguaaccuaagguacucacaggacaugggccucuuuugcaaguggagaggaagaagauguauuauucugcuugccacauugcguagcucuugauuuucacuucuuuuaaaaaagaacaucugcagaaagaauugagagugguggauaauucuccaaucauuccugcuuucuccugaaauaaauuucaugccuuucuuuuagcaguugauuuaauaauuaauuuuaaaaauaauguuagaagaagcuuuuccuguucauguguguguuaugaugcauauguuugucugaugaaggggaaaaagggaaggaaugacucaaguacuuucaacuuuagggccagccuaggauuggaauucuggaguagaucaugaggaggagauggucaacuuucuugugacaaaagcauguacauaaaccacuuaggauucuccacuuuucacauuuuauucugaaauugcaugcuucaguuaaugugauuuaaugguuuucucucagugucauuggcaggauuguuacuaagcgacaaacauucaccacaguguucaaauguacuugggaagaaaaugaguagccaaacuaaaagugggauuuaaauaacuccaauuuuaugaaaagugaagaaguucagagauuacuuaagguauuuuuuuggugaucuguggauucaaugaucauuucguucauggaaggaaguuuuauuuuuauuuuuuucugagacugagucuugcucugucacccaggcuggagugcaguggcgugaucucggcucacugcaaccuccgccuccuggguucaagugauucuccugcuucggccuccugcauagcugggacugcaggcaugugucaucacgccuggcuaauuuuuguauuuuuaguagagacuggguuucgccauguuggccaggcuagucuugaacuccugaccucagguguuccacccgucucggccucccaaagugcugggauuacaggcgugagccaccgcaccuggccugggaauuuauuuucauuaacuuaaaauauuauggcagcugauagagauguaugugcaucgcauucuauuucugacacaauaaacagcguaaucgucacaugaauauaaaaguugauguguuaaagcaguacagcucauguuuauucacuugaaagccaggagaguauacccgugggagauguugcuaucaauaaauuuuuaccuauauauauuuuaacuuugauuuuaaguucugggguacgugugcagguuuguuauagagguaaacuuguguaauagggguuuguuguacugauuauuucaucacccagguacuaggccuaauagccauugguuauuuuuccugauugucuccuuccucccaucuuccagccucugguaggucccaugucuguuguuccccucuauguguccauguguuuucaucauuuagcugccacuuaaaugugagaacaugcgguauuugauuuuucguuccuguguuagcuugcuaaggaugauggccuucaguuucauccauguuucugcaaauaacaugaucucauucuauuuuauggcugcacauauucugugguguauauguaacacauuuucuuuauccagucuaccauugaugggcauuuagguugacuccaugucuuuacuguugugaauagugcuguagugaacauacacaugcaugugucaucaugauggaaugauuuauauuccuuuggguuuauacccaguaauggcauuucuggguugaauggucuuucuguuguuaggucuuugaggaauugccacacugcuuuucacaaugguuggacuaauuuacacuccuaccaacaguguguauguguugcuuuuucucugccacuucgccagugccuauuauuuuuugacuuuuugauaauagccauucugagugaugugagaugguaucucuacuugcauuuuuuuuuugucucuuuguuuuuuguuuagauggacucucgcucugucauccagacuggagugcaguagcgcaaucuuggcucacugcaaccuccaucucccggguucaagugauucuccugccucaguguccagaguagcugggacuacaggcgcgugccaucacacccggcuaauuuuuuguauuuuuaguagagaugggguuucaccauguuggccaggauggucuugaacuccugaccucaagugaucugccugccucugccucccaaagugcugggauuacaggugugagccacugugcccggccccucuaccugcguuuuuaauaaaggauuauacaugagucaaggauuuguuaaaaaaaaaaaaaaauccuuccaagauaauuauacauacauuacucagaacugucacuuuuuuugguuaauuuuacagaugugaauuuuauuuuauagauauguucuuuuuaugacuuuccucaauuauuauauagacaaugcaguuguugaauaauaucuaaauuauuuagaauaauagaauauuuucuauuaugcauuucugaaaaacucaaguuacuguuagaauuaaguaaggauuuugucguagacaaacagauguagcgauagcauaguaaccuacuagguuagauacugccugaaucuuuuguucuuauauggauaaauucuacgagcuuuuauuuuucaaggagaaacuuaucuucaagaagacaguaauuuguuggcggggggcgaccaggagaaaaauccuaagaaugugaaaaccccuauauaaggagaaguuucuguuucuuucucuuuuuuugagauggaguuucacucuuuugcccaggcuggagugcaguagugcgaucucggcucacuccaaccucugccuucugguuucaagugauucucaugccucagccuuccgaguagcugggauuacaggcacccgccaccacgccuggcugauuuuuguauuuuuaguauagaugggguuucaccauguuggccaggccgguaucaaacuccugaccucaugaucugccugccuuggccuucugaagugcugggauuacagccgugagccacugcaccccgccuucuguuuccuuuauuacugauaauccuuagugaucuaaagacugagauccuauaagcuuguugcuacuuucccuuuucaugucucauaaaaagccaugguacaggcuguugggaauuaucacguggacauugaagauaaccuaauucuggccauugauuucuucaguuucuuuauccugcaguguguagaagaaagaaaacugugacauauaucaaaccagaaagacauaugacauuaaaggaauaacaagccuggcacagaguagaugcucaauaaauauuuuuuaaagcaauggaccaaauaauuuguugguauauguuaauuuguuaauuuuuauaugcuagauuccuuguuuuuuggccuuaggaaagagaaacauaucuuuaccauuaaggaauauacaugauaagcauggcuggguggcucaggccuguaaucccagcgcuuugggaggccgagguaggcggauugccugagaucaggaguuuuagaucagccugaccaacaugaugaaaccccaucucuacuuuaaaaaugcaaaaauuagcugggugugguggugcacgccuguagucccagcuacucaggaggcugaggcaggagagucgcuugaaccugggaggaggagguugcagugagcccaaaucaugcccuugcacuccagccugggcaacuccgucgcaaaaaaagaaaaaaaaaggauuauaaaugaauaaaugauaagguuuuuuaaaguuaggguccguuuaguggcaguuuggaaauuacagaucaggaucuaagagagcucuaaugacaguucuuuugugacuuacaaggugucuuuuuacuguguuugacuuaagggauuuuguuuuguuugguuuaucuuuuaauuucuguuuugaccuuucauaaaaugagaccuuauagaauucucuuaagauaguguucauaaacuuuuuuuggauugagaggucuuuaaaaaaauugauguggagguuauagaauuucugccugugcucaaauucacauaugugaggacaugcauuauuuuucucauaacuuuaagaaguuugggaagucacuaaaacuuacccagaucuguucauucguucauuugauucauauuuguuuauucauuucuauggcuuauaagguuuguaggaccaucugacagagugcuacccuuaguuguuuucuuucuuuuuaaauacaauauuguguaguuguauuuuaaaagucaaacauuucaucacauaaaaauuauaaccugggcugggcaugguggcucacgccuguaaucccagcacuuugggaggcugaagugggcagaucacgaggucaagagaucgagaccauccuggccaacaugguaaaaccccgucuuuacuaaaaauacaaaaauuagcugauugugguggcgcgugccucuagucccagcuacugggagguugaggcaggagaaucgcuugaaccuaggagguugagguugcagugagcugagaucgugccacugcacuccagccuggcaacagagcgagacucugucucaaaaaagaaaacaaaacagaaaacaaauuacacccuacuccuaguggggaacccucugauaugguuugguuguguccccacacaaaucucaucuugaauuguaucucccauaauucccacauguugugggaggaaacuggugggagguaauugaauuaugagggcagguuuuucccgugcuauucuugugauauugaagucucaugagaucuaaugguuuuauaaagggcaguuccccugcacauggucucuugccugccaccauguaagacaugccuuugcuccuccuucaccuucugccaugauugcaaggccuccccagccauguggaacugugaguccauuaaaccucuuuuucuuuauaaauuacccagucuuggguauuucuucacagcaguaugaaaauggacuaaugcaagaaauuuguacugguagaguuggguacugcuaauuaagauaccugacaauguggaagugacuuuggaacuggguaacaggcagagcuuugaagaacuuggagggcuucccaggaagauguuaauccccaagacaguggggaaaauggcuccagggcaugucagaggucuucacggcagccccucccaucccaagccaggaggucuaggagggaaaaaugguuuagugggccaggcccagggcccugcugcuuugugcaguccugggacuuggugcccugugucccagccauggcuacaaggggccaacguauagcucaggccguugauucaaagggugcaagccccaacccugggaggcuuaugcaugguguuggaccuguaggugcacagaagucaagaauugagguuugggaaccuccacuuagauuucagaggauguauggaaaugccuggauguccaggcagagguguguugcaggggcagagcccuaauggagaaccucugcuagggcagcguggaagggacacgugaggugggagcccccgcacagaauucccacuggggaacugccuaauggagcugugagaagagggccaucauccuucagaccccagaaugguagauccacugacagcuaacaucgugcaccuggaaaagccacagacaaugccagcccgugaaagcagccaggagggucuguacccugcaaaaccacagggucggagcugcccaagaccaugggaacccaccucuugcaucagcauuaccuggauuugagacauggagucaaaggagaucauuuuggagcuuuaugauuugacuguccuccuggauuucagacuuacauggggccuguauucguacugaaaaucaagaucaagugagcuuuugcccuuuugcuccaugggauguuucuguccucccugagcucaccuuaagacaccugcauuacuguuugacagguguacugccccagucaaacuccccaccuagcacuguccccaguccccugacucaucccugcaagggggccucccacuuauucuacaccucucaugucucuucacugugccagaauagagucaaguucaacagggucuucucuccccacugacuuuuuuuguuuaugugcauuuacuaacgugaguauuaaaauaugaauuuauauugccuauuuuuaauaaauacaagaugauauuauuuauauuguuuacagguuuuguuuuuccuuagcuaaauauacugaauuccuuuccaugccaguauuaguagaucuagcaugcuuuuuuaaaucccccuauuacccauuauuuaccaugaaccuaauucuacagacauacuaaaguucuuugcagauuaacuuuuauuuauuuuauuuaugugcuuauguuuuugagacggaguuucacuuuuguugcccaggcuggagugcaauggcgcaaucucggcucaccgcaaccuccgccucccagguucaagcaauucuccugccucagccucccgaguagcugggauuacaggcacgcaccaccacaccuggcuaauuuuguauuuuuaguagagaugggguuucuccauguugaggcuggucuugaacuccugaccucaggugaucugccguccucggccucccaaagcgcugggauuacaggcaugagccacugcgccuggccgcagauuaacuuuuauauuucacauagcugguggcagaaauaaggguagaagaaggagugacagauuggagugauaucuuaguugcuaaaacucugcuuuguucaucaucucagagagugggugcguagggcuggggaggcauacauucugaaaagaggggguuguugacuaagaaauaggccuccaccuaacaaaacacccacugugacuauuuacaauguuugcaucucagcaaaaauaccauuuguauucugaauuccuuuguuucaacuacauaacucaauaagaaagaaaguuuccuacaauugaaaagaauagacaguguuuaaaggccaaguuuugccuuccuuuuaaggcugaaugugcuuuauuuuaagccacucuuccuccucaaguuaagaagggccuucugguauuucugugcaaagcaccaguaauacuguuucuuuuuaaguuaaucauuuuuaauccugcuuauuuuauuuagugccuauugcuauagcaucuaaugagcucagcgcuucugacaguauguccuauggaugccugggggcagauugccuggguuggacucugcuccaguucuuauuaguuguguaugucagcucuguuuucccaucuguuaaaugggauaguaauagccacaauaauaccucauggcuguugugaggauuaaaauaagaaaaugcaagugaaagacaguccagaggaugggagaaaauauuugcaaauuagguaucugcuaaaggucuaguauccgcaauagauaaagaagucuuuuuauuuuuuauuuuauuuuuuuuugagauggagucuugcuuugucacccagacuggagugcaguggugugaucucggcucacugcaaccucugccucccagguucaagcgauucuccucccucaaccucccaaguagcugguauuacaggcaugcaccaccaugccuggcuaauuuuggcuaauuuuucuauuuuuguagagacguguuucagcauguuggcccggcuggucuugaacucuggaccucaggugauaugcucaccuuagccucuuaaagugcugagauuauaggcgugagucaucauguccagccaagaauucuuauaacucaacaaucuaaagacaacccaauugaaaaaugagcaaaggaauagauauuucuccagaaaagauaaacaauuggcuaauaauuauugcccaugaaaagauggucaacaucauuagucacuuagggaaaugcaaaucaaaaccauagcgaaauuuuucuacuuugugcccacugguauggcuguaauaaaaauggaaagaaauacguguuggcaaggaugugggaaaauuagaaccuuauauugcuugugaaaauguaaaauaguguagcaguuuuggaaaauauuuuggcaguucuacaaaaaguuaagcuuugaguuaucauauaacucaguaauuucucucuaaguuuucugcccaagaaaacugaaaacauauguucacacaaaaacuuguacauggauauucauaacagcauuauucauaauaggcaaaaaguggaaacaaccaaaaugcccaucagccgacgaauggaucaacaaaauauggucauuucauauaauggaguauuauucagccauacaggaaauacaggacugauacaagcugcaacaugcaugggccuugaaaacauaaugcuaagugaaagacgucuggcacaaaaggugacauauccuaugauuccauuuauaugaaaugucugccacuggaaaauccauaaagagagaaaguaggcuagugguuuauuagggcucagaggcuggcagggaaugggggaguaacugcuaauggguuucuuucuggggugaugaaagugucuggaauuaagauuggaugauugucgcacaacuuugugcauacaguaaaaaaccacagaaucguacauccguuaaauccggauggauuuuauggcgugugaauuacaucccaaugacaaaaaauaggauaauagcugggaggugguaccaugccccuaacaugguaagcacucuauguguuaguuauuucugcugcugcugucaucauuuucauuguuacuacaaaaucaauuccauucauuauuccuaaaaauaucaauuucuuaugguuauauuauuucuaguucuuuucuucaaauuacacaaauauuagccacucagugcuugcagaauauuuucaaaggucugcauuugugaacagguccugggauggagagccuuugaauuaccguggguguauguguuauccauuugcuuacacugcaucuucuuacuauaaaauaaaguacuucuuggcagaucauauggcauuuauagauuuuucuucuuacuuucuuuuauuugauuuauauaauuggguacucucaacucccgugauggagagaaagcaaagaaaccaagaauaggauaacgcuauggaaugccucaaucuucuuuuaguuuuuuauuuuugguugaauaauuuuaguuuaguucauggaauaagguaaauauuuuacauuuguuaauaacuccauacuuuguucuagguucaguggcuuacaaaaauauguauaacaaaacaaaauuaaaaaaugaaucaguagagacaaaaagagcauggauguuaaaauguaacuaaaagaugcccugcacgguggcucacuccuguaaucccagcacuuugggaggccaaggcgggcggauaacuugaggucaggaguuugagaccagccuggccaauauggugaaaccccaucucuacuaaaaacacaauuuuuuuuuuuuuuagguggagucucacucugucaccaggcuggagugcaguggcgugaucucggcucauugcaaccuccgccucccgggcucaagugauucucuugccucagcucccagaguagcugggacugcaggcacgugccaccacacccagcuaauuuuuguauuuuuaguagagaugagguuucaccauguuggucaggcuggucuuaaucuccugaccucgggauccgcccgccccugccucccaaagugcugggauuacaguugugagcuaccgcgcccagccuuaaaaauacaaaaauuaacugggugugguggccugcgccuguaaucccagguacuugggugacugaggcaggagaaucacuugaaccugggaggcggagguugcagugagcugagauugugccucugcacuccagccugggugacagagugagacuccaucucaaaaaaaaaaaaaaaaaaaguaacuaaaaggaaauacuuaaaaaauacuggaauuccucaaucuugaugaacuauccuuuccauguuuucucccauaguuaaacaaggaguuuuuacuucuuuugggcaguagcuacauaguaugagacuucuaguagugcacuaugcuaacaucaucacacuugaauguuuuuugaaaauauuuuacguaaaauacaugucccagauggacucuauucuuuaguugguuaucuagaauuaacauuuggauuauguuugcuaaaugcgucagccauauccuaagcgcugugauccuuuuagaacuauuaacagaugagacuggggggcauuuuaugguuauaagagcuaaaugauauuuaugcaaguguguaaacauuaauaacucagcguuuauaagcauguuagaauauuugauuauggcuagggaaaugcauauuagcuaucuagcacagaucuaaaagugaucugggcuauaccuuucauuucuggauuucuuuccuuaagcuuaaaggguguucuaauuucauuauuaucaaucucaagaucauuucacaguuuccuggugguugggugucauggugacuuuuuguuuuccaggcucuuuguuuggauauguggccuuguuugaguugucuuugauugcuauauaucuguacccuuguuugcuuuugccuggcuacugauucucaguguuucacuuugaccuuugauaaagcugugacucugauucauuuuuaggggggauucaccucguugguggaaucuagccuugcccugccaggcggcugccuggguguugcuugcugguuggaauguauccauugaaggccuuagauguuggaguccuugcuuccuagcuccaccucuuuguuucagggcaccacucuucuggucuagugcacagccuggucucugucaaucagcacguucugccuggcguuuuauggcauguuuucuucccccccacauaggguagcagccuuuuuauaaguuguaauggguuuuugauacccacugucauuuuucuuuucuuuuuuuugagacaggguuucacucugucacccaggcugaaugcaguggcacgaucacagcuuccugcagucuugaacucugggacucaggcaguccucccaccucauccucccaaguagcugggacuacaggugugcaccacuauucccaguugcuuuuuuuaaaaaaguuuuuugggucgggccggguggcucacgccuguaaucccagcacuuugggaggccgagguggguagaucacgaggucaggaguucgauaccagccuggccaacauggugaaaccuggugucuacuaaaaauauaacaauuagcugggugugguggcgugugccuguaaucccagcuacucaggaggcugaggcaggagaaucgcuugaacucgggaggcgugaguugcagugaacugagaucaugccacugcacuccagccuggugacagagcgacacucugucucaaaaaaaaaaaaaaaguuuuuuguagagacagaggccucacuauguugcccaggcugaucuugaacuccuggacucaagcaauccgcccuccucggccucccaaagugcugggauuauaggugugagcuaccaugcccaggcuucccagugucauucugauuugaauuuuucuagaaagauuucuagaauuuuucuagaaugauuauuguauccuaaacauuuauagcauuauguucuuuacuuuuuauugcuuagaaaaaaauaguuuaguuacuacugguaauuugcaaauuaaagaauuauguauaaaauugcuauaggugccugugguuaaauucuuuuaccaagauuucacuucuagagaacugaagaauuuaccaaaguaaaaauggucuaacuuuauuacuugguuuauagaaaugaauaaaucauaguuaauaguacaguauauuaauaauacugugcucuaagcuacagauuagaaaaauaugcacccuguuugucacaauaaauggagugaccaaagcuauaguauuucaaaucugugacuauuauauauuuuucuauaccaagucacuucuuuuuuuguuuguuuguuuuugggacagagucuugcucugucacccaggcuggagugcaauggugugaucucagcucacugcaaccucuaccuucuggguucaagugauucucgugccucagccuccccaguagcugagauuacaagcgugcaccaccacaccuggcuaauuuuuguauuucaauagagaaaggguuucaucauguuggccaggcuggucuugaccuccuggccucaagugaucuaccugccucagccucccaaagugcugggauuacaggugugagccacggugcccggccuguaccaaguaacauuucuuucugugugcaggaauauacaugugcuuguuacagaguugaguuuaucauauucuaucaccauguauuucccauaaaucuauuaaguuaaaaucugugccacuuaucaaaguuuggagugauuacauauauauacauaacccuauaugaucuuugaauucagagccuugaugcuagccugagagucuguguguaugaaugcagguggcaagagugaggcauggauuguugcuauuuuuucuaccggagugccauuauuaacaguuucuuuucuguauagucacugugaacacuguuguggggcugcucccuguguguggcucugccucagaacccacagagucggcuggcucccagaccuacucugucucugguuacaagucagugucuuauuuacuggaaguuaaaagacagggcacuguugauuuacacugugcuucagcaugcccuuauuaguauuucuugguucuuccaucagugagucucugauuucuucaccaaaaaauaaucuugcagagagucaugaucaacccuguuuuuauaaaacacugagcuuuggaaagggaaaugauuacucaucacaacucuaaacacuaggauaaaauguucccauuuagaucaaucaggggccaauuuaauuuucuaaugaacuuuagaauugcuuuuguggucugccuuuagggacuauuauuauaccagcuuuucuucuuuuuaauguuucuagaagucaauuuucaucuuugccaagaauuaaaggauccuuaaacauguggaaaagaugagaaaaacagucaguggaucaucuugaugaugauggucuugcaauuuugcagaagguugaaaaggcaauacauauaacagauucauguucuuucuauugaaauggacaaguuagaggucuagauugaauacacucuguguuuagacuuaauaaacacuuucaauaagcuuauucaauauuuuuuaaauugacaaccuguauugggaacugcauauacuauagagaucaaaguugacauuucuugcccucuugggcuuacccaaaacaauauguaaucaaauuaagauaaguacugggugcacaaggaaggaaaacagguugccuuuagagacuggaggagucguccagaaguccgcucugaagagaagauguuuaaaauuaaaccugcaauguucgucugaauuaagcagguugagaacagggugaaggaggcaggcauagcagcaugaaccaauaucccgaggcaggaaagggcuggguuugucagaguaacaugaaggucagugugcuggagcaaacugaggagggugaguguuucaagacaaggcuuggcauaggaguggucagaugauucagggccauaugaaccauguuaauuuaguuguuccaaaguucagagaguugauuagaaggaauaagaagagaauuuaggagacagugucagaagguuauuggcuuuaggcuggaggcaagagaugacaguagcuuggacuggggguugacaguggaacugaagagauguggauggacucaagcuguauuuaggaauuagaaccaacaaaaguugauagaaggguuagauugugguauuagaagaaaggauucauuucagcauccuggcaugaaccagugaauggaugaaagugcuuuuccguaguugggaaagacuagaggcagaauagauuugagagagaagcaacaguucaguuuuuugauggguuaagguugaaaugagucugugagcuaucucaguggagaugucaaguaggugguuaguuacauaguauguguuuaucucuugcugcauaauaaauuauuaugaaacuuagcagcaaaucuauauuaguuaucuauugcucuguaacaagucaccccaacauuggugcuuuaaaacagcaaauauuuauuaucucaugcaguuuccuuggccaggaauuuugaagugguuuagcuaggugauuccaguccagggucugucaugagauugcacucaagaugcuggccaggguugccaucaucugaagcuugaccgaggcuagaggaucugauuccaagauggcuuauguacauggcuuuuggcagaaggucucaguucccugcugguucucggucgaaggccacaguuucucgccacgugggccucucucuagggugcuugagugucuucaugacauggcugugagcuucucuuagagugagagagauaugaaagaaugcaaaggggaagcuguaauacuuuuagucucaaaaguccgacucaucacuucugccauauucuauucaguagaagugagucaccaauuucagcccauacucaguggguggggaauuaagccccccgcuugaauagacagccaccaaauaauuucugaauguauuuuaaaaccaccacacaugauuuuguaauugagaagaaagguuugggcuggaaauaagacauuaggaguuuugcacauagaugcuguggagugaguagaugcgugaccacuuaguaaaagugugaagagguccaagacugauccuuuaggaaaucuaacuuguagaggaucugcuguggaggaguggaggagaaggaagaaauggaaucugggaagaugagaagaauuuuucaggcagggaguguucuauucuguggaagccuacuggaauguguauuugacuuucauuuuuaagaauuuauucucugaaugaaugaagaaugaauaaauaaaugucauguauauguucaaaauuuuaauucuaaguaugauuguuauugaaaugcuuauaaaauuaagaauggaaaucagcauuaggaaugcauaauaacagagugggagauauugguaaaaaauuauuuaauguccagacaauaaaauaccuaugaagcuuuaaaaugacauuauuaaagaaugugcacuguaauaaaaacagauuuauaaaguauuuuaaauaaauauaaaauacuauguaaggaagaagcagacaaaaaugucuaggaggauguauauaaaccuguuaauacugguuaucucugggcagagggaaaaugggugguuuaaguuuccuuccuuugguuugucuaaaucuuccuuaauaaauggaaauugcuuuuguaauaaaauguuugaaaauauccccucccaaaauaaagaaaaauaaugaaaauaaugauaguugaaacucaauugaggggcccggcauauuggcucaugccugcaaucccagcaccuugagaggcugaggugggaggauugcuugaggucaggaguuugagaucagccugggcaacacagcaagacuccaucucuaaaauaauuuuuuuaaaauauuagcugggcuugguggcucaugccuguagucugaaccacucaggaggcugaggugggaggauuacuugagcacaagucaaagcuacagugagcuaugauugugccauugcacuccagccugaagccucaaaaaagaaaaaaaaacuugauugagaaaaauuaaaguacaacauuuggcucugaacuuccuggcagccaagacaaaaugauacaaagaagaucucugaucuuugucaagacacccugcuuuaugccugguccccaaagugagcagaagugaggcaccuugcccucuaaagcaauuccuuucuuuuuuucuuucuuuuuuuuuuucauuugaaggauuucuuuuuuaaacuuuuauuuuaaguuaagggguacauguguagguuuguuucauggguaaaugugugucacaggauggggguuuguuuacggauuauuucaucauccagguauuaagccuaguauccauuaguuauuuuucgugaucguuucccuccccccaaccuccacccuccaauagaccccaguguauauuguucccugcuauauauccauguguugucaucauuuagcucccacuuaaaagugagaaaugugguauuuggcuuucuguucauauguuaauuugcuaaggauaauggccuccagcuccauccaugucccugcaaacaacaugaucucauuccauuuuauggcugcauaguauuccauaguguguauaugccacauuuucuuuauccaauccaccacuaaugggcauuuagguugauucaaagucuuuguuacugugcugcaaugucuuuguaacagagcaauuuauauuccuuuggguguauacccugauauggcuugucugugucuccacccaaaucucaucuugaauucccagguauuaugggagggacccagugggaguaauugaaucauggaggcaagucuuucccaugcuguucuugugauagugaauaagucucacgagaacugaugguuuuauaaagaggcguuucccugcacaagcucucucuuugccugcugccauccauguaagaugugacuugcuccuccuugccuuccaccaugauugugaggcuuccccagccacauggaacuguaaguccauuaaaucucuuucuuugguaaauugcccagucuuggguauauguuuaucagcagugugaaagcagacuaauacauacucaguaaugggauugcugggucaaauaguauuucugucuuuaggucuuugaggaauugcuauguugucuuccacaguguuugaacuaauuuacacucccaccaacaguguguaaguguuccuuuuuuucuucaaccucgcuagcaucuuuuauuuuuugccuuuuuaauaauagccauucugacuggugugaaauuuauaucauuguguuuuugguuggcauuucucuaaugauagugauguugagcuuuuuuuaauaugcuuggccacauguaugucuucuuuuauuuaaagcaauuucacauaagcuacagcgauguucuuaagucuugggaaaacagagggcauacuuuaaaauguagguucugugaaggcaguugugcaggcacaggguagauuccuauauguggcuuagguaagcuuugugaugauuugguauaacaaagugguaaaguuuuuauuaucuugagaauacagcaguugguauucccuuagaccagauuccuucacaucucuggaugacugggcugcaccugauuccuuaagccuggcuggagucaaggagucuguauucuaagacaauucuccaggggauucugauguuuugcuacaucugggaauuugugcaguguacuauucuuuuugaccaugaugacaguuggguuuuauugagaauuaaccauguggcucuugccgcaugcugauuauuaucuuuaauucucauaacaauuguuuaaggguugcauuuuuacccucuuuguauauaggagaaaaauaaauuguucaagacauaaagcagucaaaaagcaguuccauaaaguaguugggagcugaguuuuaccuuauaaggcuguugggaucaaaugagauaauguguacaaagugguuagcccugugucuggcacauagaaaguguuuaauaaaugucaguuuuauuaugagaaaacaugauucauggauggagacucugauagcauccuuagugcaugcaucucccuauuccagucaucuguccuucaguguuacguuuuagaucagaguuauaggacaugucaggcuuauuuuaucuuauuuucuuuuaugagacagguucucacucugucucccaggcuaaagugcaguggugugaucauggcucacugcagccucgaacucuuggguucaagugauccucccaccccacccucccaaguagcugggaccacaggcauaugccaccacacccagcuaauuuuuguacuuuuuguagagacaggguuuuaccauuuugcccaggcuggucucgaacuccugggcucaagugauccacucgccuuagccucccaaaguguugggauuacagacaugagucauugcgcccaggccauuucagccuguuuaacauuccuuuugcagagcuggaacauccaacuccaacuuguagaccagaaauacuccugaauuucuuuccucagacuuaucucaguggcaccagauugaguuaggauugaguuuagcugcaaguaagagaaacccuuuuacgauagauuaacuaagaaagaacucauuuuucucaaguaagcuucagucuguagguaggcaacccagggcugguuaccugcucagggaaacuggcagcuucugucuuccuggaggaagcagaaaggcccagggcaagauguucaugccagccaagucuguuaauuuuuaucagggaaauaauaguucuccugggucuuccacccaauauacuucuccccuccucugggcggaauugagccaaaugguuaucucuaguugcaaggcaaggugaauauuuuaacuggccaccuugcuacagggaaaaaaaaugggauuaaucuuguaagugagaaggagagaaaggaugcuugaguaggcaacuagcaguguguaccauagugaguuccagcaaauaguucuaucuuaaauaccaugucuagaggcaugaucagagugaaaacaauucugauucuagaauucagguuaccuguaauuauauucugaaagaaugauagguugaaaauaugaguauuaaaagacaaaauuggaaccaaguacaauuucuccauuugucuuauaggggaauauaugaaaaguugagauaaauuaaucucuuuucuucaaaaaaauaacacugugaaaugaacaugaaaaauguuuauugcaucugguuuuuuuccucuauguuuuauuucaguaaaauacagauaacauaaaauuuauuauuuuagccauuugaaauguacauacaucuuguuauauaaccaucacuaccaucguucuccugaauucuuuucuuguugaaaaacugaaaauauauacccauuaaaccagggguccccaagcccugggccacaggucgcuacuagucuguugccuguuaggaggcgagucacacagcagggggugagcgguggguaaucgagcauuaccuccugagcucugccuccugucagaucagcagcggcauucgauucucauaggagcacgaacccuauuguggacugugcaugugagggauguaggucguacacuccuuauuagaaucuaacuaaugccugaugaucuguggugaaacaguuucaucccgaaaccacucccccacugccucccccacugccccgcccauggaaaaauugucuuucacaaaaccgguuccuuuuuggugccaaaaagguuagggaccgccacauuaaacaacaacuccucacuccucucuccuccuagcccuuggcaaccaccauuuuacuuucacuauucuagguaccucauguaaguggaaucauaccauaguuuucuuuaugugacuggcugugucacuuagcacacuguccuccauguucauccauguuguagcaugugucugaauuuccuuucucuucaaggcugguuauuauuccauuuuauguaaauaucacauuuugcuaauuaauugaucuguuuguggacacuuggguugcuuccaucuuuuagcuuuugugaauagcguuccuauuaacauggauguacaaauaucucugagauucugcuuucaguucuucugguuauaucauugcauaugcuuuuuacucagaucccguuucuccuugacauaacccuagguaaugguaguuagcuuacucuuaucuugagggaaaugcuaaaguuuugaggaaagaucauucauccaaaucuuuuuguuugauugacucuugcuaaccuccaagaaaaauuugugaucacgaguuauauuuuauacaguccauagguucagggaagggaguaauucuaguguuccuaaaagaugccauugcagugcuguaaugcagaaaaacgcuagguuuugggguguccuuaggaaggagacaagaaagaaaacagagaacguuauccuuccuuugcaaagccauguugacugugcacauggauuacgaucugagauucuggucuccuacuuaaaugauuuaacaguggaagguauucuagugaaggaaacccaagucccggagcgaaugcauuuguuacuuuuguaaaacugacuaaggugaucaguacucuucagucuaaaaauaugaaaguggaaagaagacauacuuaccagcuauaagcuuauuucagaaaagcaaacauaaacuuauucuucuaaccuucaacaguuaucuggacuuuuugaugcuuaaaagaccagcaaauguucaagacaaaugagaggaagagcuauuuuacacugaagauauaauuagcaaguuugcaguacccagugauaguauagacugaauuuacaaauuuuuucuuuuaaaggcaauaaaugucagacucacaguagacuauuaaauaaagacagugcugccagaacucuauuuuuuuuuuuuuuucuuuugagacggagucuugcucuuucgcucaggcuugagugcagaggugcgaucucggcucagugcaaccuccgccucuuaaguucaagugauucuccugccucaaccuccugaguagcugggauuacaagcgcacaccaccacaccuggcuaauuuuuguauuuuuaguagagacaagguuucaucauguugaccaggcuggucuugaacuuuugacuucagaugauccaccugccucagccucccaaagugcugggauuauaggcaugagccacuguccccggcccagaacccuaauuuuuaacagugacaagaaguuaacaugaaggaagucauuaggaaagugaguggccuguaaaugaaguuucuugcgcuuuugcucaggcaauggauuuuaucugucccccucauccaacccuaccugaaugagcuuuuuaauuaaaaaauucauuaguaaggcugggagcagugguucaugcuuguuaucccagcacuuugugugguguaggcgggcggacugcuugagccccggaguucgagaccagccagggcaacauggcgaaaccucgugucuacagaaaaauacaaaaauuagccaggcauguuggcacaugcccuccagguaccugggaggcagaggugggagaaucgcuugagccucggaaguugaaggcugcagugagccgugaucauacuacugcacucaagccuaggugacagagugagacucugucucaaacaaacaaacaaaaaguauuaguaguuuaugugaaccuuuucauaguuaugaaaauuaaaaauaagaauauguauuuuucaauaugagacuaaaccuuucaauuauuuuauuuauuaacuuccaauuuauacccuuuuaggcaaagaguucugugauuuaugggccaauuuuuaaacugugauguccaugggaagaaauuuuuagcccugaguuuugaaggggaaugcaguguuccuuucugacuuguuuuuccugcuuauuauaaauauuuaucuuggacaaaggauugcauuuuagcggaugugcaauuuuacaaauuuaauuauuaaaaugacucuucuuccuuuuuuuaugaucuuacauuuuguuuuuaacuugucauggcggauauuaaaacacuccaaauaaagacaaaaaaacucaauauaaaaaaaaaccaaaaaccacuuccgaaauacuccauuuuuucuuauuuaaaaaaaugcuauuuauaguaguaguuggcauuucaucaaaguacauaagcaaaggacagauacuccucauuuuuucccagguuucuauucuuuuucugaaagugaguaaaauauuaggcuuuggagaaagucuagguaguuuggugugaucuguugguagcauuuuguuuugccuuaaucuucuauuuuuuucuucccauuuuauuuauuuauuuuuuugagauggaggcucauucacuuugucgcccaggcuggagugcagcggcgcgaucuuggcucacugcaaccuccgccuccuggguucaagagauucucaugucucagccuccugaguaguggaaauuacagguacgugccaccaugccuggcuaauuuuuguauuuuuaguagagaugguguuucaccauauuguccacuucuugaacuccugaccuuaagugauccuccugccuuggccucccaaagugcugagauuacaggcaugagccaccaugcccggccuucuucccauuuuaauaacuaaugauuuugccuuaaaauacuugaauuuauugcaaaagguguauuuuaaaugauucagcucccucuuccacgguguuucuguagugaauagacuggaagcugggaagaaagugaccuccauaaacacaguuauuuuacauuauuucucucucugaagagagaauuagcacucuuuuucacuuccaaguggaaaacccacuggacaggcaggugcaaauaaagcaauguaaaccggcaaguuucauuuuuagaaauaugugggcuuuauccaguuuaggagcuuagcucccgauacauuucugucucccauccuuugggauuugggagcuuuuuuuguuuuugguugaguguuggcaucuacaguaucucccuuccuccuagauccuuccugucugcauguaaauacagauaugcagaagucucccuuauucuuaccauccuccaccaaagcagacagacccgcagacagacagaccuugugucagcccaguuuauuuuuuagcugacaaauucucuuccuuuccuacuuguccucauuaaaguggagaaaaauacaccuuuuacaagaugggugcauuaaagaaaaaauguuacagaagguauuacguauuuauuacaaacuuagaaaauauggcuaacaaauaauagaauauaagagucacucagaaucuucuaacguacagauacagugcuaacauuuuggcucuuggcuuucugucauacguacacuuacguauaagugaagcacuguguauauucuuuaaugaccugcuuuauuaccccuuaauacauugugaaaauccuuccaugucuuuccauauucauuauauguaucugaauaucauuuuuuuaaccuuuuguguuuuuuuuuagagacagggucuuacuuuguugucccacuggaguacaguggcacaaccauagcuuacuccagccucaaacuccuggguucaagcgauugucccacccuagccuccagaguagcugggacuacagguguggaccauucugccuggcuaauauuauuuauuuauuuauuuauuuauuuauuuauuuauuugagacaggaucucacucacccaaacuggagugcaguggugugaucacggcucacugcagccuccaccuccccagauucaggugaucuucccaccucagccaccugaguagcugggaccauggcgugugcuaccaugccaugugcuaccacaccuggcuaaguuuuguaucauuuuguagagaugagguuuugccauguugcccaggcugguggcucaagcaguccacccacuugggccucccaaagugcugggauuacaugcaugagccaccuugcccuacccgcuaguauccuuuuuaaugcaugaaaauauacuuuuaaacaguucucauggauggacacugggaaagcuagaugccugugagaguuugagcuccucagugugaagacccucuccugucugcucuaauguugcauuuuccugguaugaacccugaauaucugacagaggucucaguuaauuuagaaaguuuauuuugcuaagauugagagugugugccugugacacagccucaggagguccugaugauauguucccaagguggucagagcacaguuugguuuuauacauuuuagggagacaugagacaucaaucaacauauguaagaugaacauuggcuuggucuggaaaggcaggacaacucgaaguggggacggggcuuccaggucauagguuaauaagagacaaaugguugcauucuuuugaauaucugauuagccucuccgaaggaggcaaucagauaugcauuuaucucagcgagcagaggggugacugaauaaaacgggaggcggguuugcccuaagcaguucccagcuugacuuuucccuuuagcuuagugauuuuuggggccccaccguuuauuuuccuuucacacugggcuugcuugauaaguuuaccugaguaugcugcuaaucucucacauuuuuuggugcaaagaggaauuucuuuccuuaaucaauuucuuucugugcuuaaaaaaauuuuuuuugcacuuuuuauuuuuuaauggagagacaccauucuuuaaguuaccaaagucugagaaguuuuugcacaucccuuucuccuucauuacucuuuuuuuuuucccccccugagacggggucuggcuguguugcccaggcuggagugcaguggcaugaucucggcucacugcaaccucugucucccagguucaagcgauucucccgccucagccuccugaguagcugggauugcaggcgucugccaccacgcacagcuaauuuuuguauuuuugcuagagacaggguuuuaccauguuggccaggcuggucuugaacuccugaccucagaugauccgcccauccuggccucccaaagugcugggauuacaggugugagccacugugcccagccuuuccuucauuacucuuauaauaauucaguaguccagucccagcaugggggugggggacuuggaguaauauuggucaaagaauauaguuugacaggaggaauaacuucaagagaucuauuguacaaggugaugauuauaguuaauaacaauuugguguauacuugaaaauagcauagagagcagauuuuaagucuucucaucacaaauaaaugguaaauaugugaggcaaaagcacuaauaaauaaaauuuugucucuuaagagccauagagucuaauugagaauagaacgggagacacgcuguauaauaaugaucaugcccauccaccucaccacgucccagcagcaaccuucucucuucaauucaauaccuauugcauccaccucccccuuucuugucucauuacuucucuacucuuucaggcucgcugaugucuagcacgggcaauucuaauaagccucaaacuggcuuacuuucuuccggccucccuccccaugaguccauuuuucauguuaaucucacuaaagcacccuucugaucaugucacgcucuugcucaggaaaagccaauggcccacauuaccugcucauuuaaccccuugcuguggccuucaaaguccucugcaauuuaacugcagccuguuccaaaauucaguggcaucacagcucugauaaaaaaccacccagccaaaggaaccucuucacaguugugucugcaucauguuuuuaggacuuugcugcagcuguucucucuucuacaaaugccuuucuaaccauuuuuacgugccccaaacauaguaauucaagaucuagcucaaaugcaaccuguuccucaaaucuuuccgugauccccuuuucauccccaucaagacauauuugucuaugaauuuaugaauguaucuguaccugauauauuaguuauaauuuucuguugucuuagucccuuccccacucaucccaggccacuggaccacagcuuccuugaaagcaacaucuggaucucuuuugggacugacacauaguagaugcucuguaaauguuacuauuucuuuguacaguguuuuucacaaaauaguuguacaacuaauuguuauauuuaauaacaauuagucauuuagacuagaaaauauaaaacuuaagacaacaaacauaacaaagaguuggaaauauucccaguucuuuuuuuuuuuugacacaaggucuugcucagucaccuaggcuggaaugcaguggugcauucacaauucccugcagccucaaacuccugggcucaagcaauccuuccaccucagccucuugaauaagugguacuacaggcauguaccaccauacccagacacuuuuuugauuuuuuguagggacagagucucccuguguuacccaggcugaucuugaacuccugagcucaagagauccuuccuggaggccacccaaagggcugagauuacagaugugagccacuugccugguccccaguucuuauuaugucaguuuauuugacuagaagucuuacaaaaugaccuaagccaauuugauuaugcguaauuauaaauuauggcuuuuuuuugauugguaauguuggcucccaaugccacugucuuccuauaagggucauaauaaaggcaaguuucagaccaaauccugccauuaacauuggcauucauuaagcaaucauuauucgcaaguaggcucgaaaaacaguucauacagcuugcauguaaaguugguaagcugcagcucugugucauuuuuguuuuuuuugagacagagucucucucugccgcccaggcuagagugcaguggugcaaucucggcucacugcaagcuccgccuccgggguucacaccauucuucugccucagccuccccaguagcugggacuauaggcaugcaccaccacacccaucuaauuuuuguauuuuuacaaaaauacaggguuucaccuguuagccaugauggucucgaucuccugaccucgugaucugcccuccuuggccucccaaagugcugggauuacaggcgugagccacugugcccgacagcucuguguccuuuugaaggucauaguuaaaguaaaugcagcaauauucuagagcuguauaauuuggugcauugggugcugaguuccugaacuguagcuagucugaauugaaauaaugcuguaaauguaauauacacacaggauuucaaaggcuuaguaagaaaaaaagacuauaaaauauauuuucaagauguuuuaaaauauugaguauauguugaaaugauaauguuuuggagauauuggguuaaauaguacauauuacuaaaaauucauuuuaccuguuuuuuaaugcggcuuuuaaaauuauguaugugacuuucauuaucuuuuuauuagacaauguugucuuagggagaggauuuagucuuauaaucagcagcagauaacuaaaauccuccagccaauggcugaacauaggaccuuuagggaucuagccucccagacucacuagauuuuuauauucuguuuaaucagugguggggcaugucuagaaaauauuuugaccaauccuuguucauugaauaacacuaaaaucaacagugggagaauauuucuaacauucuaauuaugccaauuauuaagccacaguaaaagcacauuucucauauucauuaauuaacaaagucucugguguugaugaaaauaaagauaacugaugccuuuguagugguccacucuggaguuuagccuuucuaauuaaauuauagcugaacuucucuggaauguuauacuggcuuggcacaaaugugagccucuagugugguuugcacacuggaauaugugugucuuacugugaucuuggcaagcuuuuguagugguuaaggcacccaagauagcauccuaccugucucuuuucuuagcguuccuuucauaauucuucuuuuugacuuuauaaaagaaagucauaccucucacucuccucaaauuuuacugugcugcauugcugugaggcaucaaacaagaggacaauuuaagaaugcaaaacaaagagcaauccuuuacaaauuuuuuaaauggcuggugcuuguugcauccagggcaaggcuuuguguccagcugccauccauccauccauccauccauccauccauccauccauccauccauccauucauccauccauccaucccuuuaucuuagaaagagaauucugaagugagauguuauuuggaaacaccuauaacaugguuuuuaaauccaaaaccaagucagacuccucuugucagaaaauaaaucugcuuuggcugauuaguuugacagugaggacuaguuuugccaauuagguaccagaggaggcauuuucuauuaauugaaugagcuaaauuugcaacuccuuaacaacaugcuagaaauuacaucuuuuucacgauuuaaauuuaugauaaauaucaguucucaacuuuaaaaugugcauggaaauucuuuuggaaguucacgaacaagaguguuugaagcuucugacuuaaacuaguuuaacacaagcauauuacacuuuguauguugaaaucuucuaaaguauauuauagacauuauauaggaaguuuuaagaagaaaaagaaacgauggaaaaaggcaauccagaagagaaaugguagaaagagacugacccacauggugcagggagcccagacugguacagcaggauggcucuguggcugagaauuccaagauggcggccugugucaugacacgucagagaaggguguugaaaaagaauauucagugacgcaggauggagggagguuugaauguucaaaaaaguagaacaggcagaaggagguggguucugaaaaugaagaggagagaaagagggggagagucuuugcuccaaugauucuccaaaugaugggguguaguaaagaaggcuuggcagauuuguuugaggggauguucauuguggcccuuaagguuauguaaacuuuuguagaugucuaauccugacgagcuggagacacuuucucuuugacccaugaguuuuuugagguugcauuguucuuugaugcuaccuggagacucuccugucuggaagaauggaaagaucagugcuuuaauguauguggauugcuguugucugggucuugucuaucucaagguguuguaugggcucugacacacagaggacuaaauugaaguaaggaagcaagccaaacuguauuauugcugguccauuuuauccauuggaguuguuggcuucagaaugucaucauuggcuuuuacaaugcucauucacugcuugaugcuuuucaauuuauuauugaauuaucauauauauguguauuagucucuucuuaugcugcuaauaaagauaugcuggagacuagguaauuuauaaagaaaaagagguauaacggacucauaguuccacguggcaaagggacgucucucauggcagcaggcaagagagaaugagagccaaaggaaaggggaaaccccuuauaaaaccaucagcucucaugagacuuauucauuaccacaagaacaguaugggguaaaccaccuccaugauuuaucuucuaccagguuccucccauaacccaugggaauuaugggagcuauaauucaaaaugagauuugugugaggacacagacaaaccauaucaauauguauucucucacaauauauuuuuuauuugacuaugaugacccggugucaugaucuuagaagacacauggcauacagugaaagguuuccuacauuagcucuauagaaaacauagcauuccuauauaugcaucuggagagauauuuggguaaaguauuguucucuuuuucuuuggauauuuuauacauuuuuuuguuugaaaauugcuguuucuuggauauuauauuguuuuauucugugaauuuaugaggaagaucccucauaacaugaggaaaauaaugaaauaaauaaaguaauuaaaaugagaaaaauauuauuugaauaauuagcagucuuacaaggacauauuuuugcugcuauuuugacaaguagaacuugucaugagaaagucugaaggucaaaucacuggaaugguuuuuacauucaaaauguuuuccccauuuuuuuuccaggcuuauacaucuagaauuauauguuaaugagauaguugcuuuuucuugagauuucugcagacaguuuguagaacauaauagauguuuauuugauaauaauaaagugaggaauuuaauuucauagaaauuuucuuucauaaguuuagccuuuugucaaucaauaaaaaaauguuuucuguuggcuuuucaugacagugacucauaucauuaugacuaauucacuguguccuaaauaaucccuccuuguucuaugacauuucuagcaauuuuaaugaaaaucuucacuccaggacaaaaauucaaagugaaguguuuguauguaagguuuacaaucucuaccaccauaaauggagucuguuuuucugcauuugcaacacauauaauaugguugauagaaaagauguugaguuuuuuuuuuuuuuuuugcaaaauauauuucuagaggaaaaguuucaaacagugucggaugccuguaaaucuuagaaacauucuuucaguuuaaguuuaggcgcucuagaaagugcaaguagaaaaacauuaucuccuauauuccuaugcauuguuuaaaaaaacuugaguuuguugaaaagaaaacagguuaagaaguaaauaaacuaaaauuagaagauggaauuaaugguuacauuuaauucugaaaauaacuauuuugagaguaaaucaaucauuuggcaauaugguguggauuaaaugugaaaaagcaauuucugaaucccagcuacuucagguuagcaugcuguuaaacuugaacucauucagaaagucuucaggaggugucuaaguuuggggguuuuguuagguaguuucuguguuuucaaagucagucuuacacuaggauggcuauacauuuuuuuuuaaaggaaaauaacaaauauuagugaggauauggagaaauuggaacucucaugcauuauggugaaaauguaaaaugaugcagccacuaugggaaauaguuugcugguuccucaaaaaucuaaacauagaauuacuguauauuaaccuagcaauuucacuccugcaucuacacccaaaggaacugaaaucgggaacucagauacuuguacaccaguguucauugugacauuguucauaauagccaaaaaguggucaacuagugcucaucuuuagacaaauggauaaagaaacuguaguuuauacacacaauggaauauuuuuuacccuuauaaaagaaugaaguucugauacaagcuacaacauggaugaaaccuugaaaacauuaugcuaaaugaaauaagccagacccaaaaggacaaauauuguaugauuccacuuacaugacauaucuuaaauaggcaaaugcauagaaacggacaguagauuagcuauuaccaggggcugguggguauggggacuuauugcuuaaugacagcagaguuuauguucagugugaugaaaaaguuuugggacuagauagugguuaugguuguauaacacuguagguguaacuaaugccacugaauuguaugauuaaaaaugacugaaaucacaaauauuguuauguauuuuaccacaauuaaaaaaaaucuauuaauaugccaaaaacgauugaauuguaaacuuuaauugggugaauuauauaguaggugaauuuaaauggguaaauuguaugguaggugaguucuaugguagguguguggaugaauuguaugguaggugaauuuuauaccuccauaaaacagguuuuuaaaaagaggcagucuugugaguaggaggagagcuagguaaggagacaugaaucuugauuugauuuauggcaccauccaacugcaugucaugagggguaaguccuugaccucucuggucacaggauggaaucccaucaggcacccucuuauauacuuccuacuccuguccucuguggcuccgugauaguaagguggauaguuuugguggguuagguugguucucagcuggaacaaauauguuccucuggccaggcacaguggcucaugccuguaaucccagcacuuugagaggccaagguggguggaucacgaggucaggaguucgagacaagccuggccaagauggugaaaccccgucucuacuaaaaauacaaaaauuagccaggcuugguggcacacgccuauaauccuagcuacuugggaggcugagggaggagaaccgcuucaaccugggaggcagagguugcagugagccaagaucacaccauugcacuccagccugggcaauaagagcgaaacucggucuuaaaaaaaaaaaauguuccucugaugcugaacaugauauaaauucuaaaugcaguccagauguggcuguagacauucuaggaucccaaggcuccauaauugccuucaguuuugggcagaguggaugggucauugggucaugcuagcagagcaugugcuugcuuaaggagguugauuuuuuucagauaaucucgauuuuauuacaagaacauuuuuaaagcauauauuuuaacuccauacccuucuucucuuuuaugggcauauacaguuuucaggauugaaaacuucugaaauuuggauugucuuagccuuauuuugacaucauuagauguuauagcccucuguguuuucuuguagauaccaaaauuauauuaaacauguucuuuuuugugagguauugagucugaggcugaaaugaagagguauugacuaggcuuauucuaucuagaauguccuucccaucuuugcaugaaccauacuucaucuauuuuucaagauauauuuuaaagccuucuuuccauuaaauuaucuuuaaccuccuccuacauggaagugcauugaacacaggcuccacagucaguuagaccugguucucucuguggcccagcauuugcugggugggugaugcuggacaauucauuuaacuucugccucagccuucuccuuugacaaguggaguuguuuuccuuucccuucucacuuccaccauuuccaccucuccuugccuuagggcagagaggaguuaccagcagaaagacuggcagcauugccugcugucuccugcucaccauugcugaugauuggcauuuguauuucaauauggcguccgugcucuggaaaggaauaaucuggaaagaugacugggaaguagaugguuugccugugucaucaccacguuuucccuguucccuggggugguguaccugcucuugcaauauucucuaauuucuggaugaaccuggcuuuggaagguacugugcuguagguuuuuccaggaguuuuguuugcuuuggaguuucuuaacaaccaucauugccuuggaggcuuugucaacauuuugggcuuccuuguccucaauagauuugcuuguugggccacacuugugccuuuucacuuauucucaccagggacuuccuucacugggcaucuggcugggauucuucuugcauuaaugcacacucaagggccucugaagaacaucauggaagcaugugcuggcauuuuuuucccuccaauuauugguuauccaggacagugauauuacuucaauuguucaggcuagucuggauaucaggaucauuaucuuuauggcaggccagguuauuaugaagaagcacccaggagcuaugauacauacacagcaguacggagagaaaaagaacagcuugugagagcaugaagagccagccccugggaucaagaaaauaccaggaauagcucacugcccugcgggcuucuucucucagaagaaaugagacuauaauggcuucacagguuugauagccagugaggugacacagcaucuugggaagacaugguccacuuguguuauuauugcccaucggauucauuccccaagcaacuaguucauuguaaacuaaagcaaaacauaucguuaaaaaaaaaaaaucaacuuguauuuagcuuuuuacagagugaagugaaacucuguuuuaaaugcgguuuuuagcuuuaauaacgucaagguuuaaauguggcaaacucacaaaaauaucauuugaaauguuaauuaucuaaacuucuuguacacuuagguaguuuugacaauucugaaaacuacauuuuuaauuuuggcuuuuuuaagguccucugaggaugucggauuuugaaagaaacucagggagguuaaacauuucuguuugagagcagucuguauccuguuggcuuuguuucuuugucuacauacauauuuauaauauuuuacagauuauuauauaauauuuauuauucccauuugacauuuuaauaaauauuguuugaauaaaugaauuaguguuugggugugauugggugugaugaaacaagagagcauaauggcauaacuaagugugaguggcagaauuauauugggagugauucacauguagggcccacaaaaagaagaaaugagaauaugaucugaaaugcuuuuguuacuuccaaaauaauaaucuuugcuaacgagagauuggcuuucuaggguguguuaaguuuugcauuugugaaagaggccuuaauaaaaucaauccaaguuuaaaaucauccaauaagagauuucuuucuuggcuaaaggucuaggugcuacuuuccugaauaauaagcugcacuuuagggaacucauguuauguuagugucagccaacuggacacucuuaaauugcuucaaaugguguacuagaggauaaugcuuucucucuaauaacaguagaguuuuagaggugauuugugugcuuucauaggggaaacaacuccuaauuucucugccacauuuccaguuuaggauuuaaauugauauauguugcuacguucugcuaaaacaauuuuccauacccauuugagcuggugaagugaaaacauuuugaaaccaguuuccuugaagauuuaucaagcaguuuuguugaugugucuugcuauacuucuuuuaccuaucacagaaauaaaaucccaggcuaggcagcagugaaggccuuuggaucugugugagcaugucaaaagcauuuuaagaagagcaaaauauuuagaggaagaauuugggaaagcagccuuaagggauuuaacacauuuuucuucuucuaauucagucucguguucaucccucuaauggagaaaggucauuaauggauaagauuugcuaagccagcaaaggcuuuuagaaacaaaaugguuuucaaaaauccaagccuaaggaaaacaggguuugaauuugggagcuugaaagaauacauuuagagaagguguauaugcaguguaaauuauauucauucacuuaauauuauacauauauauuuauaaucaaguuauaguauguuuguugcauucuuacacauuuuuguuuuggagaaguuaaaauaacgaauuggcuugauaaugaagauugaaauaauuucagacuguggaaguucuguauaaauuucuaggcagacaaaauggcugaucagaauagcaugacggaguuuuaguuguccuguuacucgucugcuauuuuuacgugcccgagaucugggccaagauuguuuaccuuaauuguugugauguggagguuaguaagugugugaaauuuguuacauuucaaucucauaauugaaaagccacaggcaaauucuuguucuuuuacugaauuccugucuaguagaaaauaagaaguauguguguuuguaugugugugugugucugaaaaaaggaaaaugcaaacuagucuuugaaauauguacucccuuuuccccauuuuuaacuguaucaagagaaugaaugcggaaguguguuuauaaacuuugaaguauuuuugaaacauuuggauguuagaaaauguaucguuuacaggcaaauaauuugucuguuacuuagacuuauauucugacauugacuugacccauaaaauaaagacuauuguugaaauauuaucuuacucauuuuuacaaacauaagaaugggaauccauaaauuuuauuucauuucauaugugauaaaauggaaagauuauuaucauugauaggguaauagugcucauuucuuugcccacuuuauaucuggggagaaaccuacauaguauuagauauuuuaauauguuuuugaaauaagaaaguuaaaugcuccggaaacagguuaagaaaauguaaaauguaguaagauuucucucuuagaauuuuuuccauuuuuauggccccaaauucuuaaguugugugaauguuaucaaauuaagauaauuuaauacuuauuuaugaccuuucuauauuuuuuuauucaugggauuaaaugaaacugcauauaacaagauuuaugaaaauaaauccuuuuuaagguagugggacaaauaauuggauuuuccaaaugcccuaaacacugauuuuuaauauuaaauucauuuuggugaggcugguauauccccccuucagguugauguguggugguagccuuauauucugaguauaaucucuacugugucccucuuugauaugaagaugguaaagggucauucacuguguaagcaaguucucuugguuaauaaauggcuuauguggccuugaucagauaauauaaagcuugaaauagggaucguugcugucuuugcuguccuuucuugaaggaaggucaccucugagcaccauuaauaucaaggaguuucuuaaacagcaguuuuguuuucuauaccacuugcucccuuagugucuuggaguuggucuccaauuaccuuuauggauuuguaaaagugcauuuuuuuuuuucugaagcugcugcuauauuuauucugggaaugaccuuuuaauuacaaacucuccuuccacaaggggguaaggaccgaagaccacaaacugggugaagugguaggcgaaccucuaaugauccuagcagagguucgugagcaggucuguauuuaauguggaacugacacuggagggccaagcacaccugggcuuccuccauuauuauuuugcugcucugaugugggaggcagcccagcaguauaaaagguggcaaaggaggcaggacacacauauggauggagccacaccuuucugcacugucgcagauacgccuuggacagcuuucugaacaacugauagagauugugaaaaugcuguuuuguaggauuuaagccaacaaugacucuuuuacuggcuuuaauagaaaaucguggagugauggaagaguaugauuugaagagguccaaugaauauuuauuuaucuaccuugcuuacacuuuuacuguaaucauuauaacaacgagcugaacaccagcucuucgucaagugcuuuucauuuauauucacuaaccuuuacaauacucuugcaagcuagguauuauuuauccccauuuuacagaugagaacugugaggaaaagcgauguuauaaugacccaaggucacacaauaaauggauugggacaccgucuauuugguucuaaagagaaaguccuuuucucuuuuuguuagccacauggacuccuuguauguaaccaaauccuucuacccauauuucaaaaguucaggguggucagucuuuuaaaguaacuuuucuuuuuuuuauggcucagaaaaugaauuuguaaucaaaaccaaaacggauaaugguuuuaaauucuucugauuuuucuaccuguaaaaguucguauagaucaagaucauuaaaaccucaugccaaucuuacuacaggaaaauggguuacaagauugaccauaaaccuuauacugucauucuagaggguguaggaccaguaugaagagggaggaagucacgaauuccugaguuuuuauuggauaacuuuaauuuuuguuuuuagcaugcugacauuuugauuaugcugaaauuuuacuugcacaaaauguagcagaaagugcuacggguacuagcuggaaaguagggcucugauuugauccgauaaaccuggauuuggucacugauggcaggacuccgggguuuagggugagacaaccuggucccuugggaaaggugcccgagccucccucuguuguaggcaguguugggcuccauaaguguaccgggcagucaucacauucugcauuagcuccgccucauugugcucaaggagcucgacuaauaggacuauuuuaaacucuccaggauagagauaaccuuauuuggugcuuuacuaaagguacagacucucauacuuuuuccuucucuuucuuuuuccauuccacagaugaacacaaugacguacagaagaaaaccuuuaccaaauggauaaaugcucgauuuucaaagguaacugagacuuucaaaaacuucgaugguucagaugccgcauucugauugaaggaguuugguuggaagugcagugaauuuuccccaggaaaugucaccuagccgaagucuucugaguaugcagauacauuuguuguuccuuuauucuguccuaaaauauguuuaaacggaaauucucaugcacauaguuuaugggacgcuauugacuuuuaccuggccuucuccagauaucuaaggcagcaguuagcugcuuucgauucugugaauccuggguacaucuuggaaaagaauauaucauugggaaaauuuuugaguucucuugguuaagaggaugaugauuucauuuugccugguuaaaaccaaauguuauaauucaggcagucuuucuacccugucagaaauauuuauggauuuuuauucuuguggauguggcuaauaauauuuaucugccuuguggguuguuuuuucuuguguacuuccuuaauuccucccccaccccaaagaucuacucuuagcauuucuaaccauuuagaacauaaucaaugcuuugagcaauauuuuuucauaggggcagagcaugcugaagagaggaauugucagugcuauuuucaaaucuguucuaauaugauuaucuauuaguuauugguguuggaauuuugugcacuaagccugagguaggaggagaguuuucaggauaacagauuguuuaggacucuucuacaacaagaugaaaaauagaaguuucucagagaaacacuguuguggucuuuuaaauaguauaaaagcuauuuuaaugaagaguugcuuuucaaaauuuuugguugcuuuucaaaaguuguaaaggucagagagacaaacauugguauuucuugaggaaaaaugaggauaucuuaagguuacuuugaguagcagcauaguuuaaaaaaugcuccacgucccaauauuuauaguugguuauuugauuucacugcuuuuugggcuuugcgaguuuaucuugagggguauuuuaucuugccugugaguauguaaggaacaugaaaaccaacuuugacagaggguuaaaaauacagagaauuagaacauaaaggugcuugcauaauuggcaguuauauguguaggauuauuccaaaucacaugcagguguguuuugguaaauuuuaguuuguuuuauuccagagacacagguaacauaugugcaucucgggcuugacaugaauaaaaacuuuugaacuauucaucugcaugugaccauuuuccagagaauguaguuuuagcaacugggagucuggauaugagguguuuuauuccaguggucuuaugauugcucauaaaaguaagauuauuuuuccugguuauucacgaggauaacacaguaauuguuuagauagaacaagugaagcaguuuuuagcagcuuaauuuagucuuuggggaagaauugccuuagaacuaauuuugaagauuguuuugaaagcauuaaacuugguagaccuaaguuuagagagcauuugaaacuggguaaauuacuuuuuaccuauuuaugaaaauggagagaaauagguaguaaaauaggacauggaaaggguuuguagaggaagagagaugacaacugagacagaauaauugaaaagaaauuucucaauauuuauggugggucauugacaccuuuaaaaagaccucaaagaaaacaaaaucugguaguaccagacuaguuuauuaaaugaacuugauauuuaaauuugugcauuuauaaugucuauuauuuugcaauuaaauggggcuuuaagucccauguaaauuguuugcccuggaauauuuguauuucuuaccaagauacuggaaaagacuugguaauuuuuaucauuuuuaguaaaaguuauaguuaguuuuagcuaaaagcuucucuauuaguguuuggagaugguaguuucuaagcucagcuucuguguuaguguuuggagaugguguuuggagaaaaacuaccaaacgugggaugacucugaaaacuuuuauuuucaucuagcaagaaaucaaaaccuagaaggaauuuaucugagaaauuaugaauauuuggagaugggaagcucauggcagugacacuaaacauccacauuauuuuuucuuucuucuggcugucuuaagaccauaaguuggauugcuuccaauuggggauagugaaagagggaguaacacauuucuagacugggagauuuccauagacucccauguggcuuaacucuugcugagcuggggaaagaccguauucaugccugguauuacuagguaaugcgaggauagaacaagaaaaaaaaauaaaucccguugaagggaacgaauuuuuuuuuucauuuuuaaaaauccauguccuuugguacauugugguggguuuuacaauauaauuuuucaguggguccacuacuucccuacaguguggguuccuaaacagagcaacaggaccucugugcugagaaauccaaacagacacugauggcaccuucugccauuuaggaauuuguuuuaaaacagacauuugucuagauauuuccuuuguggccuccuccccaucaaaagucaaucaaacaucgagccuuguuaauuccaauaccuacauauauucaaaauuguccacuuacucuauguagagugacacgucucuuuuccaaggcauuguuauuuguauuagaaaaaauggugagagacuuuacaaugggcaaaaaacuaguggguguccuguuagcucaggcaucugaauuaucucugccuuuaauuacuuuugagcuacuuuacgacuagguaaguuguggaaaauagguaugcaaaugauucuuauccauaaaaaugaaaauuauuuguaaagcaguuaauuauuacuccuuggauagaccaguuuuugcaucuauugcaaaucuauuucaguuuucauuuuucuuguguaaaacauguguuuuuaaaaauuuuccccugaacugguuguaacagcuuacugggucccucauuaauuaaugaguuaaauaaaucuuugacagacauuauuaucacauugguuugagaguuaugacuuuaccuuguuggaaaauuauccuugaauacauggaccacugugauaaucugcuaauugguucuuccauuccaugcuccaccuucuccaucucccuuuccuuuuuuuuucuuuucuuuuuuuuuuuuuuuuuuuuugagacacagucuagcucuguugcccagucuggagugcaguggugcaaucuuggcucauugcagccugcagccucugccucccagguugcagcgauucuccugccucagccucccuaguagcugggauuaugggcgcaugucaccaugcccagcuaauuuuuguauuuuuaguagagaugggguuucaccauguuggcuaggcugguuucaaacuccugaccucaagugauccgccugccucgaccucccaaagugcugggauuacaggcgugagccaccacgcccggccuccccuuccauuuucaagagaguaucuacggugcuucuaaaggguaaaccugaauaccuuuuucucuucuguaagcucuuucguugggugcccauuuuccuuuuuuuaaaaaacacaauuaaaaauugaaauuguauaauuuuugguauauagugugauguuuuggucuuacuugguucuuaaagcucuaaauagcugccucccaauuuacuccuaauuuuauuuuacuuuccucucgcucccucauuuugcuccagccacacggccuuugcuuaccaucccggugggcccucccuggccuuugcacacaguccuuucucuaucucuuccuggccagcuccuaccccuuccugcuugucugagcuuaaauguugcuuccugaaggaucucuuuucugagcucccagacuaggguagauaagcuguauacucucaaaguguuaugauuugaagcacuuaccauacuguaauuuaaauaguugccagccuuuuuuccuagguuagacauaaacucugugggugcagggacuuucuauuugcuuauuggcauaucuuuuggcauuuaguagguauccaguaaacuauuuguaggcuuaauaaauaaaugaaugacaaugacauagacauacauugaauaugccuaauucuauauguucauaagccacuuggggaugguugcauuggagagacaggaguagaguuuaggacugagugcaacauggcaugaauugugcuaaguccuggauaugaauacaaugcaucaggacuuuugcugcauuauugacaaaaauaaacaaauccagcuauccaaacuuucccuauuuaccugauuucuuggaguugugcugcagugauuguuaaauaaccacuuggacuuaaugcauauuauuguuuuauuuacccaauacaauucuucacauagggucuaacuauuaaauucacugugaagaaaaauaagacuuaaaacuuaaagccagaacaauucuuuucuugauaagggauuugguaaagaacuugagaauaauaucagucuaaaaccaucuuuuaauuuguaacuguaaaugaauauacaguaaccaagacagugcucacucaaaauauguauucuuuuugcugcaaauccuugugaacauaucauggaguauacagugcuuuggaauucaggauccugagaagucauaguguagaguaaauuauggcucuuggauuuuuaaaaguuaugaagagcucagaaaaagugauuaucuaaaaaaagcuaaaaauuaggaaauuaaacacuuauuucuggauauccugcucauuuauuuaugaccucaggcaaauuauuagucaauuuuuucagaucaccuggucuacauuuccauagccauaagacgcaaucgaucauuauuaccuuccuuauaucgugaagaaauauugaggcauugcugagaaguguauaggagaugauaauuacuuaggaaugcaaaauaaaaacccuaucauauaccucgaaucugugauaguccugaucuguggauccgugccacacguaaacagaaaagggaaaaagcacuggcucauuaagcccgcguucuuccauuguaugguguguaugacuugaguguuuugccccuucuaaauuucagagccucuggcuuguuagccggccggucucccaagggaggcagcaaaggccucauugcuuugcuuugggaaauuugcucugacuuugagccugcauuuucuuuggcugacuuucagagcugcucaucuggcagagcugaaaacauacaaauugcagaaguucuuuuauccauuuggugagaugguucucuaaagaggcuucacaaauaaagguuagguagaaaauaugcaaaauuaaaaaugcugaacuugaguuugugcaaaucccugcuuuucucuuuucuaagacacagaugagccaaguuuucauguaaguuacaauuccaaccuugaaauucaaauugacagaacguaagagaggaaagccaugaagcauuuuuuauggauuccaauauggagagcuauuaagauguuuuccuuuaggagacagugagacauugcuuuuagauuguuuuccuacuuuuuucauguuggaaguuaauaaucacuaaaauaagggugggaaaagauguggagggagauuuguacaggaggugcaauaaaaggagcccaaacccuuuuccaccucuagauauucagucuucucuuuaguacuguaaagaggcugacaggcuuccugugugaagauaaaucccaucuauaguagaggcuugagcuugaagaguuacacauugggucugccauugguuuauuucaugaguaugcauauggcaacucaacugauuguuuuaggagccauacacauucaagugguuccuuaaaaagaaaugugaauuugugucuauucacuaauaccucuaaaaagaaaacaauaaaauguacuccauauucuuaaacaccagcuuccagauacuuuggcuauacuuaugcaagcuuuguuguuguugcuguuuguuuuguuuucauucaauuugaauuuuuaaaauuugauuuuugucucaaaauuguuuguaaaaugaacuucaccuugguuaaaacuaaaaacaaaugauuaaaauuaaaacugucaaguauuauuuaauaugcuaugcuuugaugaguacuuaauacaggguuuugauucagccuauugguauucauaauugugaagcaaauuugguagucuuuguaauugacgaucaguuuagaaauugaucaacugggaggaaaugacuuuucacccuucacuuaggaaggagugagcaggaccaccuuccuugugcuuucccauucagccucuuguggccccaccaucucuagcuucagagaugggcucugguggugcagggaagggugggcuuaugccagggugggaaguaagguaucaagaggggauugcugagagguagugguugaggggagagaaucucuaccuauuacacagagcaaggagacacuggacccauuuccagcuguaucuggccugggaagcuuuuagcugcaauugccacagguaaccauccaccagccaugaggggagucacacuuagggggaagcugacauuuauuuuuguuauuauuuguuggagaaauaaaaaacccugccaacacugguaccucugguuaccaacauagaauacagagaaaacacaauuuacaauuaagugugcauguaugguuaagugcaugcaggcaguuggcuaaagacgucaaagucuggacagaauuucacacaaauauucaguaaagugggagaaagaacaaugaacacuugucucugugagagacaacuagaugugccuuguugugauagucucuuguccaccuucucaacaacuccuguguuuaacuuagcuugaaaaacuggagacuggauuuaucuauuuccugaccaaaaaaauugggucuauuuuguuuuaaggagacacccuaagggaagggaaggagcaguguaccugccucuccuuuauauauauugaacaaaggaacuuugauuuuauuuaccuuuacacuaucauaaucagugcuauuaccagugccucacccuagucucauggaagccuaucuuuugaaggacugccuucuucaaacauuucuacuguauugccaguuguguauacauggaauaagcuauauuguuuccugaguuugccuacagaccuugccugguaugcauaaagagucagagcuuuuuauuuauuuauuuauguuguuuuauuuccauagguuuuggggggaacaggugguguuugguuacaugaguaaguucuuuaacggugauuuggugagguuuugaugcacccaucacccgagcaguauacacuguacccgauuuguaaaauuuuaucccucacccccacucccaccugcaccccccgcccagguccccaaaguccauuguaucauucuuauaccuuuggauccucacagcuuagcucccacuuaugagucagaacauaugauguuugguugcccauuccugaguuacuucacuuagaauaauggucuccaguuucauccagguugcugcagauaccauuauuucauuccuuuuugauggcugaauaguauuccaugguguguauauguguguguguguguguguguguguauauacacaccacaauuucuuuauucacucauugaucgaugggcauuugggcugguuccauauuuuuguaauugcaaauugugcugcuauaaacaugcaugugcaagcaucuuuuugguauaauggcuccuuuuccaaaugccuaccucugaugggcauuugggcugguuccauguuuuugcaauugugaauugugcugcuauaaacaugagugugcaagcaucuuuuuuguauaaugacuucuuuuccucuggguugauacccaguaaugggauugcuggaucaaaugguaguucuacuuuuaguucuuuaaggaaucuccacacuguauuccauagugguuguacuaguuuacauuuccagcagcguucccuuuucacugcauccucgccaacaucuauugguuuuugauuuuuugauuacagccauucaugcaggagugaagugguauggcauugugguuuugauuugcauuucccugaucauuaguuauguugagcauuuuuucauauucuuguugcccauuuguauaucugcuuuugagaauuguccauucauguccuuagcccauuuucuuuuuuacuugcuaauuuggagucagagcuuauucagccuccagcccucaccugauuguccguggaguaugcuaguggccccugccucuggccgccagguaucugagccccacagugguuucuuaucaucccagauuuuaucaucacuauaccgguaacuuaccaaaaucgagguaaacauucuguuacaugucuguaugacuugugauucccugaaagauauuacuugguuuggcauguguuuuacaguauuuuauaguucugaagguaggugcacauuuacugauucggaguguucucugcacauuuacaguaaacacuguaaaucauugcucuguaguuaaugaggcauacucugugaugaccagcaccaucuguuucucuugucuuucucucuuccucuucuucucucccucccuccuuccaagcaagcuucuaaauggaaucuuuuucaauucuuagcaacuuaugcugaccacccagaauucuuaaagaggacggcugagagaucugcagucacuaauuguuuaagugacuggagcacauuuugcugguuuucuguugucgagguguggaaggaacucauuaggcauuauugcagugcccucauuuuacuuucagucuucucuguggaaagcaaugcuguguuuguucuuuuaccacagaguugaaucauaaaaguaaauacuacauaucauacagucuucauuucguugauucaacuacacauuuuauaauugagaugaaccuaauuuuaucauuuugcuuaaucuugacuagagacagcauucuuuuuaaaacaucuauuauuuguuuuaugcaguaauacauaaacuuuguaaaaauuagauaaaucaauaaauccaaagaaaauuguucaaacuacuuuuaauuccacuaccaagagaaaaaguguagcauuuuguuguauaaugguuuaaaaauguauuaucauauaaauauauuaucauuaacuaagaugauguacauagugcuuacugaugcauuauugauuauuaagaaauugaaaaauuacaagaauguaaaagaugcuacauuugugucaguguugaaauugggguucaugaguuaaagauucuaauuugaaaagguuuagaaauguugcauuaaauuauuucuuuuugaauuuuuaaauuaaccaacuucuugcaaaaaacagaugaggagggagagagagagaccauaaaauuuacaauguuaucagaugcuugggcaucauuuugaacuaucaggggcaucagauuaaucucaaauuaaucugaggagagugugaauauauuaugguauauacacuauauauguuuguguguguguguguguauauauauauauauacacacaccauacacacacacacacacacacacacacacaguaaacaaugggacugguaauugaauuaacuagagugucucaaauccuguuuugaaaauaggguguaaauaaauaauagaauaaucagugucgaagggcucaaauuuguuauucguuuguaagaugacacucaucagacauguuacuuuugaaagcauuuaaaaucuguuaucuuccaacuguuuuuauuauaugcaguuauaacuugauugcugauaauggguuuagguaagucauaggacagauucugucucccugcuguaucuguuucuuuguacaauuuuggcagcaccaagcuagauuugcaaauucaccuuaacguguuugccauauuauguuaguacuguuuuuuguuuaaaucuacagucaugugucacauaaggauguuuuacucauugauggaccacauauaugaucguggucccagaagaugauaaugaagcugaaaaauucccauagcuuagugaugcuguaacuguuauaagggcauagcacaaugccauuuacucgaguguauuagucuguucuuaugcugcuacuaaagacauacuccagacuggguaauuuauaaaggaaagagguuuaauugacccacaguuccacauggcugggaggccauggugagaagcaaaggaggagcaaagucacgucuugcauggcgucaggcaagagagagagcaugugcagggaacuaaccauaagaucucaugagacuuguucacuaucaugagaacagcacaggaaagacccacccccaugauucacuuaucucccacugggcaccucccaugacacgugggaauuauaggagcuacaauucgagaguuggguggggacacagccaaacugugucaucagguauuuguggugaugcuguuguaaacaaaccuacugugcuuucaguuguagaaaugucuagcacauacacuuauguacaguacauaauacuugguagugauaaccaacaacuguguuacuggcuuauguauuuauuauaaauuuaucauuauuuaauuaauuuauuuauuuugauauggagucuugcucuguugcccaggcugaagugcagagauacaauuauggcucacugcaaccucuaccuccccuguucaagcgauucuucugccucagcuuccugaguagcugggauuacaggcaugugccaccacgacuggcuaauuuuuguauuuuuaguagagacgggauuucaccauauuggcaggcuggucucgaacuccugaucucaugaucugcccgccuuggccucccaaagugcugggauugcaggugugagccacugugucugguccauuauuuuagaggguacuccuacucauuaaaaaaaaaaaaaguuaacuacaaaacagccucaggcaguuccuucaggaggugucccagaagaaggcaucgguaucauaggagaugacagcuccauguauguuauugccccugaagaccuuccagugggacaagaucuggagguggaagacagugauauuauugauccucacccuguguaggccuaggcuaauguguauguuugugucuuaguuuuugacaaaaaaguuugaaaacuaaaaaaauacaguuuuaaaaauugaaaaagccuuguagaauaaggacaaaaugaaacagaauauucuugcacagaugugugauguguuuguguuuuaagcuguuauuauaaaagucaaaaaauuaaagaaauugaaaaauuuauaaaguaaucuaagguuuauuauugaagaaagaaaaauauuuuaaaaauaaauuuaguguagccuaaguguacaguguuuauaaggucaacaguaguauacaguaauguccuaggccuucacauucauuuaccacucacccagagcaauuucuaguccuguacgcaccauucauguuaaguguccuauacagguguacuauaucuuuuuuuuuuuuuucguuugagacagcguaucucucuguugcccaggcuggagugcaguggcgcagucuugguucacugcaaccuccgccucccagguucaagcgauucuccugccucagccuccugcguagcugggauuacaagugugcaccaccacaaccagcuaauuuuuauguuuuaggagagauggguuucaccacguuagccaggauggucuccaacucccaaccucaggugauccacccgccuuggccucccaaagugcugggauuacaggcaugagccacuguauccagccuaaaaucuuuuauaucauauuuugacuguaccuuuucuguguuuagauacauaaauacuuaccauguguuacaguugccugcauuauucaguacaguagcaugcucuauagguuuguagccuaggagugauaugcuauaccaucuagccuagguauauuguaggcuauuccaucucgguuuguguaaauauacucuaugauguuugcacaaugaugaaaucaccuaaggaugcauuucucugaauguaucccuguccuuaagugacucaugacuguauuuggaaucugagugccgugaagucaagagcugcuuucaccagccuugauuuucgcauacuguaugacagaaaguaggcacugaucuaucucucuacuggaaaauccaaggcccaauucugcaucugauuuguuauugauacaaagaauuagaauuucacucuuuuaagaaauccaaacugcacuuucuaaaucuuacuuucuuauucaauuuuuuguagauuuuuuucuauuacuacuacuauugcugaaaaacaugaucugugguagaaauauuaauaauugugcuuugagaguauugaaguaggguaagaauaauacaguaucagaucagagagagggugggaccagaucucacaagauuuuuauuuggaguuuggauuggauuugccuguaauggaugcccauuaggguaaaucagggaaauugacacaauguggucugcacauuaaaauuggaauuauucuggcucuuacguagaagcaaagagaucaguuggcuggagcuggaguucaggcaauagauaauggcgguuugggcuagaguugacacaaugaccaugguaagaaguggucauguuugggauguguuuuuggaaguggaaggacagggcugguggguagguuagagguggagaagaagugaaaggaaaugaaucaggaaugacuccuuuguuuuuggccugagcaagagucauuauuucuugauaugugauguauuugcaauuaaucauauucuguaguccguggauguguguguguguaugugugugugugugugugugggugugugcauauuuguguguggccuuucuccagaguugaccaguuccuuaaggcauuccucuuugauuaauccuauauuucaccuauauguggucaugcucuaugcagaaauugcucaucggucacccuaugaccuggugugccuguagacaagaucuauuuguuuagcacaguguuuuaggaaauuacaguuaccaggagguuauacauauaaauucagauuuccaccuucuuuuuaaaaaugagaaguucugcccacagugaaccugaauucccauauggccacccuuagcuagaacugagcaggagcugccacuugagccugcagagccagcugauucuccagaugugccuggggcucaucagguuugcuucccucacaugugucaucacugcaguuguuugcagcccuugcuccccgcuagaccccccuggcuucuccccuugcauugugcugaccguucgccuuugugcucuaacauuuuaaaauccagcagcaguagugucccagccgcaagcaugagugcuggucucacuugucaaaauggugaugguagagggagaugagacuuggggacagccaaagcuggccacgccagggcuguaguaucugucaucuagaguugugucaugugguuguuuacuuuuuuuaaaguuaaaugugacccaaggcuuauauacccuucaaguucaagacuguucauuuauaccauuuuguauuuauuggaaaacuauggaaacucucuugagaauaaggagaaugaccugaacuuggcauuucugcagggccaagcacaaaggagguauucacuaaauauuuguccaaaugcauuauucaacuguauucucuuugucagagaagucucugcaaaugagucuuugcaaagauuucaaaauugaaauaagagguuaacugucaggaugaaucaguuuuuauuuuuauucauagaugacuucugacauuuccaagcuguuucacagaguggaucccaaguuuacagcuugugauaccaaagcaccagacacgcuuuaaagugguguacuagaaaaaaaaauagucugcauuuugaauucaucaaaauguaguauauaucuuguugcucucuuuggggggccacuaaauauaucccacccacuccagugauuaaauauuuuuuucccuacauaucccaguccagugaugaaauauuuucuucccuaucuguccuaguccugugucuucauaauuuuaguagcaguauagcacagauguugaaaacauagauuuagagccagauuuugugguaucagauccugguucugccucucauuuguuaagucaccuccacaucaguuucuucgccuguagaaugaagaagaugaugcuguuuuucucgaaauacuauuauaaggaaauaaauaauacaucuaaauaauacaacuaaaucuuuauaagucucuuagaacauaugauacauaguaaaugcuugcuaucauuaugucuaagaacauuucauauuucuacugccuguuuccguauggccuaugagcugagaaugguuuuuacagcuuuaggugguugcaaaaaaaucaaaagaagaguaauauuuugugacaugugggaauuaugugaaauucaaauuuuagugucuauaaauaaaguuucauuggaagauagucauuccaauugguuuauuuguuuauguauucucuauggcugcuuucacuuuacaacaaaagguaguuaauuguuuuugaaugagauauguuccugcaggucaucauaugacauauuaaugaaaccugagacuugugagaucuuucucugugaauugacacuaccauguucucauguucagggccugcuuuugccuuccugcuugagaugaagaagugcuuaguuguugucucaguccuuucagauauuguugauauuuuauuacacuuuucugccaauagaaaacacuaaaguuaugcuugugauauagucacaucaaccauuuaaugaacaucugucaucuuaguuuaacagguaaacaaauagaugcagaaaggccaaguaacuugcccaaaauucuauggccaauaagaggcuucuuguuuacagaugaggucauuaauggacauccauaauuauuuauaauaugaauaaauauuuauauuucuuuuuuuuuuuuugagauggagucucgcucugucacccaggcuggagugcaguggcgugaucuuggcucacugcaagcucugccucccagguucaugccauucuccugccucagccucccgaguagcugggacuacaggcgcccgccaccacgcccggcuaauuuuuuuuuuuuuuuuguauuuuuaguagagacgggauuucacuguguuagccaggauggucucgaucuccugaccucgugguccgcccgccucggccuccuaaagugcugggauuacaggcgugagccaucgugccaggccuguauuucuuuuauauaaugcuguuuuuguuguuguuguuuguuuguuuguuuguuuuuuugagacagagucuugcuguguugccuagguuguagugcaguggcaugcagucuccaucuccucuggguucaagcaauuuuccugccucagucucccaaguagcugggauuacaggugugcaccaccacacccagccaauuuuuguauuuuuaguagagaugggguuuugccacauuggccaggcuggucucgaauuccugcucaagugauccucucgccucggccucccaaagugcugagauuacagacaugagccaccgugcccagccaguuguuuuauauuauacuauuuuuuggaaaguggagaguggauuugagaaggguuucaggcugcccagguguuauauuagcugcccuugccaucaucaguauuuucuaagauccuuucuaugccuauauaaccccauuuguuucucccaugcgcuuuaccuauauaauauauuuuugcuaugccuaagaccugaaagugaauucgguuauuuguuggcuauuuugcagaauuguacuucugguugggugggggagggggauuagacguaggcaggugacgaaggccacuucugcccauugcuuuuacugacaguggguagcaaguccucaggggacuuuccccucaaggggaaauuaccccuuacccggcuuccugaaguucugccucuggaaaguggccccugcaucuugcacaucucuguguuauuuugauugauggagaaaaucucuuugucccugaaucuaucgcugccugugaaaaaggcagcugggaacagaaaagcagcuuuguuucagauaugaauaaguaacaguguauucuuuacugauucuguggugaaaauuuacugcacuuucccucaucugaaguauaugaaugaugaaaaaggcacaugcuaaaaauuaugaguuggcuauaccuaauaccuguuuaaaaacagauagagggaggggaacaaggguugaaaaacuaccuacuggguacuguguucacuacuugggcaauggggucauucgagacccaaaccucagugucacacaacauacccauguaacaaaccugcauaugaacucccugaaucugaauguuuuaaaagauaauuaaauuaugccuuguaaaaaacuaaauaaagucuaguucaagggucagcuccugucugaagccuuugcccacucccuggcuugcaguggucuuggggucucucucuccucugugcuucuauagcacuggcacacuuuucuauuccagaccuuacacaucgcacuguaauuguuauuuucuaaaaaagaguaucacuuccacugaaugguaagcuguugagugugcagaaauauggaaucuuuauucaucuuuguaauucaggucucuucagguacacacacuugugcgcacacagacacagacacacacacacacacacacacacaauaaaaacagauaaggaaucacgagggaaggaaggaaggaauaaugccaaauuuuaggaaacuucagaauggcuccuucuucccccuccuccauuucaaacucagaguaaaguuuugcuucauaugaaugauauguauauauuuuuuaaagugagaaaugaagaagauaaaagaaguauugguuaaaaaauaucuauuauugacaggaagugggacuguucaucucuguggagauuuuauuauauaaggcaguaauucgauacaagauaauacaacauuuauuaaauauuacauuguauucuguaguucucagggcauuuucuuauaauauucuauuauuugaucuuuacagugacuuuugauuuaaaagguuagguagcugagccagguucaccagguaguuaaaggucaaacuggacuuaaagccgaggcuuccugauuuucuaugcggugaucaccccauugcauaauaauucauuguaucacagacaggcaaggaucuaccaaacuuacagugaauggagugggauuuucuggcaucagacacuagagcaggauuaucugugggaguugaugcuauuuaucaggaaaaagaguuuagaaauucuauaagcuuugucaguuaaaaucuuggacugguacuaguuuuaagcacaaaaaguauuuaauuguuaagcccaaagugccuuaaguguuaagaaauuaauaaccagaaauacagacugaacaccucagcccugaaauugaugaccaaaucacguacucccauaauggaaaggcuggaagacauugucacacugugaugugagacgcagugaugaagugacaguccuuauacuuuuaguuggccucugcacccggauguuguaggcucauuuacauuuuuaaugcgucucguuaucauugcuuucucaggaacauaugccauacucaaggccuauuauuuugucguuuauuguucuuucuuccacuuuacuguauauuugugugaaauuauguccagacuuuguaguguuuuuguuuuuugagauggagucuugccauguugcccaggcuggagugcaguggcacgaucuuggcucacugcaaccuucaccuccuggguucaagcaacucuccugccucagccucccgaguaguugggauugcaggugccuaccgccaugcccggcuaauuuuuguauuuuuacuagagaugagguuucaccauauuggccaggcuggucucaaacuucugagcuugccucggccucccaagugcuggaauuacaggcaugaaccacgaugcccaacagcuugauuugcuuucuuuguaaggaaaaaugcaauuuauuucagcuuaaaauauucuuuaugggauuuaaaaauuucuguauuuguacuuguucuuucuauaaaagacaaauuugggccgggugcaguggcucacgccuguaaucccagcacuuugggaggccgaggugggcggaucaugaggucaggagaucgagaccauccuggcuaacauggugaaaccccaucucuacuaaaaauauaaaaaauuagcugggcgugguggcgggcgccuguagucccagcuacucgggaggcugaggcaggagaauggcgugaacccuggaggcggagguugcagugagcugagaucacuccacugcacuccagccugggcgacagagugagacucugucuaaaaaaaaaauuaauuaauuaaaauaaauaaauaaauaaaaacccccaaaagacaaauuuggauagucugcagaucauccacaacauuuuaauugagcaaaaaaugaagccacucauuuauuugcccagguauauauggaguuucugcuguuggcauaccccauauuuuauuuguguuuuucuuuuacagagugggaaaccacccaucaaugauauguucacagaccucaaagauggaaggaagcuauuggaucuucuagaaggccucacaggaacaucacuggugagcaagucaucuuuguaaacaacggagucuccggucauugcugauacuugaugacccaguguggguacccauuaaagugaaaguauccauuuuacuuuacguucaaauguaaaggcugaaauucggaacauuuuuaacaaagcauuuuaaugagugcuuugauacaacaacauuuuggcucuucugagggcucuguuuuuauugaagauaaaauuaccuuaaauguuuauugcucugagacagcccaggaugagagaauuacaaaaaagaauggauuuauagagaggacacaauguuuugaacaguagagucuggagacaaacacauuuaagaguuaaauauuuuuuaaaacaguuguuaaggcugggcgcgguagcucacgccuguaauccuagcacuuugggaagccaaggugggcggauugccugagcucagcaguucgagaccagccugagcaacauggugaaaccccaucucuacuaaaauacaaaaaauuagcuggguguggcggcaugugccuguaaucccagguacucaggaggcugaggccaggagaauugcuugaacacaggagguggagguugcagugagccgagauugcgccacugcacuccagccugggcaacagagugagacuccgucucaaaaaaaaaaaaaaguuguuaaaaacuaugacaucuauuuuuuauucagauuuucaggauuauauuuuguugauuuauuuuuuaaauacaacucuauuauuuuaugugugggguacuccaaacucaugcagauaaaacugccaauaaagaggaugcauguauggguacaaauguuaacucuagagguagaauuacuaucacaguacagagagaugcacuccugaagaugaauuucuuucuugcagaagugugggaugucauucucucucuuugcccuccagguaguggguagacaacuguuagacaggcugauuccucucucagauaagguucuggccagugaaguagaaagaagcugcauagguuaucuuuccccagaugggaauucccugccuuccgagggcucuugcaaugcuaccuggagccugggauggugccucugaauccuccuugcucuguucacaucugugcagaauaaagaggacacaauuucucuaaaauccuucugcagccagaccaauuaagagaaaggaagcuuuguucauagagcacugguuuccaaacuugucugcacauuagaacuacaggcaaucuuuuaaaaaucccaaguccagaccacacccuagacccauuaagccacacucuuugggggugggguuggacagagguauugguguuuuuaugaagcugccuaggagauuucaacgugcaugcaaguuagggaacugguaucuuaagauguuguuaguugagggauuuucauacugugaacaccagcuuccagggugguaaccugagaccucagccagaucuccugccucugaggggcccuguacgcugagcuucacuucuguguguaucucagugcuaguguuagucaggcauauggagggacaaucaguuuuacuugcuuuuuuguuuuauuuuccagccaaaggaacgugguuccacaaggguacaugccuuaaauaacgucaacagagugcugcagguuuuacaucagaacaauguaaguguguaaugugaguucugggggucugugcugccaucagcauuauuuauugugaaacucaccaacugcuugaugcauuggcauccacugauucuugcaaacauuuuuucuuaugagaaauacugaacuuuuucugugagugaagaaacagucaugugcuuuuucugauggcuguauugaucuguaguauaaauaauacauuuuugagauuuaagcuuaccugauucucuaaaaugaaauuucucuuaucucucacuuauacugcuguccaaaugugcuaaaauaaaaaccuggaguucugugaagaaauugucuuaaaagcguuuuuguuuuuguuuuuuguuuugucuuaauagguggaauuagugaauauagggggaacugacauuguggauggaaaucacaaacugacuuugggguuacuuuggagcaucauuuugcacuggcagguggggaaauuuccaaucacuuuuuaauagagauggaaaauguguuguuugucuuuuaguuucuuaaggcugccguaaccaaguaccacaagcugcuuggcuugaacaacagaaauuuguugucucccaguucuggaggccagaaguccaagaucaaggcaucagcaggguugguuuuuccugagggcucugagggagacucugauccaggccuugcccccaaauucuggugguuugucugcaauuuuugcaguuccuuggccugugauaacauagcuccaguguugacgugguguucucccugugugcauaucugucaaauuuccucuuuuuguaaggacaucagucauauuggauuuagggcccacauuacuccuguaugaccucauucuaacuagugacaucugcaaugaccuuauuuccaaauagagccccucucugaaguacugaggguuaggacuucaacauauuaauuuuagagaacauaauucaacucauaacaauuuucaauggaagaggcugacaaaaugcccuauuuuccuggcauagggaaaaaaguaccuaccuuucuuauguuaaauuuuaaaaagggacauaauuucacaucuagaaaaguugcaggaauaguucaaagaauucccaaguaccuuucacucacauuuccuaaauguuaccaguugucuauauuucauuuguacucucucucagucugccuaaaauauuuaguguguauuuucuaacgccauggcauucuccuaaaaacaagaacucucuuauguaaacacaauagcauauugguauaauaauaugagauguaaaauauugauauuuaaaaugccaauuauugauuauuaaauaugaaaacuuaguauauaauuauuaaaaucaagaaaauaacauugaaauaauacaauuauguaaucuacagaucuuaagauuuugucaguugucccaauaauauccuuaguagcaaaagaaaaucugagaucaugcauuacauuuauuuuucaugucucuuuaguccucuuuaaucuggaaguuuuugagucuuuguauuucaugauauugauauuuuugaagagugcuggcuaguuauuuuguagaaugucucucucagugggcuugggcuuggcugagcuuuccuuaugauuaaguucagguuguucacuuuuggcagggacgucacaaaagugacgugaguucuucuuagugcaucauaucggggauaggugauaucuguucuuuuucuggcaguguuaacuuugauuguuuggcuaaggugguauuuaccaaguuucuucccuguaaauugacuacccuuuguuauuaaaaguaucggguggggauauacuuugagacuguauaaauauuuaguuuuuaucaaacuuuuagcacccguucauaauuuuugccuggaccagcuauuauuaugaugcuugauagauaaugauuuucuaauuucauuaauccuucuacauuaguugguguucuacuuguaaagaagagcuuccccuuguuucuuguuucucuaucuuaucucucucuccauucauuuauucauuuauguaucaguauagauucauggacauuugcauagguuuaugaucuuuuacuaguacucauuucaguguucaagucauccuagauuuggccagugugagccccuuaaauuggcuccugugucccuuagauagaucuaugucauucuuugagcacuuucuuaaaacauauuuacuaauuuagaauaauacuauaaaauguuaguucuagaguauaaucgugauugcagucaggaaagauacuuuauuuuguagucacucaaaaguuuuuccuuucucauuuuuguagaaaauaaaauuuaauugaaaaggucuuuguaaacacauagaguuaaauaugacuuucuaugacugugaaaguuauguucauuguaaccaaacauaguacaaguauugcuuaagauauagaaaacacaguaauguauaaaagugagguaaaaaucaccucaaauucuagucccccaaaauaaucacuguuaaaauguauugcucuagugucuacagaaaaaucugaaguaaaaugaaugccaguuaccugauccauaaugguuaauuagugcaauauugcuuuuucaaggacuucauugaaguaaguugaaguaaauuacugaaguauuaguuauggacaggccugguuucucuuacauaggugaaagaugucaugaaggaugucaugucggaccugcagcagacgaacagugagaagauccugcucagcugggugcgucagaccaccaggcccuacagccaagucaacguccucaacuucaccaccagcuggacagauggacucgccuuuaaugcuguccuccaccgacauaagugagacauuacucuaucuagaagugggcuuuacaaauucaugucuccucucugucccuuugcugccaccacuacucccugaagccccuucuccagugccacugcucuccuuucugcacauguucuaccaaaaccuuaagaaaagaaauaucauggaagaaaacuacccaucagguuuuuauuuccuuaggacuuaaaugcugcaauacaagguccauaguuucuccugcauauuuaugaauuuaaaaaauaugaaauaauucacaaaguucaaccccacucauucagcacuaacugauaauguauacaaaaaauuguguuagcuuuucuucucaaacugaaaguaaaacucuguaaauucaaugcauucccaauuaaaaauagccaaauugucuuuaaugaaacuugugaacagauucuaauuauauaaaagacgaggcccaagaauagccaguagacuucugaggaagaaucaggcugaaauacuuuccaaaaagaaaccaaaacuaugaagcuauauuaauuaagacuaugcaguacuaucaauauacacaccaauauaagcugaaccauaugaaauugccgacaugugaguguuuuugcuauauaagaaugguguuuucauaugguucaaccuaauaaaauuaagaacucagaaauugcuccauuacacaggaaaaucugauauacgcuugagcugacauugcagauuaauagaugauuuggacaauugauuacccauauauaaauaaauguauuggaucuuuacuucaccacacuaaaaaaaaaauaauaauuucuacauggaucagggauuuaaaugccaaaggcaaaauuuguuauauuuuauuguuguaaaugauuacuuuucucaaauuucacuuccucuauguuuuuuugcugguauauaaaagugcaauagacuuuucuacgucuuauaucuggaaacuuaaucaguucuuacaaauuuuaguaaguuugucucuagauuguagguuucuuggaggaggagggauuagaauguccuagaauuaugauccuuuuauuucuucuguuuucuuuuuuguucucuauugugccuuguccuucaaugcaauguugauuugaauuggugauagugggcagaauuuuuguuguugauaauaaaaggagugcuuuuaguguuuuaccauaagaaugauaguuuuuguagcuuuuuugguacacuuuuuaugagguuaaaggagguugcccuagguuuuuaguugguuaagggauuuuaucaagaaacuguagaauuuuagccaauauaccauuccauuuauuaauuaauugauucaacaaauacguguggggugccuuuuaugugcuagacacaggguauacagcagagaacaaaacaggcaaaaaucuuaguucucguggagcuuauguuccaacagagggagacaagacaauaauaaaguuguguaguauauagaaauguacacacacugaaggaaaauacaucagacaagagcagaggaggcacuuggcaucggagagggcaguggcugcagugaccugaguggggggaguaaugggagaugaauucagggagggaagugggggaagugcaucccagaaggugggugggucuaacaugcaagaacagacacagaauaaagaaaaugauuaacuuuuggauaagucaaagcaacaauaauguccaauuugugagauuaaaagaaaaucaagauagaaaugaaauacaguccuagacaauauaguaguagcauggaagcaggggauuggagggaaacucuuccaaggcuuuuguuuuaggaauauccugagaacagauuagagcuagauuuuguguucugcuaaucuugaucuuuuaauugaagaauuuaguccauuaacauugauuaugauuauuuauauauuuagguucauuuuuaccgcauagugugagcugcucauuuuucuuauuuuuucugugguuuuuuuuuuuuuuacuuucuuaucucuuuuuguaucgguagguuucccuuuacccccuuuucuucuucuacucuuugggaaacauuauauacuacuucuagucuuaaugguuaccacagaaaauagcaguccuauuuagcuaauacaagacccuuggaaaguauuaucuguuauuuucauauuugugaauuaauuucaaguauguauuugacaagccuuugggauauaaaaauaaacucaaaaaaaccucacaaauaaaaauaaucuaaaacuaaaauguauuagauuauaacaaugccuacuuuguuuccacauauuucaucuucauugcauuuuauuugcaugguuuucagaccugaucucuucagcugggauaaaguugucaaaaugucaccaauugagagacuugaacaugccuucagcaaggcucaaacuuauuugggaauugaaaagcuguuagauccugaagguauuguccaguauuuaauuuccaccuugauuuugcuuuacaguuuugcauucuugaaaagcaguguuucuuuguccuuuuaaaaaugaauuaugagacuugaagaaccuuuuccuuuuuggaguauaggugcgagucauuuuauuacugacacuuauuaauacuuuuguacuuagcaguuugugggaucuuuuagguagaaauuuaacuacagcacuggacaauaguuaaucuaaauuaaguaagaguuaaaguuuuaagaaaauguaauuauuagauaaauucaguaucugguuaguccaauaaaaugcauuuuuaugugagcaucuugcaugugauguaaagacuuuaguuauaaauguugcaggauugaauucuagacuuauuuucauaguaugaauaaagucuguaucuuuaucuuaaaugguaacauaugguagcuuaucuuugaccauuuuggggaggcuuuuagggaagacuuuaaaaaaugagauacugaacaaaaauaaguaaucccuuuugccuuugucucauauauuaugaaguggcaauuuacugguauugcaaagauuauauauuagguauuguuuauggguacuaaggagaguuauuuuauaucuaauauugagcaauucacauauuuuggacaccuaauuuaagcugguucuuauauucuuccacuuuuagauguugccguucagcuuccugacaagaaauccauaauuauguauuuaacaucuuuguuugaggugcuaccucagcaagucaccauagacgccauccgugagguagagacacucccaaggaaauauaaaaaagaaugugaagaagaggcaauuaauauacagguacagguaacauuuuauuaagauguuuggcuugccguauuuguuuucuccuagguacuagauaaaaacacuuuuagaggguuuuuuucuugacugagaacaucuugguuucucagcuuacauuugcauaagaaguucagcuuagcaguuagcauucugucacauguguguaauagaacaccauaacucaauggacuuuauuaagaaggaaaauacuuuauuucacccagcaaaacugggcuguugcucaugcugcugcaugacaugcugggaaucuauguuuucacaucaucugguugccagcuuuuauuucugucaugugcuaaagaugguuuuucucauaucagccuaguuuuuuuucuaaguacuaauugucuuucuuuuuuugccauugagaaaagauuuuuuuuccauuauauaucucacaagggcuaucaaaauguaagccuuauuuucccuuuccuuuaggaggaguaauguaugguaaacuacuuggugagcuuuucaugaagggauuacgaugauuucauucaucaggauauaaaugaauuuuuaaagagagaaauaaaaucauaauuuauuuucuuccuuaguucuacuguuugaaucaauccauauuuaaucucauucuguuuuagucuagccaguccuuguaauucauaagaugagagaaucuuaagaauuggaccuuagaagucacuugguucaacauucuagugaccaagcaaccaagacauacauguagauuucaaaauuauaagaacuacauuucagagagaaagaaagcuucucuggauggaccuuaaauucauccuguugcuacuuguuuuggguuguuacuuaaacucucaaucacaguuuugucugcaaaaugugguuaaaaccaccaacuucauaaagauaaugaauucaaaguaucuaaaaugacauuaauaaacacucaacaagcaacagcuaucauuauuaucauuuuucuucuugauuuguuuuggcauucucauuuaacagauuucuuuaaaaaauauuauuuaauucccauauuaugauacuagucuugaauugacauagcaucuuuuuuuuccauccucugagauucagagaauuuacuuauucuuuuaaauuuucuuuggguaauauguacccauccuuuuauuucccccguuucaaaaauagugugauuuauagaaaaagaaaaaaauuuacugaaaagaaaggauugagaaaugaggccugauugugaacccagggcucucuuuuguagugaauaucaaaugaugcugaggaaaauuccuaacuuacuauaauugaaaaaaaugcuaggaaguauuugccucuaaaaguauaguuauuauucuacauuaaugaugcaccuuuuuaguuggcucagaugaucuucugaguuuguuacaggguuuuagauucauuuccuuauugcauuuuguuagaaggaggagauauuuuauuuaguucuuauaguuaagggccuucucucuuaaaaaggaaggagacuucauuuacuuuucaugauguguagauaaaauaaucacuucuguuuagggcucagcguggcaugauaagaacuucagaaaacauuugcuauuugauuaagugcaaguguauuaacaccucuucauuugcaagcuuucauuagugucuuagaggcugaauuacguuaauugaaaacuaaaaugugaucaaguuuuaaucaucucucugacauagcuugccaucugcuacucuccuaauagucagacuucuucugcccuguucuuucuacaaacauacgcugguggucaaugaauaauuccugcauuucucuuuaaauauccgucaguugaaaguuuccucauguguucgaauuaauaccgucugaacauuuguguuuagauagugccuuccuucucgaccucauggaugcuggugccuaucucagugaccuuuggcuggucacuaacuuuccugguucuuagaaauucucauuauaguauagagguuuggagcuaaaugaucuccagggguuauuuuagcucuacaguuuuaggauuuuuuguccauaacuuaacucauuuuucuuucucugucuuuggcaccaucugucuuuuaauuauccacuguuucgacucugugcugauugguucauuucuuaacucauauauucaguuuccuggauucuucaagccuuccuccaaaaugucuuuuguguguguuuucauuuuauugcagccuucauacucauuuuuauuuuauuuuuuuaguauuauacuuuaaguuuuaggguacaugugcacaacaugaagguuuguuacauauguauacaugugccacggguggugugcugcacccauuaacucguccuuuagcauuagguauaucuccuaaugcuauuuaaagacuucauuuucuccuauaguuuacaagcuguggccuaccucugcuacucugcccugcaguuagaguggacuuuucccccaagacucuuguucaugcagguuccccucuguuaaaugcuucugcacccaccauuauauggcagccugcacauuuuuccucaguuuaaauggagccuuuucagagaagucuuuucugauuaaucuaucaaaauacaacucucugucucucucucucuuucugucacucuaucuugguuucuuacuaucacaguauuuuuguaaacuguguuaagaauuuuaaauuguaucuuaagagcauugggaaagccagugaaagguuuucagcagguacgucuuaugauggcauuacauuuuugaaagaucauucuggcugcugugugagaaauggacuguggauugugaaggugagaguguugggugggggaaaacaggaaaguaaagacacuuguuagcagguauuccaguucagaagauggaugugugugguuguggaaauggaaaggucuggauggauuugagauaagucuuuuuuuuuuuuaauauauauuuuuuauugaucauucuuggguguuucucgcagagggggauuuggcagggucacaggacaauaguggagggaaggucagcagauaaacaagugaacaaaggucucugguuuuccuaggcagaggacccugcggccuuccgcaguguuugugucccuggguccuugagauuagggaguggugaugacucuuaacgagcaugcugccuucuagcaucuguuuaacaaagcacaucuugcaccgcccuuaauccauuuaacccugaguggacacagcacauguuucagagagcacaggguugggggcaaggucacagaucaacaggaucccaaggcagaagaauuuuucuuaguacagaacaaaaugaaaagucucccaugucuccuucuuucuacacagacacggcaaccauccgauuucucaaucuuuuccccaccuuuccccccuuucuauuccacaaaaccgccauugucaucauggcccguucucaaugagcuguuggguacaccucccagacggggugguggccgggcagaggggcuccucacuucccaguaggggcggccaggcagaggcgccccucaccucccggacggggcggcuggccggguggggggcugaaccccccaccucccucccggacggggcggcuggccuggcgggggcugacccccaccucccucccggacgggguggcugccgggcggagacgcuccucacuucccagacgggguggcugccgggcggaggggcuccucacuucucagacggggcgguugccaggcagagggucuccucacuucccagacgggguggcugccgggcagaggggcuccucacuucucagauggggcggcugccgggcggaggggcuccucccuucucagauggggcgguugccaggcagagggucuccucacuucucagacggggcggccgggcagagacgcuccucaccucccagacggggucgcggccgggcagaggcacuccucacaucccagaugggguggcggggcagaggcgcuccccacaucucagaagaugggcagucgggcagagaugcuccucacuuccuagaugggauggcggccgggaagaggugcuccucacuuccuagaugggauggcggccgggcagagacgcuccucacuuuccagacugggcagccaggcagaggggcuccucacaucccagacgaugggcggccaggcagagacgcuccucacuucccagacgggguggcagccgggcagaggcugcagucucggcacuuugggaggccaaggcaggcggcugggauguggagguuguagcgagccgagaucacgccacugcacuccagccugggcaccauugagcgcugagugaacuagacuccgucugcaaucccggcaccucgggaggccgaggcuggcggaucacucgcggucaggagcuggagaccagcccggccaacacagcgaaaccccgucuccaccaaaaaaauacgaaaaccagucaggcgugguggcgcgcaccugcaauugcaggcacucggcaggcugaggcaggagaaucaggcagggagguugcagugagccgagauggcagcaguacaguccagcuucggcucggcaucagagggagaccguggaaagaggggagggggagggggagggagagggagcgaaguuuugaaggaaggucagaauuacuuauguauuaaauguggaagaugaaggagagagaagcuggggcuggcucccagguuuguagcuggaguaccuaguugcagggaggagccaucuacugaguuggagaagucugaggaggaacaagcuuuggaagaaaguaaagguuuugaauauggacaugguuuaauaugccuaggaggcgcugaaguagagaugugaaaauagugggauaugagaguuuggaauccagacuccuaggugguucuagauguucuuuaaauccaauaggaguagaugagauuacucagacacaguauacaguggggagaaaaaagagccuagaacuuaauuuugaggagauucauuacuuaugagucagcagcugcuguugaaccagcaggaaaccagggcagugucacagaagcagggaaacaagcuucugaaagcucaaguugcucagccuugaggagugcuaccaaggucugaagcaaggaacguggguggccagcucuccgggcuuacuugggacaguucugguuuggauuuguuguuugagcacaguuaucaucaaaaauacucuaguuuguugguuaauuauauggucacccugaagaugaugcuagaaagguccguuuggcaaugggaagguuauugaugacauugguaaaagccuuuucaguugagucauggggcaaauagcaaguugaaguuaaagggaauguuaacaaaccauagcuguuaaauacuugagcauuuuuuguauuguucucuauacguuucuguacauuugaaauauuguacuuaaaaaucaugcaugagaguugauaaaguagagacagaauguaggcaagucuucaagaaaucuugcucugaaagggaacaaaagaacuagggagagucaauuugguuauaagcucuuaaaguauauauggaaauacucaguuauuuagaaagagguugauagaaauuuauuccaugagcccuaaaaggccaucagauaaaccagagggcaacugccuaagaaaaauacaaucaguacagcagccuguguggcugucuuuuagugucuaaaaugcaaugcuaaaaugcaguucagcaaaagcaauuuaccuaagggucaaggcagaauucucaccuuucuuuuucuuuaaauuacagaaaaggccuaacacguuccagcuccucuacgaaacuuuccuguuuuagccuuuguugaacucaaauaucaugccuuguugggaccauggcauuuacuuuucuaauagcuguucuucaauuucuguucagaagugauucauguggguucucugucccuaacuauauuagaaucuccuugaguacagaauucaugagugcaugcugcuuuuauacucuuugcuacccuagugcacuuacucaaugcuucuaacucauucauggcagugcccauuuggcuccugagaauuggauuagugccuaagacagagugguggguacuuuggguucgccauacagugugaguuugcugaacaccucuugcuuugaugauuaguguggguuuuucuuggcuuuguuuuuacagaguacagcgccugaggaggagcaugagaguccccgagcugaaacucccagcacugucacugagguugacauggaucuggacagcuaucagauugcguuggaggaagugcugaccugguugcuuucugcugaggacacuuuccaggagcaggaugauauuucugaugauguugaagaagucaaagaccaguuugcaacccaugaaguaaauaucuguaguuucuuagcagggugugucccccacgggaccugagccuuaaucagggacucuacucuccuauuuguuaucuacugaauucuguucuuuggaaaggucaaugguuuauuucaggaacugugauauuuaaauagugcuuugucacaaaauugguaugggugauuaaacugugccucagaauuagauuuuagauuuuagucuccuuguguguuuuggagagccacugaugaaaaucauugcauaguacugcucaguucugaagugcauuguuauauuucaaaagcaaacgagugaaccaauacaccaaaucuuuaagauuugaguguucccuaggaaaugauuauucuuuuuaauugcaugauuaagcaaaugucauacccaggguuccuguauuuuuucauaucauaaaaguuuccugcuccuuugaggacauacuauauugcagcauagugaauuucacuauauggagauuucuuuugguuaaauuuuucuuuuguauaguuaugugaauugacagaucuuauuuguuguuuuggauagaaaauaauauaagugguaauaucucuuaaacaguuccucuugggugaguaugguauuuuauuuuauauauauauuuauauauauaauaaauaaauauauauuuauauauaaauauauauaaauaaaaauaaauauauauuuuauuuuauauauaaauaaaauauauaaauaaauauauauaaauaaaauauauaaauauuuuuauauauaaucuauuuauauauuauauauguauauguauauguguguguauauauauauauuuauaauuuuuuuuuuuuuaacagagucuuacucugucacccaggcuggagugcaguggcacaaucuuggcucacugcaacuucuaccuccuggcuucaagugauucuccugcaucagccucccaaguagcugggacugcaaacaugugccaccacgcccggcuaauuuuuuguguuuuuaguuagagacgggguuucaccuuguuguccaggcuggucuugaacuccuggccuaggugauccaccugccucagccucccaaaaugcugggauuauaggugugagccaccacacccagccuuuuauuuuauuuauuuagaauuccauguucaugaucuaugaguagcauagucagcauuuacuuuaaaauagcugguauuaucagaugcaucauugcuugcuuugagcuauuucucuuuuaacuuauggcagguguuuauuccuauuuucagagauuaaaaaauguggucaaugucuauuuuauuugcgcucuacuaggcuaccuuuuucugcaucacugacauuuagguuaggcauuagcaauuuguucagucuuccuuuuuuuuuuuugcacugaguagcucacaaauuauaacaaugucccuuucuaggcuuuuaugauggaacugacugcacaccagagcagugugggcagcguccugcaggcaggcaaccaacugauaacacaaggaacucugucagacgaagaagaauuugagauucaggaacagaugacccugcugaaugcuagaugggaggcucuuaggguggagaguauggacagacagucccggugaguggaaagccaagaaaugcacuuaauuccacaggcugcuuugcacaguugagcucuaguagaugucugcaugucugugaaagcgagaugauuacagaacuugccuuggaaaaguaagacucuuuucuacggguaauauugcuggaauucugcaugaucuuuguuuccccuuugauguguuagccacaccaaaagauaaaaguuggaauacagaauuuaacaaaaaggaaaaagaggauaggcaugguggcucaugccuguaaucccagcacuugggaggccaacgcggauggaucacuugaggccaggaguuugagaccagccugggcgacauggcgaaacuccgucucuacuaaaaauacaaaaauuagcugggcauggugggccaugccuguaauccuagcuacuugggagguugagguaugaggaucgcuugaacucaggagacagagauugcagugagcugagauucagccacugcacuccagccuggguaacaaagugagacugucuccaaaaaaaggaaaagacauuucauaggggcaguuacuuauuugcaauguuaagauuagcuaaacauuaacuuggugugaagacaggacuauggaguauugaucuacuuuuccauuuugugacuuuuauuuuaaagcuuucucaugguuuauuuuauuucauguauugugucuuaaggagcaaacugcauucauugccacuuccaccuauuuaauaagcaggaauuccugauugaagaaacaaugauucugauaugaauacagggugcugcuuuuugcauucuuugucugcauuuaaugaacuccauuuaggacaaaauaaaaguuuacuuuccuggcuucuauauuuaaagacuaaaugcuaccuugaauguuuagacaagggugucuucccuugcccuguaucuccggugcccagaauguauauuugacuuugcaaagggaaaaggcuuguaggaauaaugcuguguuccccacggacaggcugcacgaugugcugauggaacugcagaagaagcaacugcagcagcucuccgccugguuaacacucacagaggagcgcauucagaagauggaaacuugcccccuggaugaugauguaaaaucucuacaaaagcugcuagaagaacauaaaguaaaucugucucauauuucuucgauaccuuaucaaauaugaaagagcagcacuuagcaucucagaggcugaugacaucuaucguuaacaugaaguugggacacuucuucaggguugucuucauuuagcagcucacaggguggaauugauagagaugagacuuuucugagccagggauaaaagggcacgguaaaauuuuauaugugaugugcaguuuucuuuugaaaguacauagcuuucauacaacuggagaaggguucuuuuggcccucuaaguggcuaagaacccaagcauguuggcguucacauggugugugggugaagagcaaauucuucgucuaugauucaggaaagcgucaggcauuaaguuaggaaccaaaauugggugggcaauuuaauuuggucacaagucuaggagauaaacuuuucauagucaagauaaggaaagauagaauaaaauaugcucucuguaaauugaagacuuuuauugaucagugaaacauugagguaacuaauauguaaaacuuuaggaauacauuaaacacaacucugagaagcauuugagaacacuauugauaguauuuaaauaaauuuucuuucuuucuuucuuuuuuuugagauggagucuugcucugucacccaggcuggagggcaauggcaaaaucucagcucacugcacccucugccuccuggguucaagugauucucccaccucagucucccaaguagcugggacuacaggcgugugccaccacacccagcuaauuuuuuguauuuuuuguauuuuuaguaaagucaggguuucaccauguuggccaggcuggucuugaacuccugaccucaagugauccgccugccuuggguucccaaagugcugggauuacaggugugagccaccaugcccagccuauaaauuuucuauacacauguauccaaugacuaugcucuucccauggaaaaggcgagagaaucuaagguguccauacuucuuuaacugcuuuauuggguagcuaaucagaguaacuuuugacuaucguguagcauucuacuuaucucuuuauacuguccuacacuagauaaaaugaucucugacuugguuuauuuaagcucuggacuuuuuugcuuuaccacuucuacauuuuuguauuaauuccuaguauggacacucaacuccuuuaugcuauaaauucugagggagggccagaacuugaauaaaaguggugauaucuccauuugcagucuguuauaacacugcauccucaaacugccuuuguugauaauggaauguaaagauguauaauaggauuaguuucauuaguagaacaguuaggguaaugauuggaaauuuaaauaugaugccucauuaacuguccuuaauuacuauugacaacugagugcguuuuaaauagguaaaugugaaaguagaaauaaugguuuaucuuaauuuuuuucucuagaguuugcaaagugaucuugaggcugaacaggugaaaguaaauucacuaacucacaugguggucauuguugaugaaaacaguggugagagugcuacagcuauccuagaagaccaguuacagguaagagugcuguaaaguuggauaauccugagggaccuguggucugagacccaauuacauauugcccuuguucuucauguccuuucucauucuuuauccagaaggguagaaaaaccuaccuuugauuguacuucucaguugggguucuacagugugugggcuacaggaguacccagguauugauuccuuuacuucagcucuuggggugaauggauggggcugguugcaguccccagcuuccuugugcauaaugacaagauuuggaagcacaguguauuaguccguuuucacacugcugauaaagacauaccugagacugggaagaaaaagagguuuaagggacuuacaguuccauguggcuggggagaccucacaaucaugguggaagggaaggaggagcaagccacauuuuauauggaugguggcaggcaaagagagggagcuugugcagggaaacuccuuuuuuuaaaaccaucagaccucgugagacuuacucacuaucacaagaacagcaagagagagaccugcgcccaugaaucaauuaccucccacuggguuccucacuuaaaaugugggaauugugggaguuacaauucaagaugagacuuggauggggacacaagcaaaccauaucauuccaccccuggccucucccaaaucuuauguccucacauuucacaaccaaucaugcuuucccaacaguacccccaaagucuuaacucauuucagcauuaacucaaaaguccacaguccaaagucucaucugagacaaggcaagucccuuccgccuaugagccugcaaagucaaaagcaaguuaguuacuuccuagcuacaaugggggcacaggcaaagaguaaauacaucuguuccaaaugggagaaacuggccaaaacaaaagggcuacaguccccauucaaguauggaauacggugggguagucaaaucuuaaagcuucaaaaugaucuccuuugacuucauguuucacauccaggucacgccuaugcaagagguagguucccauggucuugggcagugcugccucuguggcuuugcgggaaauagcccccuccuggcugcuuucaugggucaguguugagugucugcggcuuuuccaggugcauagugcaagcugucaguggaucuaccacccuggggucuggaggacaguggccgucuucucacagcuccacuagguggugccacaguagggacucuguuugggccacauuucccuucugcacugcccuagcagagguucuccaugagagccccaccucugcagcaaacuucugccuggacauccacguguuuccauacauccucugaaaucuagguggauguucccaaaccucaauucuugacuucuguguacccgcaggcucaacaccacauggaagcugccaaggcuuguggcuugcaccuuugccauggccugagcuguaccuuugccccuuuuagucauggcuggagcagcugggaugcagggcaccaaguaccuagccacaaggcacggggacccugagcccagcccacaaaaccauuuuuuccuccuaggccucugggcuugugaugggaggggcugaugugaagaccucugacaugccuggagauguuuuccgcauugucuuggugauuaacuuuugccucuuuguuacuuaugcaaauuucugcagccagcuugaauuucuccucagaaaaugagauuuucuuuucuauugcauugucaggcugcaaauuucucaaacuuuuaugaucuguuuccuuuauaaaacugaaugccuuuaacagcacccaagucaucuccugaaugcuuugcugcuuagaaauuucuuccacagguacccuaaauuuucccacauuuuucugucuucuucugagcucuccaaauguuuccaaccucugccuguuaccgaguuccaaagucacuucuacauuuuaggguaucuuuucaacagcaccccacucuacugguaccgauuuacuauauuaguccauuuucaugcugcugauaaaaacauaccugagacugggaagaaaaagagguuuaauggacuuacaguuccacaucguuggggaggccucacaaucauggcagaagggaaggaggagcaagucacgauuuacaugcaugguggcaggcaaagagagagagcuugugcagggaaacucccuuuuguaaaaccaucagaucucgugagacuuauucacuauaaugagaacagcaugggaaagaucugcccccaugcuucaauuaccucccaccaaguuccucucaaaaaaugugagaacugugguaguuauaaugcaagaugagauuuggauggagacacaggcaaaccauaucacacaggagcugaucuuauuaagugauccacugacuucuucucagaagcacuugaggagcuuguuaaaauguagauuccuaggcucuacccacuaccuaaaucuaggugagggagggaugcagugaauuugcaauguaagaaaaaucaugugcauaguaaaguuugagaauuucaccuaguaggauucaauaucucaguguuuucgguagauuaauaugugaauuucaacaacaguuuuggaaaccucccaaaauugcuucuuuuugcacaaaggcaauaguguaucuuuacaagucuuuaacagauaaauuuauugguauuucauuugaacaauacuuggauuuucugguaagacguugccaauuuauuuaaauaugaugccucauuaagugaggcaauccaaacuguaauuucaucacgugagguccuuuugcuuuugugauauuuaaagucagccagagguucuaagacuuguaugcaguaguuaguuauuauaaccugagagcuaaguauucaugccuugacuauuuagcaguaaggaaucugagauucagagagguuaaguaguccuccugagauuuaaauagacaaugaguuaucaugcugagacuggaaaucuaucuucuggcucuuaaguuuucucccccuuuguacuaugaaaagcuuauucucauauuaaguaucaaaauaguauaauaugaauuaaauaauucuuguucacauguauauaguacaaaaauaaauuuuaacauuuguuaaucauuauuuguaaaauuguaauaaaaugauuuugggagaaaauaaucaugaagagugauuuuuuauaauuaauaaaauuuauuuaguauugcugauacuaguaagauucuauugcuaauuuauguaacuuauggggaauuuuuuuauggaucacauaauguaaacagaacaaaucauuugauuuuuuuauugucucauaaaaauucucuuauucaaaacagguuuuauaaguuaaacauuuuucauaauuuugguaccacagaugaaaauuuucuuggcauguaaaagagaguuaaggaauauaacagacaugcugguuuuuuuagcuaaaaauuugaaaaauuugaagcacaaaaaguagauauguuuguuuuauuuuuuaauaauauguaaaaaugucauauucucauaaaaaccacaaugaaauagaaagagcagguuuggagucaaagauucagaggauacaguucuauuauguuaguuucuagcuaugugaaaucauuuguucaauucuauggaaauuaguuuuucugauucauacauuucuaggccuagucuguuauuuuaaagcaauuuuuauaaaaauacuuuuuauaaguuguuauucuauaauaaagaacaauggaaaucaugaauuucuucaaggauugugauaacucucucuuaaggcuguguugacaaaggaugguuucuccuuuuucuagaaacuuggugagcgcuggacagcaguaugccguuggacugaagaacgcuggaauagguuacaagaaaucaauauauuguggcaggaauuauuggaagaacagguaugaaacuguuuuccauaaggggcaaaauaaauggugaaaaguaacccaucuuuuauugugacuuuagaauaaaguugccuuguuuacuuuucuuugaaaggaaaauauauaaauaauuauuuuaaagaucaaauuucuauccaguuuauaacugaucaugaagcuuauucacagagauugugucauuuggcuccauuaauuugaccuguuuucauuacuuggaauguuaguacuuagaagauaugcuauuuucaugauuuguuugacaucauaguuauuaguggauuuguguugggugauguauuugaauuuguaucaacacaaugccuagcauauaauuugugcucaguaaauaaugaguaaugaauccacucaacacacugugaacuuuaauucccuagauuuuuucuugauuuuuaacaaguauugaaauuaaugagaaaauauuauuuagucacaccuuugauuuaacacuggauuaauugcauauuuuuuccacuaaguguuaucacagcaaaugaaucuguuguacaaagcugccaccuuaauuuuucaauaggacugguggcucuuugccuguucucugucuuuccagaaaagcaaccauugaaacaaaauacaaauaaacaaaacuuuucuccccaaaugccaaacaguugugguuuaaaaaauaaguagauacuggccgggcaggguggcucacgccuguaaucccagcacuuugggaggcugaggcagguggaucacuugaagucaggaguucaagacuagcccggccaacauagugaaaccccgucuccacuaaaaauauaaaaauaagccagguguggcggugggugccuguaaucccagcuacucaggaggcugaggcaggagaauugcuggaacccaggaggcagagguugcagugagccgagacugugccacugcacuccagccugggagacaagagcgagacucccucucaaaaaaaaaaaaaaaaaagcaaauacucuauucccacaucucucaguguccauuuugauucuuuuaaaugcauuucauuuccaucuauaagaagcaacuauauucucuucaggggaaaaaacucaagugugugauguuuuguggcuuacuaaauaugguggcagauaguugcagaauuuguccaaauauaaauuguuaaugacuacuuccccccccgcccucaaucuguggucagauuuuucuuauuaggaaucacaaaagggaccugauucugauuuaugaaauguuuacauuucauguuacaaauauuuacauuucacuuuauaaauauuuauguuuauugugaaccuuguauuuaggccaaaaagucucagaauaguuaaaauuuuacuucaauaaugacaguagaaaggcugggcgcgguggaucacgcuuguaaucccagcacuuugggaggccgaggcgggcagaucacuugaggucagaccaacauguugaaaccugucucuacuaaaaaugcaaaaaauuagccaggccugcagugggcaccuguaaucccagccacucaggaggcuauggaggcaggagaauugcuugaacccaggaagcagagguugcagugauccgagauggcaccacugcacuccagucugggugacagagugagacucugucucaaaaaauaaaaauaauaguaauaguaauaauugcaguagaagacaucgauugcuagagaaaaccauuguguuacucuucuauccaguaaaguaauugcaaauuuggaaauaauuuuaauuugaugauaaaaaacaguuuaaaaauagagugcuaguauuucagucacuuguaccacuuuagguuuuaaacugaccuuucaucguguucuauaaugaucugacauuuuaacuauaccuuuuguguguguguguguacugucuacauguucugucugauggcaucauuauuuaugugcauaucuuaccagccucacuagacugaggacaguauccauuggggggugaaauauagaggcaaggaauaguuguuaaauauuuaauucauaaauaaaauugcugagaaagaauugauuccguugcaaauacagaaccaaguuguuuuccucccuacuaaauagaaaaggguuuccacccuaaaugcuacauuuugggagaaauuaucacaauguagcuacgguuguuuuccaucccuucuucaggauuaucucucuacaugacugaauauccucugcuuagaaaacacacauuguuguccaaugaaguugaaaaaucuuuauaugggcuuugggugcucuucagacucccuccuuuaaucauaauugcuguugaaccuugaaugcuaguguggauuuccuacaugaugccauggaaaacacugguuuugggguguggacccuggacccagcucugccauuaacuauccaagugaucugggacauguaacuugacuucucuuuccuuccuuucuaaaaugaggggcugggacaagacaaucuccgagcuuacuucugccucuaggaaguuguaauguaauuccuuuggagacuugcauaguuggauuuucccuuuucccuccaccuaucuccuugagaauuagguuuaguucccuagguaugaggcuaaugucugauuguucuguuacaaaucugagaaggauaauauuuuaaagaaagguaucuuucugggucauuugugccucagacuuagguguuugaaggccuucuuauccccauguaagggugaagccucuaauaaaauaaaaguuagaaauuuggaugcaugauuuaauugaauuaccaaaugauuuugcagauaaaguucaacuuuuguuauuacuuguagugcuuguugaaagcuugguuaaccgaaaaagaagaggcuuuaaauaaaguccagacaagcaacuucaaagaccaaaaggaacuaagugucaguguucgacgucuggcuguaagugaugggguugucagcaucuguguuguaagccuaugauaucuuaauguuuuauagcuaaugguuaguagaauuuagugaaugcagauuacagcucauuaccuagcauuagacugcugcccuguaacaaucuggaaccacgagucuuaccuuuuagcauagugaacugcaaagcauguacauuuuacuauaaaagauacauguuuaaaauuuuuggcuggggaacagaaagacaaaguccuguuaaaaagagucaucuaauaaauaucugaaauacuagauuuugaaggaagacauggaaaugaagcgucaaacauuggaucagcugagugagauuggccaggaugugggacaauuacuugauaauuccaaggcaucuaagaagaucaacagugacucagaggaacugacucaaagaugggauucuuugguucagagacuagaagauuccuccaaccagguacuuuuugauuuggaucauauguugugccaugaaguaaacauuuaaaauuuaaauguucagguuaguuuuaauuuguaugaaauaaacuaaaaaguuguuuccuuacaccugaugaaaaauugacaugugaaaaucaccuucaguuuucuaaaguaaguuuuaauagauuaucuuaauauccuauaauuuaauuuauaguaacugauuauacuuagccaauaaauaaucuuaacaucuuaaaucuuaaguaaucuuauuaaucuuaaaaauauuuuaaugaauuagucaaacauaaaacauugguuuguagacagauauucuuagcagcauuauuuauaauagccaaaaaguggaacaacucaaauauccauacacagaugaauggauaaacaaaaugugguguaugcauacaauauuaucugauaauacaaaagaacgaaguauugacacaugcuacaacauagaugaaccuugaaaacacuaugcuaaguauaagaagccaaucgcaagauuauauacgcuaugauuccauucauaggaaauguccacaaggggaaaauccacagagauagaaaguaaaugcaugguugccacuggugggaguggggaauggggaguguugguuuauggcuaugggauuucuuuuuggggugauaaaauguucuggagacagacugugaggaugauuauacaacuguauaaaugugcuaauaaccauuaaauuguguauuucaaagaaagaauuuuauagcaugugaauuacaucucaaugaagcuguuauaaacauugaaauuuuggauggcuuuuauuucaggugacucaggcuguagcaaagcuggggaugucucagauuccucagaaggaccuuuuggagacuguucguguaagagaacaagcaauuacaaaaaaaucuaagcaggaacugccuccuccuccucccccaaagaagagacagauccauguggauauugaagcuaagaaaaagugagaagagauagagaaauuguucaaauccaauauugcacauacuauauuuucuacuuggugccuauuuuguacuaaucauuaaucauaggcaaaucuagacauaauaaguauuauuauuaugaaaagucaacuacugaaccacucacugccccugucuucugaauauucuacuuggcacuagcuaagcauccaaauuuucuuggaugauuuuauuuauccuguguucaauugggagaacuuugugaucgaagcuuucuuucuuccuuucccauuauucuccuuggaaggauaugauuguccaugacugucuuuuuauucuuucuuucacugucacaacucgacagugaccuccucagucuuugaauauagcuuccccaguuuuuauugucagaaagugcaggggauccuuaaccauuccuauuaacaugguuuccagacccuuuuauaucuucugucugcucuagaaaccacuauugguuugccuuaaaauggacuaccccaauaaucgagggccuuaaaugacugcuuaaugcagugccuaguuuaaaauauaugcuuaaaaaauggcagcucauuuccacuucucuuccccuggugcugcugugguggugguuuuuaccagcucgcgguacaguggacagucauuuccuagaauguagacaccuguuccugugaccugcgaucauugcaucacucuugcccauauugagagcagaugcugacugagucuccaaggucauuggaaacgugcgauuuuuagauggccgucucuucucugaaauauuaaauagaaagcugcuguuaagaugacaggaggaacauaucccuguuugagcaauaccuugaccccagauauuuaucuagagcaucacaaaaucccucacauuuuacagggaaaaucuaccuugaugaaaagauaaaauauucauaguucaccagaaacacuuuaagcaaaguuucucacaagaaucagcaauaacgacuugugccacugcuuaauguaucgagaagcucuguggggaggguacuaguuaagaagacagucuugguuugaaucccagccucacccuuuguuagcuuugugacaugggacaguuacugaaaaccucugugagcucaguaccuucaucucuaaaggggauaauaauaguguauacuuuuuagggugcuggugaggauuccuugaguuaauaauagacauaaaacacuuagaaaggggccggguagaaggccagcaaucagugaucgugacuccucuuguuccuccuugcugugguuuugaccaaccuucucaacaccucucaaaccuguccuuucgucuuccuucccacuguuacuaucuuaguugugacucccguugcuuucacagccuguucucgacucgucucucuuuaaugccuucuccucagugaacacuaaaggauaaauagaaucaugucaguuccaugcauagaacucucccuuggcucucaacugccuuuggguuaaguccaaacuccuuaauauguccugcagggccuucuuguagcugguccaugugauucuuggccacaucgucaauugucccucccuugugaguucaguacucauuauuccagacacgccuaacuaauacuugcaguuugcaaaaugugaucuucccuuucucugcuuucccuuggcaagggaaacuccucaguguaaugcuguuguucuccuuuaggaagccauccaugccccaauuggauuagaagccacuccugugaauuccuggaauuagcaccuagcaaauucuuuuguuauugccuguuacuuuccauugcuuacuagacuagaagcuccuugggagcugagauuuguaucugguucacuuucauaucaagagcccagcccagugccugacauuuaguaaggcucaaucauuacauauugaacaaaagaagauguuaacuuuaguaaugucuguacuuguucuuugcugauuaucuaaccaacucugguuuuuauuaucuauaagcauuuauaaaaauacaagugauuccuuauaaaggugaaaauuguuuuaauauguaaaguuuuaaaaauuuuuauuuaaggccaggcauggugggucaugacuguaaucacagcacuuugggaggccaaggcgggccgaucaugaggucagccuggccaacauggugaaacucugucucuacuaaaaauacaaaaauuagcugggugugguggugggcaccuauaauccuagcuacucgggaggcugaggcaggagaauccuuugaaucuggaggcggagguugcagugagccgagaucgugccauugcacucaagccugggugacagggcgagacuccaucucgaaacaacaacaacaacaacaaauuauuuaauuauuuucuucaauuguuuauuaacccuauaauauuauuacucuuuucauacuuuuaguuguaaauauaugaucucauuuugcaugguuacccuauuucuggguugcuguuuuugggggagugauaaaaagacauauuccugaugagcauuugaguugcucuuucuggagucaaguaaaacaguagaaggaaacaugacaaauggucaccucugaaucuucaaacagguuugaugcuauaagugcagagcuguugaacuggauuuugaaauggaaaacugccauucagaccacagagauaaaagaguauaugaagaugcaagacacuuccgaaaugaaaaagaaguugaagguaaaaaacauaaaccacauauauccuagugcauaaaauaguucaucaugcuggauuuucugcuggcauaaagacauuauggaauucaaaagccuccuguaaaauaaauguaggcagaagguagcuuuuaguacauuguagugaauuuugaauccauucaugcuagcugucaucagaucccuauuuggaggacguuuuuuuuuuuucaucuuugucagucacugagauguacagugaggaauacuucuuauggugauccaguuagugguacuacuuuuuaguuaguuuagaucacccuuaaucugguaucuaauaauuuaugacucuauauuaacauuaugcugaagauguuuugccuucggaauacaacaaacuauuuuaaaucaaaaaguguauucaauauauuuucuuuagaguuguaaaaaauaaauacaauuaaaaggugugggaucuuagcccugccgcuuuccaugcuuauguguguuucugaagagugugaugggaacuugcagagcuuuuuuguccugggugcucauacgucuccuacacauuacugcauuaacuauuugggcaccuggguagagaaucuauagucuagucuccugccaucuuaagagguagcaaaaaaucaacuuguaaaaaguagauaauugccuuuuucuccaguucgauggugacuuuuacauugaucuuuaguuagacaaaauaaacgguguuucuuagagucucuuacuaauauuccuugaucuuugacuauaagaagguuguucuaccuagucacaguaaacuuugugaaaaucaaaguaggauagcugaauuuauuugauagcacuuacauguaaacaauuuagaauugggauucuucucuggauugucugguugaaguaauauggguugcucagaaguugugauuguguuaugauggauacuauuugaauaguauauaaauaugaauaauauauaaauaucaguuggggauggaggaaugagagaaaauucaaauaccgaguugugugcacauauaguuguguuuuuguguguauacaugauuuuacuugcuucauucuuacuaguucuggaaagaauuuugucuugggaguaucaaacuauagagauaaaaaaaauaaugaaauuaggagccauuccucaacauaaagaacaaaauguggguugggcuugccauggcucacgcuuauaauuccagcacaaggcaggaggauugcuugagcccaggaguuugagaccagccugggcaccauagggagacccccgucucuacaaaaaguaaaaaaaaaaaaaaauuuguggggcgugagcuugcacuuguaacuccaacuacucgggaggcugagauaggaggauccuuugagcccaggagguugaggcugcagugagccaugauugugccacugcaccccagccugggugacagagugacaaccugccucaaagaaaaaaaaaaaaaaaaggaacaaaaugcuuugguuuggguucuaaagcauauuuacuauuuucauuauuuaaaaauuauguaugaaauaugauugugcuugaaguuugcauugaacccuagacuuaauauaacccaaacaaauaauacugagccucaaaauauuucuauccauuuuuucuguuuucuuucuuuugagaugggaguuuugcucuguugcccaggcuggagugcaguggugcaaucucggcucccugcaaccucugccucccggguucaagcaauucucaugccuaagccuccugagcagcugggauuauaggcacacgccaccacgcuuggcuaauuuuuguauuuuuaguagaguugggguuucaccauguuggccagacuggucucaaacuccugaccucuagugauccaccccccucagccuuccaaaguguugggauuacaggugugagccaccaugcccagccuauccuuuuuucuuguuaguuaauuuuuguucaacaacuucugucauaacacauucaauucuuuugacucaaaccauuauuuuuauggcauggcguacucaggguauguaugugaauagauauccuggaucuaaaacauaauuuuaauuauuuccuucuaauaggagcuuauaauuaugagguacauuuuuuuucuuacaaaagaaaccaaugcuuuuuaguugcuaugauuacguuugaauuuaccuuuucagauuuaaaaagaauguaggagggccauucaacuuaaacauuuaaaacagcaacauuauauugagaagaaaguuugcaauauucuuauguugggacuucauuugcaggcauuagaaaaagaacagagagaaagaauccccagagcagaugaauuaaaccaaacuggacaaauccuuguggagcaaaugggaaaagguaagauccuugauuuuuuuccccuauauuuuucagaugguggcaucgaauaauauuacaguuugcccuauuaaauauuuugcuuuaauacucgaauccucuuuuggcuagauaaaugguuuucaaaaauguuuuuaggcagcagaaucuuuaaaaaugaaauuuuauucugaagcugauuguaaaaaagcagauaaaagcaaaguuguucugauuuuauauggggucggggcuggauacccugauuagcagaacaguuaaaacccacuagcauaguauauuuuaaaacuguauccuuuggguuuauauauugggaauuuguuugcagggugguagcaaaagaaaacuuuacuuggcaacauuugggaaacgaaguuacguuaaauucauuaaggguauuugauuuuugauaacuuuuaaugcauuauauuuauuuacuacaguauuuuuauaguuaaguuugauaagguguuacuuauauaugaaauuuuuaaaugcucccaagacuuuuuuuuuugcuguagcucccagugacucagaauaagcuaaagauuaauauucuugaugugcaguuuugcauaugaaucucucuuuguucuagagaaauguugaaagacauuucuugcacuccauguacguuggucuaauaaugguaagcacuuuggaaggcugcuguagcucuccuugacaccuguacagauaccuauacagaauuaggaauauuaguuugacaagaaucuuaaaagcaguagcauuuaauuuuuuauuguuugacuuuuuguuauggaaaauauaacuguauaaaagcaaauagaauacuauaaugaacuuccuuguaucaguuaccuaguuuaguaauugacaauauucugccauucuugaauuaucuauaccuuuacucguuccucagccucucaauuauuacuauuuuuacaguuuucuuggaaguaaaauuuacuuacauugaaauacaugacuuagcugugcuguuuugacaaauagauauaccuguguaaccuacacacacacaucacuguagaaaauuuccaucuuuccagaaauuucucuuuuggguuagucaccuuccucccuccagaaaacaacuguucauguuguuuugaccuuagauuauuuugccuccagccuuuaacaaauauguuuauuuauuuaguauguauacuggauauguguauacacacacacacacaaacacacagaaacauauauacacacacaaacauauauagauauauacacauacacacaaaauauggaauguauaccauguggacaguguauguccauuuauuuugaaauuaugcaaauguauuaucaauccauuuauuauuaauaaauguuaauuucuuucuuuaaauaaauuaaauagaauaguauuuaauauuuucuuucaaaauccauucuagcagauugucuuaguuguccuuccugugggcaucccacuuggagguuacucuuuccaguauuuacuugaagagauccagagacacaaacagaugauaacuucccuugagauucauucaauaauuauaaugcauuggauguugaauuuauuuccuuuacaagcauagauuuuuuacuucuaccucagcauuguaccuggugacucugacuuuaucugaugugaauaugggauaauuucuugaaucuguguacugaauuuacucccauuucugucagguuuucagcaguguggcagaauuaugaagaugggggagacuugauguagaugagaaguuggugcgaggugauguuauagugagaauaacagugauugggggaaugggcaaacuuggauucuccuguccuuuucuaguuucuuauccuugggaaagucuuggaacccuuguuucuuugccuuggugucuggaaaaugagggaguuuauuagcugacucuuagcuguuaguuuaucaggugacuauuaguuuauuagcugacuauaggcuuugguccauaaaauucuaccauaaauggguccuaaauagacacauucuggacauugaguucacaugaaagugcuacuugcaaaaggccaaaggcaacacuggagaauaguugacauggggcuuuugucaccuaauguauacuugcccaauuucauaggaaaccuuuuauaguuuguauuaucauguuuuuucaagcauugguggaauuagaaaugcauucauuagaggacccuaauucuuuuuuguuuuaaagaugcaucuauuaaaaaauuuuuuuuaggacaacagugggaagcugagaaaugggggagcugaacuggauaaagucuguguguuccaguucaguuagggaggcaugucaaauucuucaguaaaacccauauuugaauaaucacgucacuguuuuucugaaaccaguuccaucaaaaagcccaccauagccaauucugauaggucuuuccugccuaaugcauuuuacauaaguuuugagguaucucauagagcauagaaacaauuuuagaaaauaaaauagcgugaggcugggcgcaguggcucacaccuguaaucccagaacuuugggaggccgaggugggugggucacgaggucaggagaucaacaccauccugggcaacauggugaaaccucgucucuacuaaaaauacaaaaauuagcugggcaugguggcacaugccuguaaucucaguuacucaggaggcugaggcaggagaaucgcuugaaccagggagucggagguugcagugagcugagauugcaccacuacacuccagccuggugacagagcaagacucugucucaaaauaauaauaauaauaauaauaauaauaauaauaauaauaauaaauaaaauaguguguuucauuugacuuucauagcugauauacuugguuuucuucguuuagcuuaucuuguuccuagagcucuucaucuaguaaaauacaguagaguaguugggcaucuggauaauguggcuuuaugaaucaaugcccauugugguugccuaagcauauaagcccaggaaguuuggugaagguccuauguuuuguaaacguuucccuugauuccaauagugauagacugagaaguguaaagucaagugagacugaguggcaggaauguguucuauguucucccuuuuagacaauuaauaaagugaucuucuguugauuuugccuuuugacuagucaccuucuaagaacucuguguuuuauagaaauagaaaauuuuaaacucuggaucucugggaguaaaacaacuauuuuuaaagacaaugugcaguuuuccuuuuauaagauguaaauuguguuugaaucauuaccgggcaucacuguaaccagcaauaucucaggauuagagaaagggagauucagauguuuaaaauugguuuaaagaggcaaaaugaauggcuuguaagacauugucagugaaaaaauaacugaaguuguuuuaaccgcccuuguucuugaagugagcaccucuuuccaguuuucuagaugaguagugguaauuuuccaucucagaaauuuuauuuaccuacuuaauuuucuuccuugauuaguaugaauuguccaacauaaagaugauguggcugguguuacuauuccuuugccugccuagaauagaaaugauggggcaggggcaugacccauaucuccauuguucauauuguuaggaaaauggugauuuguuuuguauacucuccccauuaacagggguaaugcagcauggcuuguggugugaaugcuuugcuuaugucucauauucucuuaccugagagaugguggugaacagugaacuucugcaauugacauaggugacacauucaaaugacagcaugauaugcccucauuuaugauuuucaguagacacaguguauuauaaaaauuuucaaaguugcauugucuguggaucauacaugacuuuuuguuuuuaugccuuuguuuuuuaguucaagcucucauuauccuggauuuugaucauauauguuuauaaagcaggauuguuuuauugcuuuccuacucaauaaaaaugugaagccauccuuuugguaugcauguuuuccuccgaauagaaagauuccuuugaagauuucccauacuuuuucauagucauuuuagaggauuugaagguauuuuagauuaagggaaggacuaugauaaaaccuauuauuauauaugacuuuauuauuuuuaggaacauucucuacuuuucaaaaauaucggacaaauaaaaugauaagauuucaguaauaaaaaugguggcauuguuuucccugauguguuucuaaaguagaucaucuuauugcugccucagucuuuugguauuugcuuauuuaugugcaaggucuccagugggcuugcugaugcuucuagagccuggcugcuggcuuaauauuccugcacucaccagguugcuucccagcauaaggcauccucgccauucauuuuuuaauuuauaugacacugugcuuuggucaccaagaccugagcugccuccuaguuuuucuagccagcuuucuuuuuuucuuaggacaaagggucuucuuucugaagucgggccuagacagaucaagguaguugaucuuauuucacugguucaggugauaaacuagcagaguagaagcauggcauggauggaaacauauauuaucuagaaaaggcaguggcugaaguucuacugaugugccugaaucguuauuuuaaaaugucuuucuucuuuguucaaggaauugaaauaaacaucauuauuuuuaagugcaucauuauaaauuuuuguuguuguauuaaaagggacuuaagaaagugaucauuaugugugacauugccucacuauucugaguguuagaauguucagaauaaauucaagacacauuuuguaauauauagacuguuugcuuguuuuucaugucugcauagaaggccuuccuacugaagaaauaaaaaauguucuggagaagguuucaucagaauggaagaauguaucucaacauuuggaagaucuagaaagaaagauucagcuacaggaagauauaaaugcuuauuucaagcagcuugaugagcuugaaaaggucaucaagacaaaggaggaguggguaaaacacacuuccauuucugaaucuucccggcaguccuugccaagcuugaaggauuccugucagguaaggagccaacggucuggaaaguggaggaauucuaugugcaguuccagaguuaaggagggcuucucguaucaugaacuuuaaguuaaugcugcccugauuaacuuccugugaggauguucaucuucagugaguugugugaccguauuuucucuuccuuagcgggaauugacaaaucuucuuggccuucaccccaaaauugaaauggcucgugcaagcugcucggcccugaugucucagccuucugccccagauuuuguccagcggggcuucgauagcuuucugggccgcuaccaagcuguacaagaggcuguagaggaucgucaacaacaucuagagaaugguaaacccaacaauuuuaaaaucuccugucucaguuugccuuaauguaaacaugacucccaacauuuagaacuugaguacacuugcuugcuuugcaccaaccuucuccauuuuccuuugugccuguauuguucaaagucuuaaagucuucuguauucagauucuuuuccagauucacaccuuuuuguaaacauacaagcaaguuucacauucucuaaaauugugucaguaggauauaauaauaauuuuuuuuuuuguagcuacaggaucucacucugucacccaggcuggagagcaguggugcaaucauagcugcagucuugaccuccuggguuucagugguccuucugccucagccuacugaguagcugggacuacaggcaugcaccaccaugccuggcugguuuuuuauuuuuaguagagccagggucuagcuauguugcccacgcuggucuagaacuccugggcucaagugaucuucccaccucagccucccaaaauaacagguguaagccauuauaacaggugauauaacagccucccaaaauaacagguguuaggcaaaauaacagauguuagccucccaaaauaccagggauaacaggugucagccauuguaccugaccuggauauaaugauuuuuaaagauuuuuuuuuuuuuuuuuuuugagaaacaggugcaauuucuuccuuugguugaggaggccacuuaauaucauugcuaggaggaucaaaaugaaugaucccuuacuucuguuuccucaaaauaguuaaaguuuuggcagucucauacugucuuuuaaaagaaaucauauuccacugucagauucagaaaaauuuuagaguucuuacuuuuggaauacacuugguuuuggaagguucacuguuaaagauuuugaaagcucaucccuccuacguuacacuauuuacuuccuagcugccauuugaguuaggaacuguguugcauugugcauuauuuugugaaaugcauugagcauugugugaaaugcuccacauguaacccagccuaacuucagcaauuguagauugugugaugacuggaagugucuguaugugugcaugcuaggcaaaugugucguauugccuuucuucugaaagugcaucuggacagcaugucuuuguuccuugaauucaguuaugugaaauaugucuuugaggguaccucuuucuccacuuauugguacaagcugugcuuucacuuuugacaaggaucaguaggcaguuuaacuuuugcugcuaguugguuucaccucuuugugcuucaagagaacucacuuccuuuccacgcaaguguuacuucugugauauuuuuacauuagugacugagguagacacuguuccagcuggcuguucagucauuauuucucaggguaccugggcagcaugguggcaguauuuccauauaaucuccuccacucuggaccuggguuugucuacacgguggagcuuacagcaagacugguugaagggaucuuuguuuucuuuuauucuuuguguagcuguuaaggaagaggagauuauauggaacaaaagggacauuguuguuccaucuucagagagacauuucaucaugaagaaaugaagaaaaauuauaguggguuaguuaauauuucaaacgucaacauccgcaggaaugaagucacugucugacucucagaaaugccaauggaaugaucuauguuguuaauuaacagagacccuuuuacauuuuaaucauggggucuccuuugccauguauuggaauucauuuaggauaauggucuauguaauaauauugguuccuaauaugauuuuuucaaacuaaauauuuuuaaauaaacagaacugaagggccaaccuggacaugcauaucuggaaacauugaaaacacugaaagaugugcuaaaugauucagaaaauaaggcccaggugucucugaauguccuuaaugaucuugccaagguggagaaggcccugcaagaaaaaaagguaacauauaucuuccauguuagaacucuagcgcuucuucuaauaucuccucuuacauauuuugaaauguuuuuucagagauuaaaaaaaaaguuggucaguuuuguucaucauuggugcaaaaauguguuuaugauuugaggguuaguuugaccucacauaaaagaaaguacaguuauuaaaaauuuuuucauagaagaaaagcauauuuucuccuucugcugugauuagcuuaaaauucucaaccuguucauaaaaucugcuaaaauaucuuuaugaaaugaggacuaucaguugacguguugauguauacuuuuuucugcaucgaauaggaauguuuccgaggucauuuaguugaguagccuuauggcucugugcuauuagaugaaaaggagagcagccauugagcacugcacacuuggcccacacuggguuugcuguucccuugguuuuuaggguugagaauacacuguauugcccacacacaacucaugaagaaaaagcuuuaauuuuuaugauuaugccuauuuuuuucaugaguuuuucauguuuuguuuuguuuuguuuuuugauuuccaacuuuuauuuuaaguucagggguacuugugcaggaugugcagguuuguuaaauggguaaacgugugucaugguaguuugcugcacuacguauuaagcccagcauccauuagcucuucuuccugaugcuuucccucccaccaugccccacccuccaacagaccccaguguguguuuuuccccaccauguguccguauguucucauuauucagcucccacuuauaagugagaauaugcgguauuuuuuuuuguuguuucugaauuaguuugccgaggauaauggcuuccagcuccauccauauaccugcaaaggacaugaucuuguuccuuuuuauggcugcauaguauuccaugguugauauguaccacauuuucuuuaaguagucuaucauugaugggcauuuggguugauuccuuguccuugcuauugugaauugugcugcaaugaacauagugugcauauaucuuuauaacagaaugauuuguauuccuuuggguauauacccagugagauugcugggucaaauggcauuucugguuuuaggucuuugaggaaucaccacacugucuuccacagugguugaacuaauucacacucccacccacuguucuuuuuagauaaaaaugcuuucuaaugcauuuuaaagugacuuuugacuuuauauagcccauuuuacuauaucugugcagacacauuuuugugcauauuuuuaaucuuuuaaaacuuuuuccagacccuugaugaaauccuugagaaucagaaaccugcauuacauaaacuugcagaagaaacaaaggcucuggagaaaaauguucauccugauguagaaaaauuauauaagcaagaauuugaugaugugcaaggaaaguggaacaagcuaaaggucuugguuuccaaagaucuacauuugcuugaggaaauugcucucacacucagagcuuuugagguaaauccagaggccacugggaguuuaaguuuauuacgggguaaauaguaauuaucuuauaagauucacguauuuauuauuuaaauauuuuacauucuuucuagauccccauuuauuauguauuuaaguugggacuuaucaaagauguacuuuuaaugugcuagagagcacauuuauuuccuuuugccuggaagcaaagucaaaaguagaguaaacuggaccuugaagauaagagaaaauugcuuaaaaauggucaaaauaauguuucaggcauggagggccugugugaaauacagacuguugauuagauuauaguaguaacuugguuggggugguagaaauagcccagguaguaguaaauugcugaauacaugaaacuacuuuuugcagguuuuugacauuugaagucaaaagucagagauaggccauugacagugucagagugggaaggcaaaucguuccagggacaugaaaauucagaaacaggauccuucacuacaccugaaaauguugacagaugcagcagugauaaaguuuaagaggaaaggauaaaugugaggauguauaaggagagagucaaugucaauagaagucagugucagauuuuaacauucugccugugagaaagauggagaagcagaguuuccaggucaccugguauuuuaauaggaaaguucuggguggagaaugaaccaaucacacucucucccugcaaggcuuccuauccuccagugacuccuuaccuuggucuuuuuuuuuuuuuuuccccaucagucagggaucuuugucuuuuuuaaauuucuuauucaccgauguaugccaagauguacucauaacuagagcaaugccuggcacagagaaggcauccaaucaauauuuuucaacgaaugaaaugaaauuagcaauaggagauuuagauuuggauauaucucuguauaucuaucuaucuauauauauagauagauagauucucuuggaagcuaaauccaaauauguguagauauauaucuauauauauagggagaugucucuguauauaugcauauacaucuuuauuuauauagagagaaucuaaauccgaaucuauauauauuuagauguagauccaaauauauguagauacaauauauauaucuacauauauuuggaucuacaucuaaauauuauaucuacauauauuuggaucuagaucuaaauauauauagauuuggauuuagaugcuaagcaaauuugcauaaggaauauugcccccaaaaagugaaaagauugaaagcgaagacaaaaauuaaugaaaauguauguuuugaaaaucaaagucagagaacacgugguagaagaggagcuggaagaccucacagauuaguguggaagggauccagccagauucucugaguggaccacugaauuuggaggggcguucuuugacucaggaacuaauggguaguuccaaugaaugaucagcagaagauacagauggagggguuguguguguguguggguagcugugugugaugguagugacaggagguaguuuuucucuagguguaagugcaguucuagauggagaucucauucaaauaaaccaguaauuauggagagaaauguguuuuguguggcuuaguguuuuugacucauuuacuuuuuuuuuuuugagauggagucuugcucuguugccccaggcuggagugccauggugcaaucuuggcuuacugcaacuucagccucccggguucaagcaguucuccugccucagccuccugauuaacugggacuacaggcacaugccacuaugcccggcuaagguuuuauuuuuaguagagaugagguuuuaccauguuggccaggcuggucucaaacuccugaccucaggugauccacccuccucggccucccaaaaugcuaggauuacagacaugagccaccaugccuggcccauuuuacuuugcgauggucccacuucucguuguguauuaugaguugcaauuguucccggcuuucaaaaugagcauuggccuuuucuauaauucuaaaguuuuugguuauggucccagcauuguauuaucagugauucucaaccggggugauuuuacccuccagaggauacuuguuaauuucuggaaacauuucuguugucagaacugugggagaagacuuccaguggguagaggccagggaugcagcuaaacaucccaccauguacaggacagccucacaacaaaauaaucaucuggcuccaaaugucacuagugccaaaguuuagcaaugccagaugaaacauuccccaucuuuucaaaagaucaucccuuuguuuucagauuuaaguccaaaguauaaauggagauuaaccucagaguuagucuucuuuugacucuuaaaaguauaucuuaggguuagcuaaauguaugcuacuauuucaauauggagcuuaaagagaauaaauauucucccaaaauacaaaagaguccugugguuauaguaauccagcuuuaagcuuugguggguuguugcuauuaauguagcaaauccaggcacuaaaaguggucacuuggaaauauuuauuuccauuaaaaauauccaacaucaagggugugugucuggauauguaaguguuuguuguuacaguagcagauuuguaauguccaguacuuuuuuuauuugcuucuuguguacuaacugcaagauugugguuaaggaauacagugucuauauuucuuaauuguauaacuucuucauugaaauacauguuuuaucuuaaauucaaaagaaaacuccuuuuuuuugcuuuguaggaauugcugguuacuuaacuacucaugauuuacuugggaaaacuuuaaauuccacacccucaaauuauuagauaauuauaauaaauauuuauuugcagauuaucauuguuuucccuuuuucaaugaccugauauaugauuuuuuaggcauuuaauuauuuuugucuuuaaggcaugaagcacaguagguuuuagauucaaugccaauucauaauaauguuuuguaggaacaaaauaguuaacucguuuauuuuuaaaaugcauuuuucauuacaugaguaguacuugaagccuacacauugugaagaaauugaauaccacagaaauacuuacagugaacauuuagaguuccuuuucuuccccaauaccauuuucuuuccugggggcagcuaauauuaacaguggauccuuguacauacaaguuagacaagaacaauugacaaauauugcuaauuccaaucauuuucccccacacuguggaaagaaaugauauuggaacucugugaaggacauuuaaauccauaguccagauagaguuuggaagugaaucccacuacuuaauaacaucuuucauugauacagcacauuuaaacuuugaaaguguuuucauggccaugugcuugcuuuuuucugcuauccuucaauauuuguaagaggcuguuaguugugugcgaauuucaguuuucuguuauuuguuggcauugcaguguuuuuccucauuugccugcauuuccuuugucuccauagcugguuccuuuugugcauguugagauuggaccuacauauuuuuauucauuguguuaugcccaaauacauucuuaaguucuuuuuauuugugccaugccaaagcaauaaccuccauuccuguacuuacgagguaaaauauucauuguuacuuuuuacaaacuacuauaccccuuccaggugacaaaacauuugaaaauacaugaaauggguauuucuuuuuuccauuauugauuuuacugacuggauuuucaugugaaucauggggauaacauauuauaaaauccuaagaggcugcuuauauaucucuccucaccaguaguaauaucuuuggauuuaggggcugcaaaguauuucauauuacguacuuccuuuuccuuauucaagagcuccugcccuauguauaacugggaaaugaaagauguccccaaggcacacacaaaacugucuucuauuuuccagcgcuccugccuuuucaggcuccuccuccaggcccuuccuucuggguucaggcucucaugcaaucucuuucccugaaaauuucauuacccuuuaaaucugauucccacuuccugucucuucucucuggaauucaucuuucacaccaauaccagaguuguacuucugaaaggaucugguugucuucaccauuaauacaaauuaauaccaagugccauuaauacaaaaugucccuuucuugcccugaagcccucccugcaucuccacugugagcugagucagguggggagaauacggugggucaccaaagaccauccuagacuauugccuuucucugaaaaugucauguacuugcuaggaauucacaucccuccuccuccugucugcucaucugucuucagcccagcucaucacuacacccauagcuagauaaucguucccuccucugugauucgacugugugucauuuacaccuucacaaugacccaucucaggccgucuuuuauuauggugagaaaugugugucucucuucccacgaggcaugagcucuuugaggguuggaucccugucaggcauagagcaaguuagcagaugugaauguaauugauguguccggccucucuagugagaguggauuuauacagucuaaagccugguuauccuaaguggcaggacaccuguguagucaugccucuuccuucaacuguugaacagucaaaggcacacaugaauggacuugcucugacccggaaucuggaggggggcgugcuggagcuccaacaggcagaaccagguuuugagaguacuuuggaaagcauuuuaggguaaaaaugcaauacuuucuaagaguaauauuaguacggaugauuuaacccuucuuagguaacauauaauugauauaauuaucucauaaggguuugaguuuuuuuucucauuugugaacacauuuuacuuuacugaagggaauauucauauauucccuuccuuagauuuaagaaccuuauuaguuuuuaauaaguguaguagcagugucauuguuugucuucccuacuaagugagagagcacauuuucaagguuguguuuuugagguuauugaguauuauaaagugaaacaaaauaggaaccuggcugccuuaaauuacuguuuuaauucuggcuucacacuauuuuuuuuuuuuucuggucuaugucuuaaaaagcuguggacauuccgacagaugggggaggagcaaaagaaaaugccaagaauuuagcuguaaucaagucuccagagguaguuguguaccuugcaaucuuacugucuuaaauccagauuuaccaagcuuuaaauuaccuccauccuuaggucacaggaugggggaugggaaaugaggugagauagggucagaggaauuguuuuaaugaccuugcuguuccuuguccgugaucccauagcagguuguugcccaucugaaaugcuuagaaaucauugcuuuugagcagugaugguccauguagacuuugacccuuccauacuagaauauuugauauuuugauuuucaaaaaauacuguauucguaauuuuauauucauuugaauauuugugaguaaaaauagguaugagaaauggcugccccagauuaguacuuaguuuauuuuuuuuugcaugugaaauaaugacauuugcuuuagaaauuuacuaacaguuuuuauauuucguuuugguuuguaagaacugaagucccuuaaagaaaugugugugugugugugugugugugcaugcguguguucuguaagcagauggaggugaagaaaaaaaucgucauuauuguagauuagaagcuuguaagugcaucagcugaguaauuuuuaaauggacagagaaacacuauuuucaugugagcucuuugacgaucuuuguaaucaaccucuuuguugugguggaauugacuuaaagaugagcagacuuuugguauguuugaaaagcacaggaaacaucugcuacagguugauugugacaauauuuugcucagggaaaggggagauaagauagggagaguggaaggcagaguagagcucccugucuucugccuucacccauacagguacaggugguagguagcauugaucuuugggacuugauaacccuucccgcgcggugugccacgagguggaaacgccgagugaaucugcugcugccaggcacuucuaaaggaugggccuuuccuucuguaccaauuccuucccaugagcuguauuuggccaggucuagccagauauauaagcaguagccauuugaaacaguuacuuugaaacaguuacaggauagaacaagcauuaauguuggcagcaauuaaaaaagugaaacccaugcuuaugcaaacacaugcucauccuggcuguucauuccuguggugccucugaugggacauaaacaccaaaacuuggaugugguaacucuuuuauggucucaaucuuggucauaauaaagcaguugguuuuguagaucuuaguauaauaaucgcuaccauuuagugcauucuucuaugugggagucucuguuuuucagaacaaccagacaagauaguuguuaugauuccaguuucacaaugaguuauuaaggcucaaagaaaaauuaguuucucaaggccccauggcuaggcaggugcugagcuugguagucagaccucagcauuucuuuauaugggcacacugucucuuuuagagcacagugugguuagaauuacaugcaggauuuuuaguagugaaaauauuauaguguggcuuuacagguucccuucuauucccuuugucacuuuugggaugauccauuggccuacauggcuucucugucuguuucuuuccuuuuuuuuuuuaguauuuauugaucauuuuuggguguuucucggagagggggauuuggcagggucauaggacaauaguggagggaaggucagcagauaaacaugugaacaaaggucucugguuuuccuaggcagagggcccugccgccuuccgcaguguuugugucccuggguacuugagauuagggaguggugaugacucuuaacgagcaugcugccuucaagcaucuguuuaacaaagcacaucuugcaccgcccuuaauccauuuaacccuuaguggacacagcacauguuccagagagcacgggguugggggcaagguuauagaccaacagcaucccaaggcagaauaauuuuucuuaguacagaacaaaauggagucuccuauguccacuuccuuccacacaaacacagcaacaauccgaucucuccuucuuuuccccacacuucccccccuucuauuccacaaaacugccaucgucaucauggcccguucucaaugagcuguuggguacaccucccagacgggguggcggccgggcagagggguuccccacuucccagaugggguggccgggcagaggcgccccccaccucccagacggggcggcugccgggcggagacgcuccucacuucccagaugggguggcugccgggcggaggggcuccucacuuaccagaugggguggcugcugggcggaggggcuccucaguucccagacggggucgcggccgggcagaggcgcuccucacaucccagauagggcggcggggcagagacgcuccccacaucccagaugaugggcggccaggcagagaugcuccucacuuccuagacaggaugacggccgggaagaggcgcuccucacuucccagacugggcggccgggcagagacgcuccucacuucuuagacgggguggcggccgggcagaggcugcaaucucggcacuuugggaggccaaagcaggcggcugggagguggagguuguagcgagccgagaucacgccacugcacuccagccugggcaacauugagcacugagugagugagacuccgucugcaaucccgguaccucgggaggccgaggcuggcagaucacucucggucaggaacuggagaccagcccggccaacacggcgaaaccccgucuccaccaaaaaauacaaaaaccagucaggcguggcggcgcgcaccugcgaucccaggcacucggcaggcugaggcaggagaaucaggcagggagguugcauugagccgagauggcggcaggacaguccagccuuggcucggcaucagagggagaccgugcaaaggggagagggagacgagggagggggagagggagggggagagggagggggagggggcgagggagggggagggggagagggagagggagagggaucuguuucuuuucucuuucuuuuuuucucaugucagagggagagaaggaacagauacaugugaauugcaugugcccugaugggucugcguguauuagagagagggugggaaggagggaggagggaaggcuguugaggccauaaaacuuccucauaugccagugacuggaguaguuaaggccacuuacucaagucaaagccaauugugguuaaaacuuccuugaaauauaaugcuuccauauaaauuuugaaaauuuuggcugaggagacuaucaguuuuccuuauucaaacuagaguuaaugaauuucccaguuauacagcaguaaugcauucuuuaaaagugcagaauggagauuagcagugcaagaaucuguggugacaaguuaaacggagaauuuuuaaagucauuuuaugaacucugugaauguauucacacuuucucucuuuuugcacuucugucuuuuuuggaugccccacucuacccguccugagcaugucuucccaagaagccuucuaugcuaagaccuugaaaugcuggagcaaacacagaagugaccuguaaccaacugaaaauauauaaggguagcauggaccugugggaauagugucagacaggcuggagaagagaggaggaagcagcuuggggaaagugugcaauggaacugaaaggcuuucaaagcugugccaagaauaaacgagaugcagaagugcuuagacaggaugguauaauauuaauggaagacacagagaaaccuagcuagauaagcacuuuuuacuugccaucuucaucagagaauggccuucaaaacuacaaaguauagaauagucauuacugagagugcuuuagagccugaacuuaggaccacaagcaaaaccacucagagcuccuccagaugcauaaaucuacaucccaagugggauuuuuacccuugaucucagggucauuuacgucauaaucuugugagaaauuaccagaaaaauggagauggaggaauguccuaauuaagaggaaacauuaguuuuuagaagcagaagauauaaaguaaguuugaugucaguuccuagccaaacuguaagauaaauaaccgacuagagaucuuauaugugcuuaggaaagaaugucguggucaccaggaaucaacauggauaccaauaauaggccuugcccagacucauuuccuuuaaguacuacuuucuuuucuuuuuuuuuuuuuuuggaggaggaagccuagauuauuagauacacagagugauaacaucucacauuugaagaugcucucucauuuaguucaaauaaugcucacaaaugaacauucuuggcaagucuugauuucaccaaaguauuugagauaaucucugauaaccuuauauaaacuaguuagaucuuugugaucaauucaaacauuauaaggaucagaauaguugguucuggguggcauauuuuaaggacauuaaaaauugauguaguuuccagagcguguugaucagaguagugagcaauaccuaaauaucauguccuacagacaucauggaaggaauugggaacauguaaucaguagaagaccagagaaaaacauggcaguugcccaccuauggaaagaaaugacaaugauuuugguauuggagcucaaaagcuaaaauugcaucuacuuacuugcauuuuuuuuuuuuuuuugagacagagucuugcucugucgccaggcuggaguguaguggugccaucuuggcucacugcaaccucugcuucccaguuucaagcuauucuccugccuaagccaccccgaguagcugggacuacaggugccccaccacgcccccagcuaauuuuuguauuuuuaauagagacgggguuucaccuuguuggccaggauggucuugaucucuugaccucgugauccguagccugggccuccuaaagugcugggauuacaagcgugagccaccguaccuggcccuuauuugcauucuuuaaggccugguuccaauguuaccuucucucuaaagucucuuucucuuugcaaaauguuugcuuucacauuugucuuugaaccccuaucgccauacacaguagcuggauuuuauauauauaguaggugcuuaauaaauguuggaugaaauauuggagcugaacggggacugucuugaguucucagauaaaaaggcauccaaaagcagaaaugagaaccaucuauuguauucccucuaccgugcuauuuguuuauuccugcucugaguuacuaacuuuagagaaaaauuguucuaaauuauaucagagcaaaauauuuuauagcugauaaaaccuagaaaugcauuuuuucccuguaauuugcauuuuaaaucauaacuauugcuugcauuuaagcaaaaagagcuagcguuuggaaauuuuuagagugguuacuaaccugucaucucuugaggauuuuagucaagaaugaagaaaauaaucauuuucaaauuuggaagguuuagaaaaagaaauaacauaaaugaaagcgaugcuaucggagcuuuaaaaaguuccuuuguuccaguggcgguagaucuugagauguaguaggcugaacgucacgaaguaauaucccccucuguuaucauguucgauuaggccgauucaacagucauugagaaguggauggauggcgugaaagacuucuuaaugaaacagcaggcugcccaaggagacgacgcaggucuacagaggcaguuagaccagugcucugugaguucugcugaucuggggaacuugucauaaauaacauuuuguucuuuuucuauguuauuugcugcuauuauuaaaauugugagaauauagcauagcauuacaucuagauaaaauaucuuucaucauaaagcuuuuaugacuuuauagcuaauaaaagaaugacagauucuucaaguuuuuauuucuggacgugguuauagaauuuugagagguuauagaauagagaacaagaacaauuuugguucauuaggagucauuguauauugcauuucuugugccacauggugaggauuuaagaaaaacauauuuaacaaaugaauuugagaagugucuguucaucaaauucauuuaaguauguuuuucuuaaauccucaccauguggcacaagaaaagcaauauacaaugacuccauguugugcacguguacccuagaacuuaaaguguuaaaaaaacaaaaaacaagaaaugaauuugcuaguaauagugcaugcaguuuauauuuggugaaaucaucaggcuucucuacauuaauuaaaaggcuauucccuucugagagucaaguauuuccagucuaauuuggcagauggcuauaucaagcacccaggugaaaugaguuucuuaaggcacaauauuucuuaaguaguuagaaguacugacucuuaagcagucugcuuguguaauauuugcagggagauaagcagacaaacuauaauuauggcauccacuuauauaguaaugaacucaacaugcaucuuuuauguguuuaggcauuuguuaaugaaauagaaacaauugaaucaucucugaaaaacaugaaggaaauagagacuaaucuucgaagugguccaguugcuggaauaaaaacuugggugcagacaagacuaggugacuaccaaacucaacuggagaaacuuagcaaggaggugaguuuuucaacuuuacuaccuacgguuuucaggagauguagacuguagcuucucucagcugacuaaauguauuaugacccauccaguuugaaaaacgauggucuagaauaacuccagcauggguagugagcuggggccaaaaaaaaaggcaucauuuuuuaaauuaagagagggugcugauuguccaguuuggcucagggcuuauccauucuugucuuaaaucuggcuugaaacacauuuaugacacuugcuuuaccccuaagacauuugagugggaccauuuauuuacuuagcaaauauuucuuaaucaguugccaccugucaagcaucauucuaggcacugcagguacagcauugaacaaggaagaagaaacuccucuuaaggagcuuacauucuagugaggcagauggauaaugaauaauaucauggaggaguagcaaggaguuagggcuagguggguuauuucaaauaggauggucagggaaggacuuucugagauggggauguuugaauaaagaacugaguaaaguaagagaugagccuuguaagguucagauaagaacauucaggcguggagaauagcaggcuuuaaaacucuguggugggaaugaacuuggucuguuuaauaaagaaugaaggcaguguagcuggaauaaaacagagaggaguuagugaguuggagaaugggaauauuugagguuagagguaggcagaggauggauuagcuauggccuuggaggaaaggacuugggauuuauuucaaguaugauauuacacagaaagcaauuggaagguuuugaacagggaagugacaugugauauagaucuuuuaaggucacucuggcuuuuuguuuuguuuccuuuuuuuuagcaacaguaucuuguuguaucacccaggcuggagugcaguggcacaauccuagcuuacugcagccuugaacuccugggcucaagcaguccuccugccuccuggguagcuggaacuauagauguucaccacuaugccuagauaauuuuagaaauauuuuugagccagaugcaguggugcaugcuuguaaucccaguacuuugggaggcugagguggguggauugccugagcucaggaguuugagaccagccugggcaacauggcaaaaccuuaucucuauaaaaaauacaaaaauuagccgggcaugguggugugcgccuauagucccagcuacuuaggaggcugaggugggaggauggcuugagcccaggggauggagguugcagugagcugagacugcaccacugcacuccagccugggcgaaagagccagauccugucuuaaaaaaaaaacaaaaauuguagagaugggguucuuagaggcugaggcaaaaggauggcuugaggucagcaguuugagaccagaugccagucuggucagaugcugcugaccucaagcaauccuccugccucagccucccaaagcguggagaucacaggcaugggccauugcacucggccucucucugguuuucaugugaauaguuugcucugggaaggcaggaaugaaaacagaaagaauucuuauaagguuacugcaggcuuggagagagaggauggacccauacacuagggaggcuuaacgaaguagugauggagggcaugagaaauauuagguuugaaaauaaagaagagaccuaaggaaagaauuggaugugugauagaagaaaaagugaauggucaaggaugacucaggauuuuuacaaagcuuccacuuugugugaauuguggugucauuuacugcaauaacgaaggagaagcuucuguggguguaggugaaaugaugacuaccauucuggaaggguuaaauuugaugcuagaagcuaaggaggaaaaaucaguaacggggaauguggggucccaaaugcuagguggagaaaacuuuucacagggccuaaugcugaggauugcaggggccaaucaaaacagaaaaucgagcuuuaaauuugauaagaaggaggcauuuaauaaccuugagaaagcagggucaaugaacuggugggaaaaaagucauaguggauaguucgaggaggguaugggaacugaggagcugggacaccaagcauaaccaacuuugagaaauuucugucuucaggggagcagagaaaugggugggugcuggugaugggaauccaaagaggugguuuuguuauuuuuaauaaugagagauauuaaaugagagauauuaauaagaggaccucacuuuagaaaaaaaaugauggugcagaaagagauugagauaggagaauuuaucaagugaagucugugauuaugcgaggaugagauccaccgucuaagugaagauguugcuagagauaugguuucuccgugguaauggaagggaggaaaugauaugggaacaguagaacugggagguauucuuucccaauugcuuugauuuuuauuaguggaauaauagugaggcuauauauagcugaagugagugacaaagcagugaaaaauagaagucaauaugaaauauaggcuuaccccacagucacguaaauaguacguauuucuuaauaaaaugcuuuuggcuaauguuuguaucagaaaaauuuauauuugcauaacugaauauuuugcuuuguguuuauuguuuuacccaacuuauuuugaacauguucaaauguaaagaaaaguuaaagaaugauaaaaaggaacagcuguauauccauccauucagagacuugcuaauguuuuaccacauuugcuuucucucucucugccuuucucuuuauacacacacacacacacacacacacacacgcacacacccuuuuuuuuugguacuuuugaacaguaaguugaaaacaucaugacacuucaccccuaaauacucuagcaugauuuuccaagcaugaaggcauucuucugcaaaaccacaauacuaugaucacacuuaagaaacuaauaauguuauacucucaucucuuauccuagcuaaauucaaauuuuucucaaugugcuauaaucugauggcaugugccuuaaggaacugggguuuuugaggaaauagaaaaugguuuggaaguggcaaugaggaucaaggaaggugauaauuagaaguuuguaucucuaucuaucuaucuaucuaucuaucuaucuaucuaucuauccauccauccacauacauauggugacaaauaauucauugugaauuacugauucaaaauacaggaauaaauauaugggaaauuuaaaguguccucaggaaggagguaaccacaugugugaauaauuaucuagagcauuuccagacuauugcauugcauugacuaguacaaauguugaaguaguuuuggacaaacauaauuuugccaaauuuucauuuugcuaaaaagaacaggcauauaaaacaaaucaacaaacaaagauagucuauuucaucuauuauauucaugauauccugaaaaaaaggaacauuuuaaugccaaaaaauagaaaguauauauucucaggauaauuaaagauaauuuugaggguguuuuguuguuguuaagcuuaugguagugucuuuauuuucuucauuucuuuuuggaucugugaaaauuauauugcugacuaguguucaagaaguacacauacagagaauuuucuggaaauggggcccaagaaucucugucucucucuuucucuuucugugugugugcauguauuuuuaugaaaagcugaccagguuaaccugaugaucagccaggcuugggaaugggauugugaguguugcuggcaucagcuccuugguuacccuguggggacaguggaagaaaagcucuuguuugguccugucuauuuuuaugccggagauccuguuuggagggagggacugggaaagccucugucucuugcuuaacucuaacuucugugagaaccauccagcuccugugcuggccuuugguuacuauccaccuagcagccaagcaggcccuggcaggguggccacuacuguggcguuuaauuugagcaugaggcugaaccugccaaguagagguuggacugugacugcagaacggcgccuucucucacaguagaagucaguuugucguuauggggaggagugcucugaaaauauuucuagacuucuccaaaauuuuuaacuaaguuacugaaucagaaucagacaacuaucuauuuuuuacuguaacuuuuuugugucuguguggcauauacaaacauaguagacaucaaaaccaaaauuuuauagagcggugucuuaugacaucuuuaauagcagccucucccucccugcuuuuuaaaagugaaaucuuaaugggaagugcaguuaaaaagaagaaaauggacauuuugauugcuucuagggguuuuuuuuuuuuuuuuuuuuuugagacagagucucgcucuguucccuggguuagagugcaguggugcgaucucggcucacugcaaccucugccacccagguucaggcaauucucccgccucuaccucccaaguagcugggacuacaggcaugcaccaccaugccugguuaguuuuuguauuuuuaguagagaugggguuuugccauguuggccaugcugaucucaaacuccugaccucaggugaucccccugccguggccucccaaagugcugggauuacaggugugagccaccaagacugacuggcuucuagauuuuuuguuuuugcuuucuuuuuucuuuuuuccauuauaaguagugcuacauuaaauuuacuucauauaugugcuuuuacuguuauagauuagauuccuacaucugggauuacagucaacaguuaugcauugucaaaauuauaauagcuauuucgagauaagaguauuauccaaaugugguguggaaucccagucuuaagauuauuuucauuacugcuuauauuccacagcguuagcaugagauguaugagauuuuaucugaauuuuaaagcaugcaauucguuguggaaaguuauuacugugccuuuaaauauuaagagcuaaaacuugacauugaacacauuaacauuuguuuauuugggggaauggcuuuuccuuuguagaucgcuacucaaaaaaguagguugucugaaagucaagaaaaagcugcgaaccugaagaaagacuuggcagagaugcaggaauggaugacccaggccgaggaagaauauuuggagcgggauuuugaguacaagucaccagaagagcuugagagugcuguggaagagaugaaggugaggcggggacgaccagugccaacaggcuucaugccucccuccucccuuuaaaaccagcacaucaaucaucugucuaucugucaaacacuaugugcauguagcaucuuucacaguagguuuuugaauuaaaaaaacauaacaggguagcugcucuaauuuuagcaggggaagaaagccaggaguccacauauuuggcuuggcccaugaguugaguccaugagggcccaugagacaagcucuuaaguuagaccuuugggaggcuacagagaaugacuuaaaaaccucugguagugggcaugaggaagaaugaucauuuuuuuuuaauugggguaaauacauauaacauuggucagcuuaauuuuuaagugcacaauccaguggcauuaauugcauucaucacuauuuccaaacauuuucacaaagaguuauuuuuuguaaggggaacaaaagagaccucccaaguugucugagguuuauucuuauuuuccuguuacuaaucuuccaguuaauacauacggcacauaugaacacugacguuucauuagagcagguaggaauagcgguaggaaugcaucggggaguucauauuaguuggauccacuggauacauuuccuguaaacuuguacuccucugucgauagucuugaacacucucuuuuuauauauaauaaaagaacugggcaucauucccaaauuucuaacacagcuucaacuguccuugaauguucaagccaaaggagaugguguuuucaaagcuuuuuuuuccuguaagcuuaagcaacacagugacuaauguuuuaccucaaaguuaacuuaccuagaaguguaacuaaagcaaaaaucugugauuuuuuucaaaaaagggauuauaugacauucauacauuauuauacaugaaucaaaguaaauaugacaggagacuuguuggaaguuguuuuuucacuaaaacaucuuuuuuaguguagcucuuuuugaaagauuuaaaaauacucaguacauaagguauuuuaaaauaggcuaccauguuaagaauugucucauuuauugucuuucuuuacacuauuggcauuguaguucuguggauuuuaaaaguugcuauagaugagauuugagaaaaaugauauuuaaauauuugauugggcaacauuuuauuuauuuuuauucuuucaaacagccauuaggacuuacaaaaccacuacacuuaauuacuuucccccaaucuaaggaaguucaaaaccauuaaguaguagagaaaaguaaaggggaaagugaaagacuguuuuauuuguauuuauugccauuaaaaguaauggcauaaacugcaauuacuuuugcaccaaccugauagguugauuuuccugaaugucagauuguuuaucuuagcacugagaaacagcuauuucuggaucagaucaucucagucuaacuuuaucauugaaaugcuauuaauuagcagaaggauacaugugccuauguucuauaauuuuuuaaaaagcuuaaauuauuuagagaacuuuuaaagauacuucuaccauaguguaccucaauuuuugugaaaauauauuuaucacaguguaaucugcucagcccuccagugauaaugaaaauucacucacuuaaauucugaucuuggacccagacuuugaaaauacuucaugucaguaaacauacuuuggauaacuuacguuaacacugcuguuaugaaaugaaaacauuugugggagcugaguacauuggaugcaugagugaaauuucagaguuagcauucuuauuucaaaaacgcucaacugggcugggugcaguggcucacgccucuaaucccagcacuuugggaggccaagguggguggaucaccucaggucaggaguuugagaccagccccgccaacauggcgaagccucaucucgacuaaaaaauaugaaaauuagguaggcauaguggugggugccuguaaucacagcuucucgggaggcugaggcaggagaauuucuugaacugggaggcagagguuguagugaacaagacucuaucucaaaaacaaaaacaaaaacaaaaccccacaaagaaccauucacuguuaccuaaauaauguucuauuuuggcaguuagaaucauccagauguuuuaacuuugguuuaauucuugaaaaaaaaagaaagaaaagaaauugguuacugagaaagggagacguuuuucaaguucauccauccuuucuuggaacagagggcaaaagaggauguguugcagaaggaggugagagugaagauucucaaggacaacaucaaguuauuagcugccaaggugcccucugguggccaggaguugacgucugagcugaauguugugcuggagaauuaccaacuucuuuguaauagaauucgaggaaagugccacacgcuagagguaugcuauuauuauuauuguuguuauuauuauuauuauuauuauuauuauuauuuucagugauguauuucugagauccaaacucuguaauguuuuggccauuuucaaaucuuggagaaaacuucucuuuucuuucaaauucuggauuauaaagaaaaaauaguucuugggaaauaguuugauaaaaaugaaagagggguuaaaaacaggagaccaaaaucugucccuaauuaucagaagguucuugggcaagucauuuuguauauucaaacuuuacuuuuuuuauaggugcaauccagguuuucauguaacagaugaucuguagggccuauuccaguccaaaaauugcagagcacauuucaagccucucuuuuguuuuguuuugccugguugaguacauagagaggaauuauuuucuuuugaguggugucuaaaguucaagagucaccugaaggaaaaauagaacuuaaauaugugacaguuuuacugggucuuagauaaaauaccuuuuuuuuuucucccuggccauuacacguaaaauguagaugagucuaugaaauuuuuuuaaacuaagagugagguuuugcuuguuuguuuuuauaguaguaugacuuuuguuauugcuuguuggaagauuuaagaaggcuuucaauuuacaacaauuuaauuuacauucaauuugacguaaaacaaauauuuguauuguggcaaaucuugaaaugguaaaaaauggcaacugcaauauuuaaccuaaauucauucauuacuuugaucauucauucauuuguaaauucauucguuucuuguucuaaaccaauuuugugcuaagauaaauauauaucauugaggcaaguuaguaagaaagcuacuugauuugggaucugucugcuucuuggaaguggucuucuuugagucauuuuuucuuucccauaagaaaagagguugugcuugcaucugagcagauuuuuggucugcuuuuugcuuguggaaauugggggacuagaaccucuuuucuuuuauucuaauucaguggcuggaaaauuauggcugaggauuuuguuuuguuuuguuugagacagggucuugcucugucaccuaugcuggagugcagugguaugaucacagcucacuguaaccucaaacuccugggcucaagugaccuuccugcccccgcuuccugaguagcuaugacuccagccuugcaaugccacaccuggcuaauuauuuuuaaauuuuuuuuguagagaugggggucuugcuauguugcccaaguuggucuggaacucuugggcucaagccauccuccugccuuggccuaccaaaguccugggauuaaaggcauuagccacugcacccggacuggcugaggguuuaaaucuaacuuguaguuugguuuuggauaccugguuaacugagaauaguuuauacauuucucaaggguuguacaacacauaccccccuccaagaagaaucugugauaggaagcaaauguguccucccaaaaccuaaaauauuuacuggcuggcccuuuguagaaaaauguacugcuccuugaucugguaagcauacuucauauggagaguggaccggcaggugccuucacucauuuauguaaaccagaagaugccuccacucauucaguacauucaagacgacaagcccaggaggcauccagcugaguucuuucuccuaaacuuaccacucaaauaaguuccucuuauaauaagggauuauaaauuuauaaauguuuccacccacuacacaaccccugggucccugcucuggaaaccucagaggggaaugagugaucaaaaccaacacaguaagaacaguauaacuccaguuuugguaaaauguggcucucuuauauugacauguccucaugaauuuagaaaaaaguugggaaggcuacauugcaaacuuuuacaucaguuagcuccaaguuggaauuggguggggcccaggagauuucaauuuucuaugaaauuauuuuuuaaaaauuuacaauugggagcaauuuuuucauuuuguucaaaaaccaaacuuuuuuuuuuuuuuuuuuuuuuuuuuugagauggaguuucacucuuguuacccaggcuggagggcaguggcguggccugggcuuacuguaaccucugccucccagguucaagugauucuccugccucagccucccgaguagcugggauuacaggugccugccaccaugcccagcuaguuuuuguauuuuuaguagagaugggguuucaccauguuggccaggcuggucuugaacuccugaccucaugugauccaccugccuuggccucccaaaaugcugagauuacaggugugaaccaccgcacuuggucuuuaaaaaacaaacuaaauaauguuucucuccuguuuuucuuacuaauuauauaguucuauuuuugacauuuaaaucagaucauggaauuuauuuuaaagagugaggcagccucuugcccacucuuugcuccccacccuucaccaacuggucucauaugauuuuguugauuauuuuauuuuauuuuauuugagauggagucuugcucuguugcccaggcuggaaugcaguggugcaaucucagcucaccgcaaccuccgccucccggguucacgccauucuccugccuccuccagaguagcugggacuacaggcauccgccaccacacccggcuaauauuuuuauauauauauauauauuuuuaguagagacaggguuucaccguguuagccaggauggucuuaaucuccugaccucaugaucugccugcuucagccucccaaagugcugggauuacaggcgugagccaccacgccuggccgauuuuauuuuauuuuuuugaaguuucaacuccaucaguucugaauuccuagguauacucacauccaaaugaaauuauuagcgauuaaagagaauguguaguacuagagauacgaugugugaaauggcuuuuugucuaauuuaaaauuuuucaugcuuuaggaggucuggucuuguuggauugaacugcuucacuauuuggaucuugaaacuaccugguuaaacacuuuggaagagcggaugaagagcacagagguccugccugagaagacggaugcugucaacgaagcccuggagguuggaacccgugaucuccacggcauuucucuuugcugugaugaggccacacguguauuacaaugaggaauguaaugcuuuacgcaggcaaaugcauuugcuuccucagugguuuucaaugucacuugcauuuucuuccauagccugaaguguuuauacaaucauguguauuuagauuauuggugacccauuauaucagccucaagacgugguuagcuguuugacaucuuacauuuuagacauguugaagcacucuagugguuuuccaguuuauuuuaguaggcccuggacaaagcucugccauauguuauuaggacaacugcucucuuguuucaucaacaaguuauuuuuacucacuaaacacagcacugacaguuuauaggggauuccugucucuuaccuucagaugcuagaaguuaagacagugguugagccaugggaucuugucguaggagcuugucuucaagccuggauuugaacuccuugaggccaagaaauguacccgaugcuuuguuauuccucaguucccagcacaguguguagcacauguuaacuuaauaaccguuucuuaaaugaaauacagugcaaagaggguagguuugcuuaacaaaaaagaaaagggaaggggguagauaggcuuuuaaaaaugucaugguaccaugugggaacugaguggacaacuggauuaaaggucagaaaugaguaaaauguggcacuuacauuccaggagacggaugcucugcuagagaaaagaugucacuucucaaauauagcagagugagagacagagugaaugaaaaauaugaaaagcuuaauuuuuuuccuaauguaagagugaauacguauauauucuugaaauauggaaaauaaagaaaaguauaaagcaaacucuaagauaaacauuuuaaaacaguuuguagauuucuuccuaauuauuaucuuuuauguaugcauacuagaagguaguauauuggaucaaaggcuuuggagucuuuuauuuacuuauuuaucuuuuuauuugagauggaaucuugcuauguugcccaggcuggagugcaauugcaugauuuuggcucacugcaaccuccaccuccugaguucaagcaauucucaugccucagccuccugaguagcugggaucacaggcgugugccacuaccccagcuaauuuuguauuuuuaguagagaugggguuuuaccaugucggccaggcugggcucgaacuccugacaucaggugauccacccgcuucggccucccaaugugcuaggauuagaggugugagccaucgcacuuggccaggcuuuggagucuuaaagcuuuagagccauguuggaaucuuagcucuucuuuugacuguguguauguaggcaaguaauuuaaccuuucugagcuucaauuuuccaaucuguaaacugggaaugcuauuuagcccauaugguuaauuagauuuauguauauaaaaaguguguauauaaaacaaugccucuuauucugcauauauuguaggaaaaugacuacuuauuuuuaguaauauaauuaauaaaaguugagaucauuuugcuuguauaguacuguucucugccuuugaacuuugugucaugagcauuuccccauauaauuaauaauuauuuuuaacuuuuuauuauucauuuauuuauuguuuagagacauagucucgcucuguugcccaggcuggaguccagugguaugacagcucacugcagccuugaacucuugggcucaagugauccuccugccucacccucccauaauuaauaauaguugaaauuauuuuugugaaauuauaucauauaucacuugugcuaauuucucaauuuuaugcauuuuuuaaucccaugauggauauuuuugugaauuaguaauuuacuuaacuuuugguccuguuacuuagguagauuuuuagaaaauauaauuacuuguuuaacaaauagacauuuuggggauccuugauaccuuuugccuuaguaaaugcauuauuauuuuuuuuucccaucuccauuccagucucuggaaucuguucugcgccacccggcagauaaucgcacccagauucgagagcuuggccagacucugauugauggggggauccuggaugauauaaucagugagaaacuggaggcuuucaacagccgauaugaagaucuaagucaccugguaagaguugggacauacauggguguugauuagguauugaugaaguggagcuggcccuaagcuccauaucauagagcuuuaauguuggaaaaaucuuuaauguugguuaaaguugguaaccaaugcuaacaggggcauugaggguauugaaauauucagaaaggaagaauagaucuaacacucuaagacagaacuggaugauuaaaaaaauuauuuuugagauuacuucuacuuacaaacauuuaauuuucauuaaggaucauaugauagcuguauauaagaacaacaacucauacuauccuaguaaauauuagggccaugauauuucacauaagcugcugugaaagccauagucucuuaguucauauccagguuguaacauacauauucguaucacaaauuagagaaagaacauuucuuuuauaggaagguuggguaugaauauuaggugcuuccaaacacauauuaaauaauaacuguugauguucagcccaugaauaacaucaagcuuaacccaaaagugcuguaaauaguaguuugauauguauguacaccuauagaauuuguuuuaggcuuuggaaaaaaagagacucugauguuuguguauugauagacauuuuucuuauguuuuauauucuuaauuggcagacauugcugauuccuaaaaaugcuuuaaaauuauaauaaauaacacauuuuuaucuucuguuuaaugcaucuuaugggaaaccuuuacauuuuuguauuucaacauuauauauagaaagaaguaauaauuaguaauucagcugcaugguacauaagauccuagugggacauuuucacuguuaucauuaguaauuauuauuuauuuauaaagaaagcuaaagucuuggaugaaagcuuuuauggucuuuucuuaguggccagaauauauauauucugcuauuuauauuuguguugggcaacuaaugauucaauuucuccuuugugcaggcagagagcaagcagauuucuuuggaaaagcaacuccaggugcugcgggaaacugaccagaugcuucaagucuugcaagagagcuugggggagcuggacaaacagcucaccacauaccugacugacaggauagaugcuuuccaaguuccacaggaagcucagguauugccgugcauuugagggcuuuugagcuguaaagagagcuuuuguaauugccuccucaacuauaagagaaccccuccugcucuccaaaaccgagagucaaugggaaagauugaccuuacuuacagggcagcauuuggguuuuggaguucucuugcuuucuaugugagacucuggcaaaagucuuauauaguuuauuuuauuuuauuuuauuuuauuuuauuuauuuauuugagacagaaucccacuaugucacccaggcuggagugcaguggcacgaucuuggcucacugcaaccuccgccuccuggguucaagugacucuccugccucagccucccgaauaacugggacuacaagcacgcgccaccacgcccggcuaauuuuuuguaguuuuaguagagacgggguuucgccauguuggccaggcuggucuugaacuccugacuucaagugaucugccugccucggccucccaauaauuuuuguauuuuuaguagagacgggguuuugccauauuguccaggcuagucucaaacuccugacuucaggugauccaccuuccucggccucccaaaaugcugggauuacaggcgugagccacugugccuggcugaaaaguccuguauauuuuaaauuguaguuuucuuagcugugaaguugggacaauuccuuccuuauaaauaaguugugaacauuagaaacgacaaaugcaaagcccuuagcaggugcgucauguacaauagucauaccaugcagugggccauauuauuauuauuauacaaaaacguauuauuauuauuuuuuagacggauucucacucuguugcccaggcuagagugcaguggcgcgaucucggcucacugcaaacucugccccacagguucaagcaauucuccugccucagccucccgaguagcugggauuauaggcgcccgccaccgugcccagcuaauuuuuguauuuuuaguagagaugggguuucaccaucuuggccaggcuggucuugaacuccugaugucgugauccacccgccucggccucccaaaguguugggauuacaggcauaagccaccgcaccuggccuacaaaaacuuauuaaagcuucuguggaggucaacauuauguaaaauacgauaucauguauuacacaacgauauagaacuuuuguauugucucuuuuuauacuuaaguaaaaaaaaaaggacauccucuccccuuuccaaucucuuuuuagaaaauccaagcagagaucucagcccaugagcuaacccuagaggaguugagaagaaauaugcguucucagccccugaccuccccagagaguaggacugccagaggaggaagucagauggaugugcuacagguaaagaaggccaggagcuuccuuuuacuuuucaacuuguugggaauuuucuucaaaaaagagaaagaauugauuacuugggcaccguuuguauucuuugugauguaaaccaugggaugggagugaugauguguugaagguugcauccuagggcagcagaaacaaauuguugcauguguggaaaaauaugaaaucugauuuugauagcugagaugagaaacaagagagugagccagauuuagaaguuagcuuuauauacacuuuuucuuuaaugcagagccucugucaguaucguguggcugaugcugugggcaggccgagcaugaauuggaugcagcaucauuuaguucuuucaugguugauaugacauugacuuucacucugaacuugugaugaagggcauuuugaguucuagguuccugaacuaucuuuuugaacaugaaguuuuaauuccagugaggucagcuuuaucuaaauuucuuauccaaaucuauuacuucugagauugagacacugaguguuguaauuuuugacacugggcuaugcaguucacuuaggugaucggguacccucacugagauucauuaggaguuuuuuauuuugggucauauuucugaauuuuuuucuuuugguacuuuaugguacaaauuuuuaguaguaucuguuaugcucaugaugagagagauaaucauccugaugggaauugcauauuuucauuucugcaaacagaggaaacuccgagagguguccacaaaguuccagcuuuuccagaagccagcuaacuucgagcagcgcaugcuggacugcaagcgugugcuggauggcgugaaagcagaacuucacguucuggaugugaaggacguagacccugacgucauacagacgcaccuggacaaguguauggugaggcuuuugggugauuggcacauccaguggcuuuuucagcagcuguuauggcuuggucuagcaaguacaugccuaguguguccagugaucacuagucuacagugugcuaaacauaaggauugaugauggaaaacguguuaaaaaauaagaaguguggucuuucccuccaaagaaauuagaagagauaagagagauagcuaaggaaacuagaauagacauguauauaacaugaugacaaaaaccaaaacaaaagaaauacagcuuaaucaccaugugaaguuaggagggcuucagcagagugugacuaauaagcaaaguuuucaaggauaaauuugaauuagcuagaagaaccauacuuagaauggauaucguaaaaauuccauuuucuaggaaaauaaaaauuucaauagaaauuuaaaccuuaagauaggaaagaagaaaugauauauaaggccuuauuacuuuuuuagucuugaacuuuauaauucaauugaauagaaauuuaaaaauaauguggcuaaggggacacaaucuuagaauuaguguucugcuugagaaucacagaacuuaagaugagacucuuuaggacaggagagguauagggacaguucuuugugcuuuucaaaacaaaggauaaauuuuaauauauaugugcauguauguaaguauuuauuugauuauugugacauaaugguaaucagagaaagugcuguccuugacuucauggaacauacauaguucaggggucuguuacaugacagcguccuaugagauguugagaugaugauguauaggugucaagagaagcuguuuagaauaaagcuuuuugguuucagguaacuaggaagaagacagcucugaauuugaccuacagaacuacgauuucuuuuuuuauauuuaaauuuauuuuuauuuuuaauuuuugaagacuuuuagguucaggaaguacaugugcacguuugauacauggauauauuguaugaugcugagguuugggcuucgacugaacccaucacccaaauaauaaauguaguacccaauugguaguuuuucagcucuugccccuuuccuccuucccuccuuuuggagucccauugucuuugcuuuccaucuuuaugugcaugugugcccauuguuuaacucccacuuauaagugagaacauuuaguauuugguuuucuguuccugaauuaauuuacuuaggauaauggccuugagcugcauucaugcugcugcaaaggacaugauuucauuuuuuauggcuguguaguguuccgugguguauuuguaccacguuuucuuuauccauucccccauugaugggcaccuagauugaugacaugucuuugcuauuguguguaguggugugauaaacacgggagugcauguguccuuuugguagaacgauuauccuccuuuacuuauauacccaguaauaggauuucuggguugaauaauaauucuauguuuaguucuuugagauauuuccaaacugcuuucccuaggggcugaacugauuuacaauccuaccaacaguguaugguguucccuuuucucugcagccuugccagcaucuguuguuuuuugacuuuuuaauaauggucauucagacuggugugagauaguaucuuauugugguuuugauuugcaucagaaaucuguuuacuuauaguuauauacaucuugauauaucgaguuuuguauuuuuuaucauacaaauuauauauguucauugugguagacuuaguacuucugagaaauagaaauaaauguuaauaauuccaaauccaacagacagcaguagccaguguuggcuuguuuuagucauaacaugcaagauuuuuuaaaaauguaauuuuaauugugauaaacauucuguuuuuaguccuaauguuuucccauuuuauguaggaaaaauauuuauauuaucaaguacuuucauaagcauuugucugagauuuugaaagaaugagcauaaacucuauuaguuuauuuucuugucagauuugaagaaguuauuacaagcuugauuucauuugacucgaccuucagaccaaaucugagaaagaugauggccuuugaucaccauaguuaggucuuggcugucaaucuguguaagcuguggucugacaugaugccaguuggcaaguugucaccacaguguguaauuugucuuuuucuuuguuuguuuuaaagaaacuguauaaaacuuugagugaagucaaacuugaaguggaaacugugauuaaaacaggaagacauauuguccagaaacagcaaacggacaacccaaaagggauggaugagcagcugacuucccugaagguucuuuacaaugaccugggcgcacaggugaggagagcagccccacagcucaucucucugucucucucucucucucucucaaucucucucucucucucguucucucucauguauuuuuaaauuucauuuuuuggaaaaugcauguuugaaaauuaugagauucauacguguuuucaauuuauuguaauaauuguuauauuucuuuaaauguaugugguaauauuacagugauucauaguuacauagaaauuuauuuuuggcuaggcacaguggcucacgccuguaaucccaggucuuugggaggcugagucagguaauggcuugagcccagggguuugagaccagccugggcaacaugaugaaaccuugucucuacaaaaaaauacaaaugaaaaccuccaaaaacaaaacaaauuuccaaaaaaaaauuagccaugguggugaguaucuguaguccuagcuaccugggaggcugaggugggagagcugcuugaaccugagaggcagagguugcagugagcugagaucacaccacuacacuccagccuaggaacagagugagacacuguuuuuaaaaaaaauuuauuuuuaauauuuaauucaggcuaauauuuauacuuucaauggcuacugauauuccauaaauuauucuaaggauacuacaaguaauauauguucauugugguagacuuagugugucuggaauugguggguucuuggucucacugacuucaagaaugaagcuguggacccucguggugaguguuacagcucuuaagguggcgcaucuggaguuuguuccuucugauguucggaugugcuuggaguuucuuccuucugguggguucauggucuuccuggcucaggagugacgcugcagaccuuugcagugaguguuacagcucuuaaggcagcgcaucuggaguuguucguuccucccagugggcuuguggucucgcuggcuucaggagugaagcugcagaccuuugcagugaguguuacagcucauaaaagcaguguggacccaaagagugagcaguagcaagauuuauugcaaagagcaaaagaacaaagcuuccacaguguggaaggggacccgagcggguugccacugcuggcucgcgcagccugcuuuuauucucuuaucuggcccuacccacauccugcugauugguagagacgaguggucuguuuugacagggcgcugauuggugcguuuacaaucccugagcuagacacaaagguucuccauguccccaccagauuagcuagauacagaguguggacacaaagguucuccaaggccccaccagaguagcuagauacagaguguugauuggugcauucacaaacccugagcuagacacagggugcugauugguguguuuacaaaccuugagcuagauacagagugccaauugguguauuuacaaucccuuagcuagacauaaagguucucuaaggccccaccagaguagcuagauacagaguguggauuggugcacucacaaacccugagcuagacacagggugcugauugguguguuuacaaaccuugagcuagauacagagugccgauugguguauuuacaaucccugagcuagacauaaagacucuccacguccccaccagacccaggaguccagcuggcuucacccaguggaucccgcacccgggcugcagguggagcugccuuccagucccgcaccgugggcuugcacuccucagcccuuggguggucaaugggagugggcgccguggagcaggggguggcacucaucagggaggcuccggccgcacaggagcccauggagggggugggaggcucaggaauggcgggcugcaggucccgagcccugccccgcaggaaggcagcuaaggcccggugagaaauugagcgcagcgccggugggcuggcacugcugggggacccaguacacccuccacagccgcuggcccggugcuaagucccucauugccuggggccggcagggccagccugcugcuccgagugcggggcccgccaagcccacccggaacuccagcuggcccacaagcguggcgcgcagccccgguucccgcucgcgccucucccuccacaccucccugcaagcugagggagugggcucuggccuuggccagcccagaaagggguucccacagugcagcggugggcugaagagcuccucaagugcugccaaagugggagcccaggcagaggaggcgccgagagcgagcgagggcugugaggacugccagcaugcugucaccucucauuaguacuucaaagaaauacaagggaaaaaauaaauguuaauaauuccaaauuucaauggauagcaguagccgguguuggcuuuuuucuagucgcaacauguaagauuuuucuaaguguaauuuuaauugugagaaacauucuguuuuuaguccuaauguuuucccauuucauguaggaaaaaugggaaauaauaaucccuguaaaaacucaaguuguugguccuuagauuucuaaauugaacagucuaccgagaaauguuaaaacaucagggcucuaguaaauaaccaguggcaagaaguucacauuaaucuaccaggauuugaaauccuggcaagaaauaucucuaauuugggcauuuuagugaauccaugcaggaguuguugagcauuuacugugagugaaugaauuuuugcccugaaaccaggagagcaaagaauguguggaagugugaaaccuuaauagguaauauugaaaacccauguuugauaguauuuuggauccuccuucaguuaggaaauauuaacuacuuccaguugagguaauauugaaguuucuauauaagcccagagaaaaauagcugaaauuuuguuuucaguugaaaucagaacgaccaguuuauacuuuuucugggugauuuugaucucacuucugcaagcuuagauuguugaugugauacauuuugauguauuacaugucuggaacacacaccuuagagcuucuuuuuggaauuauacagcugguuauucguuaaauauuauuauauuuauucacugacugggcauuuuaugaauggaaugguauugcugguuuuugcacuaauucuccaauugugacuauaauuuuaguauuaauuaauuuuaucauuuaaaguuucacucaaucgagauuuuacucugugucaggaauuauacaaggagacagugaugaggaaagauauaaauuaucucguugucuaauggaacuuaggguagugaaagagaaaaacauugaguaguuacaugagaugaugucacauuaucagucugaagaguuaugaagaauguacaugguucuuuaagaguauagguaaagggggguuucacccagucuuguguuaggaaggcuucccugaggaggugaugcauaagccgagaucugaagucuggguaggaguaaccugggugaaacgaggagauuucuagacugauaaaacaguauauauaaaagcucuaaggcaggaggcagugugguacauuuauguggcuagagcagagagagccagugugaggaacauggugcuagggagauaggauuagacaaaauccugccaaugucauagaguuuguguuacagauuaaaaucugugucuuaagcaguuacugcacagguuuuaguaggcaaauuacauacucagauaugucuuuuaaaggauuacucacugcauuuuggaagaggaauuggagggaggcuggaguggaugugaggagacugguuucgaagucauuguacacuuggugagagauggucguaccuugaacuaggauggagaguggagauggagugagugaauugauuucagacauauguaggaagugaaaucaacaggacuugguccaggaggagagaugaaggaugaccccuggguuucuggcuugaugauguggaugguguggccauugagaugggugcuguaagaaaagauagaggaccgggugcggucgcuuaugccuguaaucuuugcacguugggaggccaaggugguggaucaccugaggucaggaguuugagaccagccuggucaacauggcaaaaacccgucucuacucaaaaaaaaaaaaaaaaaauuagcugagugugguaguaugugccuguaaucccagcuacucgggaggcugaggcaggagaaucacuugaaccugggaggcugagguugcagugagucaagauugugccacugcacuccagccugggcaacaagagugaaaacucugucucaaaaaaaaaaaaagguagaagcaugcagaaaucacagguauguauuggacauguugacauuuuaaguaccuuugagaauguuaauuggaaaugucggguacucacaugauuauucaggucuggagaauauaucuggacugaagagguggauuuuaugagucaucugcauagaggucauaauuaaaguaaucagggaugauagauugucuaggaacaggauauagugaaagaagagggcccucaaccaagucuuaagaauuacaucauuuaguaagaaaucucaggaagaugagcuugcaaaagaaacuaauguaaguagcaagaagugguagggacacaguugaguacuaggucuggaaagcuaggggaagaugguauuuugacagagugcaguuaccuguuuuggauauuuugaaaguuaaauaugauguccacauaaacauauuaauuagaucaguugccauuggggucauuauugaacuuagcaagggcaaugucugggagugauggugguagaagccagaauggcauggcucaauccaaagauuguaccacccuggccuuggccuuaaccucuuuaaguuucauuuucauuauccauaaaguagaaagaggcuuugugaauuuuauugcauacguguguaagauuccuuagcacaacacggaagcuguauuaagagcuugguaaauguuaguuaaguucauuuguuuucugucaacaacaaugagagcaaaauaauaauaagguuugguuuguauagucguguacugcauuuuaaguuaaagugguuaauuauaaaacauauaauugugaaaauggugcuauuuuccccucaaguuacuauaauaccguauuuuuccuucauggagaggauucuaagauaucuuauguucaaaauuauaauagauacuagugauuuuucaacuuuauuucugcccuuuuauguguguuuuucucgcuuaauacacauaacaaucuuuuuuuuuuuugagacggggucuugcucuguugcccaggcuggagugcaguggcaggaucacggcucacugcagccccagccuccagggcucaagcgauucucccaccucagccuacugaccagcuggaacuacgagcacgcaccaccauacuggcuaauuuuuuguauuuuuuacaaaaugaggucuuucauuuuguagaaaaugaggucauguuucccaggcuggucuuaaacucuuggacucaaaagauuugccugccucggccucccaaagugcugggauuauagacaugagccacugugcccagccucauaccaaucuuuugagggcuauaccucugccaguaucacuuaggaaauuaaugauagagcuaagaugaaaacccaggauugccuggcacuuaaccacuacagcauauugccuccuugcagaaaugcaagcuuagaggauucuaaggugcuaagacaaagguuauguaugucuuggggguuauauaugaaucaguuuggaucuuuaguuaacauucugauucauucucauuuauguucauucccaucucagucucagucucucccugccucucuccgucucaggugacagaaggaaaacaggaucuggaaagagcaucacaguuggcccggaaaaugaagaaagaggcugcuucucucucugaauggcuuucugcuacugaaacugaauugguacagaaguccacuucagaaggucugcuuggugacuuggauacagaaauuuccugggcuaaaguaaguugcaguucagaugaaacaccagcaugaugccagcguaacauggcauuuguucgggcgaccugguuggauaccaugucccuccauuuuauauuaaaucuagccuuuucuuuuuugcauuguuuuuccacuucucuguccuaagaaaaaauauuuuaaaaauaaugauuauauuuuauuuucuuuauaauuucuacuuuuagauuaagggguacacauauagguuuguuacauggauauauuguguaaugcugagguuugggguaugaaugaucccaucacccagguagugagcauaguacccacuagguaguuuuucagcucaugccucccucuguuucucgccccucuacuaguccccaguguuuaucguucccuucuuuauggccuugcguacccaauguuuagcccccacuuguaagcgagaacgugguaauugguuucccauuccugcauuaauucacuuaggauaauggccuccagcugcaaccauguugcugcaaaggacaugauuucauucuuuuuuaugguuguaugguacuccaugguguauauguaucacauuuucuuuauccaauccaccauugaugggcaccuagguugaugacauguccuugcucuugugaauagugcugaugaacauaugagugcaugugucuuuuugguagaacaguuuauuuuccuuugccuauauacccaguaaucagauuucugggucaguaaucagaauucuguuugaaguucuuugagaaauuucuaaacugcuuuccacagaggcugaacuaauuuacauucccaccaacaguauaaaaguguuccuuuuucucugcaaccuugucaacaucuguuauuuuuugacuuuuuaauaauagcuauucuaaauggugugagaugguaucucauugugguuucaauuugcauuucucuaauguuagugauguugagcauuuuuucguguguuguuggcugcuaguauguccuuuuugaagugucuguucauuuuauuugcccacuuuuuaaugggguuauuuguaaaacagcucuuuuaauaagauauuuuuauccugauuccaaaagcauuacauucauggaucaucaaggccuuuauagguauuauuuuuauauaguacuuaaaagccuaauucaccaccuuuaaaaucaaugacacauauuuacagaguguuuacaaagaauugugcugaguuuaauucuucuuuaauaacauuuuaaaaccaauaaguaaucuuucuauugcaaacuuucagauguaaagaacuuaggaauagaauuuuaaaaaaucaauacaagaguuuucuuuaacccuguacuuugaaaucacagagauuagaaaguugauuugcugguucuggcuucugcaguagagaaagaauugaauggaacaugagugguucuuuuaacaaggcauucuguuuuccuaaaucucuuuccugagaaagaagcgaguauacuagugggaagugcugaauauaaaugaucaauacugugacugauguuuauauaaagccacaaguaucaguuugacacccucuacagcucuacacguuugcugugggccuugaggagaaggugcugagagguuguggggugacacaacuccugcuuacuuugaaugcucuguggagaugacagcugggagaaaguuaagauaguagacacuggaaagacuauucucaguuuagaaaaaagcucaugaaaagcgugaucaugccaugagcagugugaguguaaaggaagugaagaaaggaauguaugagggaaaugagcauugcaagucaucgguguguugugguugaaugcaaaacaaaggcaccaaacuuuauuguuguuaaauuuaaguuuuucaaggacauauuaucauccucgugcaguauacuuugaaaaucauuacuuuuuaaauuaguaacauaaguaauagaagcuauuugaaugaaauuugccuaguguaauacaaaaaaacaggagcaaaaaucaccuauaaucaaacaaugcuauuuuuuuucauuuuuuugagcacauuucgaugugcacaugcaaaagcauauauuuaaaaauaaauuuuguuguaacuaguauuuauugaccuucuuuuaaaaacuuacaucuuuggcauuuuucuuuaccuauacuuguuuuuauauagcauauuagagauaugcauaguauuucauucuuaauuuuuuuauuuucucauuucucuauucauguccauuuaaauuauuaccauuuucauuauuauagauaacgcuauggugaauauauuaaaccauaucauacauucauaauuauuuccugaggauaaauucuuaacccuaaaaguauugaucaagggacaggaauauauccauuuuuaagucuuauacauauuaugcaauuguucuucagaaauagugcaccuaccacaugcgaaugagaauuucuacuugacaucauguuuugguuauuuaauuagaacauuuuugacaaguuuauaggucuucuauagcgcuguuaaaaauaccgcuuuuuacucuaauucugaccauuuuuuaucaccaaauuggucuuuuaauuuggagcuuuuuaucuguucugauuaucaaugcuuagugaguuguguuugauugcaaacaaauuuuuuuauuacuguagcuuccuuuuuuguuuuuuuaaguuuuauuuuuuuuuugaaaaaaaguaaauccuucugaauauuuuuuaaugaacaaaauccaucuuuuucuucauuauuucugccuuuagugcuuagaaagaccaccucaacuccagguucauuuaauuauucacuuuuuuuuucuacuagcuuuuuuccuuuuuuuuaauuguuauacuuuaaguuaugggauacaugugcggaacgugcagguuuguuacauagguauacacgugccauggucauuugucucacucaucaacccgucaucuacauuagguauuucuccuaaugcuaccccuccccuagccccccagcccccaacaggacccagugugugauguuacccucccuguguccauguguucucauuguucaauucccacuuaugagugagaauaugugguguuugguuuucuguuccuguguuaguuuacugagaaugaugguuuccaacuucauccgggucccugcaaaggacaugaacucacauuuuuaauagcuacauaguauuccaugguauauaugugccacauuuucuuuauccagucuaacauugaugggcauuuggguugauuccaagucuuugcuauugugaauagugcugcaauaaauauacgugggcaugucuuuagaguagaaugauuuauaauccuuugaguauauacccgguaaugggauuucugggucaaaugauauuucugguucuagauccuugaggaaucaccucuuccauaaugguugaaauaauuuacacucccaccaacaguguaaaagcauuccuauuucuccacauccacuccagcaucuguuguuuccugacuuuuuaauaaucgcuauucuaccuggugugagaugguaucucauuguaguuuugauuugcauuucuguaaugaccagugaugaugagcuuuuuuucauauguuuuuuggccacauaaaugucuucuuuugagaagugccuguucauauccuucaccuacuuuuugauggaguuguuuguuuuuuucuuguaaauuuguugaauuuccuuguagauucaggauauuagcccuuugucagauggauagauugcaaaaacuuucucccagucucuagguugccuguucacuaugcugguacuuucuuuugcucugcagaagcucuuuaguuuauagaucuuauuugucaauuuuggcuuuuguugccguugcuuuugguguuuuaaucaugaagucuuugcccaugccaguguccugaaugguauugccuagguuuucuucuaggguuuuuaugguuuuaggucuuacguuuaagucuuuaauccaucuugaguuaauuuuuguauaagguguaaggaagggguccacuuucaguuuucugcauauggcuagccuguuuucccaacaccauuuauuaaauagggaauccuuucccuauugcuuguuuuugucagguuugucaaagaucaguuaguuauagaugugugguguuauuucugaggccucuguucuguuccauuggucuauauaucuguuuugguaccaguaccaugcuguuuugguuacuguagccugauaguguaguuugaagucagcuggaugccuccagcuuuguucuuuuugcuuaggauuuucuuggcuauaugggcucuuuuuguuuccauaugaaauuuacaguguuuuuuucuaauucugugaagaaagucaaugguagcuugaugggaauagcauugaaucuaaaaauuacuuugagcaguauggccauuuucacaguauugauucuuccuauccacgagcauggaauguuuuuccauuuguuuguauccucucuuauuucauugagcagugguuuguaguucuccuugaagagcuccuucacaucccuuguaaguuguauuccuagcuauuuaauucucuuugcagcaauugugaaugggaguucacucaugauuuggcucucuauuauugguguauaggaaugcuugugauuuuuugcacauugauuuuguauccugagacuuugcugaaauugcuuaucaguuuaaggaguuuuugggcugagacugugggguuuucuaaauauacaauuaugucaucugcaaacagagacaauuugacuucuucucuuccuauuugaauacgcuuuauuucuuucucuuuccugauugcccuggccagaacuuccaauacuauauugaauaggaguggugagagagggcauccuugucuugugccaguuuucaaaaggaaugcuuucagcuuuugcccauucaauaugauauuggcuguggguuugucauaaauagcuuuuauuauuuugagauauguucaguuaauaccuaguuuauuaaguguuuuuagcaugaagggguauugaauuuuaucaaaggccuuuucugcaucuauugagauaaucgugguuugugucauugguucugcuuaugugauggauuacguuuauugauuuguguauggauuacauuuauugauuugcauugaacuagccuugcaucccagagaugaagccgacuugaucaugguggauacacuuuuugauaugcugcuggauucaguuugccagcauuuuauugaggauuaucacauugauguucaucagggauauuggccugaaauuuucuuuuuuuuguuuugucucugccagguuuuguuaucaggaugaugcuggccucauaaaaugaguuagggaggagucccucucuuucuauuguuuggaauaguuucagaaggaaugguaccagcuccucuuaguaucucugguagaauucagcugugaauccaucugguccugggcuuuuguugguugguaggcuauuaauuauugccucaauuucagaacuuguuguuggucuauucagggauucaacuucuuccugguuuagucuuaugaggguguauguguccuggaauuuacccauuucuucuacauuuucuaguucauuuuuguggaggugcuuauaguaucuucugaugguaguuuguauuucugugggaucauuggugauacccccuuuaucuuuuucuugugugugacuauuugauucuucucucuuuucuucuuuauuagucuggcuaguggcuuaucuauuuuauuaaucuuuucaaaaaaccagcuccuggauucauugaauuuuuugaaggguuuucgugucucuaucuccuuuaguucugcucugcucuugguuauuucugucuucugcuagcuuuugaauuuguuugcucuugcuucucuaguucuuuuaauuaggguguugauuuuagaucuuuccugcuuucucaugugggcaguuagugcuaugaauuucccucuaaacacugcuuuagcugugucccagggauucuguuauguuuugucuuuguucccauugguuucaaagaacuucuuuacuucugccuuaauuucguuauuuacccagaagucauucaggagcagguugugcagcuuccuuguaguugugcgguuuugagugcguuucuuaauccugaguucuaauuugauugcacuguggucugagagacuguuuguuacgauuucuguucuuuugcauuugcugaggaguguuuuacuuccaauuauguggucaauuuuagaauaagugcuauguggugcugagaagaauguauauucuguugauuugggguggagaguucuguauaugucuacuagguccacuugguccagagcugaguucaaguccugaauauccuuguuaauuuucugccucacugaucugucuaauauugccaguugggcguuaaaguaucccccuauuauuguguggaagucuaagucucuuuguaggucucuaagaacuugcuuuaugaaucuggguccuccuguauugggugcauauauauuuaggauaguuagcucuucuuguugcauugaucccuuuaccauucuguuaugcccuucuuugucuuuuuugaucuuuguuaguuuaaagucuguuuuaucagagacuaggauugcaacccccgcauuuuuuuuuuuuuugcuuuccauuuguuugguaaauauuccucuaucccuuuauuuugagucuaugugugucuuugcacaagagauggguccccugaauacagcacacggaugggucuuggcuguuuauccaguuugccagucugugucuuuuaauuggagcauuuagcccauuuacauuuaagguuaauauuguuauguaugaauuugauccugucauuaugauguuaucugguuauuuugcccauuaguugaugcaguuucuucauaguguccauggucuuuauauuuugguauguuuuugcaguggcuggaacugguuuuucauuuccguauuuagugcuuccuuugggaguucuuguaaggcaggccucauggugacagaauaucucagcauuugcuugucuguaaaggauuuuauuucuccuucgcuuaugaagcuuaguucagcuggauaugaaauucuggguugaaaauucuuuucuuuaagaauguugaauauuagcccccauucucuucuggcuuguagguuuucugcaaagagaucugcauuagucugaugggcuucucuuuguggguaaccugaccuuucucucuggcugcccuuaacauuuuuuccuucauuucaaccuuggugaaucugacgauuaugugucuugggguugcucuucuugaggaggaguaucuuuguggcauucucuguauuuccugaaguugaauguuggccugucuugcuagguucggggaguucucuugcauaauaucuugaaguguguuuuccaacuuuguuccauucuucuugucacuuuuggguacaccaaucaaauguagguuuggucuuuucacauagucucuuauuucuuggaggcuuuguuuguucauuuucauuauuuuuucucuaaucuuaucuucacacuuuauuuuauuaaguugaucuucaaucucugauaugcuuucuuccgcuugaucgauucagcuauugauacauguguaugccucaugaaguuuucgugcuguguuuucagcuucaucaggucauuuauguucuucucuaaauugguuagucuaguuagcaguuucuguaaccuuuuuuucaagguucuuagcuuccuugcauuggguuagaacuugcuccuuuagcuuggaggaguuuguuauuacccacuuucugaagccuacuucugucaauucaucaaacucauucuccauccgguuuuguucccuugcuagcaaggaguucugauucuuuggaggagaagagacauccugguuuuuggaauuuacagcauuuuugcgcugguuuuuccucaucuucguggauuuaucuaccuuugaucuuugauguuggugaccuucgaaugggguuuuugcaugguccuucuuuuuguugauguuaauguuguugcuuuuuguuuguuaguuuuccuucuaacaggccccucugcugcaggucugcuggaguuugcuggagguccaccccagaccuguuugccuggguaucaucaggggaagcugcagaauagcaaagauugcucccugcuccuuccucuggaagcuucguuucagaggggcacucacaagauaccagcuggagcucuccuauauuaggugucuguugaccccugcugggaggugucucccagucaggaggcacaggggucagggacccacuugaggaggcaaucugucccuuagcagaguucgagcucugugcugggagauccgcugcucucuucagagccagcaggcaggaacauuuaagucugcugaagcuuugcucacagcugcccuuucccccaggugcucugucccaggcagaugggaguuuucucuauaagccccuugcuggggcugccacccuucuuucagagaucagacagucuggcuacaguugcuuuucugagcugugguggguucugcccaguuugaacuuccuggaggcuuuguuuacacugugaggggaaaacugccuacucaagccucaguaaugguggaugccccucucaccaccaagcuccagcauuccaggucgacuucagacugcuguccuggcagcgagaauuuccagccguuggaucuuagcuugccgggcuccauggggaugggaucugcugagcuagaccacuuggcucccuggcuucaguccccuuuccaggggagugaaugguucugucuugcugguguuccaggcaccacuggggugugaaaaaaaacaaacaaacaacuccugcagcuagcuuggugucuccccaaucggcugcccaguuuagugcuugaaacccagggcccuggugauguaggcaccugagggaaucuccgggucuguagguugugaaggccuugagaaaaguguaguaucuuggcuggauagcaccguaccucacggcacagucccucauggcuucccuuggcuaggggagggaguuccccaaccucuugcgcuucccuggugaagcgacacccuccgugggcugcacccacugucuaaccaguuccagugagaugaaccaaguaccucuguuggaaaugcagaaaucaccugcauucuguuuuggucuugcugggagcugcagacuggagcuguuccuguuuggccaucuugccagccaccuccucugcuagcucuuuuauaguuucaucuuuuuaccuuuaaugcauuaaucuuuccaguauuuauuuugguguauuucgugagguaaggcucuaaccuucuuuccaaaaggauaaccaauuaucuuagugcuauugguugaguaauuaaccuuguccccauggauuugacaugcuaaguucauauauucuuauuuuccuguugccuuucguuguuuucugcuccacugaucuggccccaugaaauguaccaguuuuuagaauguuuagccauguuuuauaguauauuuuaacugcaguuaauggguucccucucuuuaugcuucauuuuugguauauaucuuauaugaacuuuagaauuuuuauuguuaaauucuuaaauucuauuggaaauuuugauuugaauugccuugaauucauacauuuguguagugcagaauugauaucuuuguuauauuaauucuauucgguaacauauaugucucauuuuuguccuaaauucuuucacauuccuacauaauguuuugauuuuuuucuuuauaaacauuauucauauaugcacaggaguuuauuccuacauaucuauuuuuauugcuauguaaaaauauacuuuucgguuuuuuuacagagugcuuauuguugguacauaggugauauugauuuuauauauucaauuuuuaaacauccauguucauauacucauaaauucaauuuguuuuucagcugauucucauagcuuuuuuagguaaagacucaaagcaaugaaaaauuuguuucuuuuggaacaauaugcucuuaaguuuccauuuaaucuuauuucagaauugaaaugauaaagaugauauauacaagucacaaauucacagcacauucucuucauuagaguaaaucaaaugaaacaucaguauauauuaauaaccaccaucuuuuuaucacugucuuuucagauuuaaggaacaugcagauuucaccacauuuuaauguauuugcacuuaaagauuauguaaaauuauuuucaaugcaaagcuuaaauaaauaauauuuucauuucugaauacuguuuuuauuccauaacuuaaauauaacuauuuucaauguaaucuuuuuuacuguaaaaaaguauguguacuauuuagauguaauuacuuguaguucauuauuuuuuauaguucuuaaaugcuauucuagucaaucaguacaugcccacugaagaaaugaaagauucuuauuaauaauugcugagagcauagcuauuggguauccuuuauuuucuccccccuugcuagagaauaauauuggaaaguaguauuucaguucugucauaaauaugccaguaauugacauggccaagugaguguuuaaaccuggacucauuugugaauuuguaauugguaugcuuuccaaggugugauuuaauguagaaauauaaacuugagcuccuuaaaaugauugguuuaaauguugauuuaaaaaauggucaauaauaguagcaguaggguagauacaugcauauugcuuuuugauugaaagagcuuuguaguuuuaauuguggaacucaugcucucucuauaauucugugacuauauacuuugccuggugaaacuuacgaaugugccgaucacuuuaucaucauaccauccagaguauuaucuuugcacuuaugacaguuguaagaccaaagcuuagacuugcugcucucuugugaguuacuuacaugaaauguuuuuuuguaauguuuauucaguauauuauaugugaaaucacccagcuguaagauguuauccuugcaaguaccuauaguacacaucgauaguuuccucugguaaucuaggagauaaauucauugugaauuuuuuuaaguugugaguucuaggauccuucugcuuugccagcuuguaguuacugaaaaugaaauugagccuuuacauuuagagugaugaugaagguaauuggcauucauauguaauaaauggauuuauauuuaaauaaaugaaauaauugcuuucccacagcugaguguguuacacucacugguauuuguugaauuacacauuuuguuuuccauuuggaacuuaagaauucucacuauguuaauaaguuugggaauuuuguaaacuuugacauuguaaauuauauagggagucauggacuacuuuguauauguggcagaaaaguuuuuaauaauuuaagguuguauauacuuuuauaauauucugaagcaucaaguaggucuugguguuuuuauuuucuagaauguucugaaggaucuggaaaagagaaaagcugauuuaaauaccaucacagagaguagugcugcccugcaaaacuugauugagggcagugagccuauuuuagaagagaggcucugcguccuuaacgcuggguggagccgaguucguaccuggacugaagauuggugcaauaccuugaugguaugucucaggaaaaaguaaaugaugaaaucuucuccucucuucuaguuauuuuuuaaaugaauacaacuuugauuaaauuucaaauccuguuuacugugugucacagugauguuuugcuugugaauuaauuucauuagacuagguuuuauuuuuucuuuggaaagguaauaacuagaaagaauuuacaguguuucuaaauauucaugaucugcauggaaugagguacuuucauauuuuaguaaaugcaccuuauuuguuucauuuuaaugauuucauauuguauuugauuuucguacuaucagaagcuauuuuuauauaaaaucuucauaguguuugaauaauggcauacugguuaagagcacaggcucuagcaucugacggccuauguaaaaauuuucauuacuagcuugguaacacugguaaaguuacuuaaacauucucuaaaccucaguuguuuaauuuguaaaauggacauuauuauaucuaucucauacaguuuugcaaugauugauuaugagccuuaaacauguagugcucuuaaauaacuauaugcaaaacaaccaauuuuagauuuugcuaugauuauaauuauuaaauauuguauauguguuagucuuugguuaugccacugcucuguaaauuugcaucucauggaaauaguuaccauuuaauuuuuauaugguuuuauguuccuaugauacuaauugugaauauauggccaccccacccuccccugcugaggaaggcauugucauuuauaauuuuuuuuaauucugaaauaccugagauaggacuuuuaucaaauuuauagaauuacuagguaauggauagagacauaaaaaauacauuaucauguguuugaauauuuauuuaaauuccucaggauguguagggcagugaagagcaugggcuuugcucuugaucucuaacagauuuauauccacaguccaugacuuauuaucuguuuaacuuuagcuaaguuacuuaauguuacuaagcuuaaauuuccauauauacagaaugagaacaaaaguauauaccuaacagaguuguuaaauauugaauauaauagugaauaugagauucuuggcacauagaauaugcucauuaaauauuuuauauauuaauuuuuaauuacuagcuuuauuucacauucuuauggcccuuauuucuguauucuucagucuacaccuuucaaacucuccauucaagcaguaucuuucuagugcuguuagaacauuugauuuaccugcuuaauagggguaaacaagucuggcacucaucaguucuuccuacuuagaauccagaucacuguugauauuuucucauaucauuuauuaguucacauuuucuuuuuuuaaaaauguuuauuuuaaguucagggguacaagggcaaguuuguuuuauuuuuauauuguuuauuuguucacuuuuuuuuuuuuucugaggcugggugucagucugucacccaugcuggagugcagugguaugcaaccucgaccuccccaggcucaggugauccuuccaccucagccuugagaguagcugggacuacaggcaugcgccaccacacccggcuaauuuuuuuauuuuuuguagagaggggguuucaccauguuguccaggcuggucuugaauuccugaggucaagugauccucccaucagggccucccaaaguacuggauuacaggcgugagccaccacacccagccuacauuuucuuuuuucaacuauguuucauauuauagauuaaugauuucuuucuuuguaaaaacuuuuacugucuaagcauuuuccaguuucuuuuaucccacaaaauauaauugcuaaagguuaauuucaucauaagucucguuacccuuuuuggucacacucuaacuucuugccuuagauuaacuguuuuucccagucauaaucugcuuaacucuugcuucuguuuucaaaucuguucugucaagcacauuucauguccugcuucaguacaucuugcuguggucugugccagauguaauauuaagggcuggugauacugagguaaggauacaaaggcacuguccuuugagcagagcauacagaaucuuuuucaauucauauuuucaucauuuuaaaaaauuauuccuuaaaugaguuuuuuaaaaauaugggccaggugugguggcgcacaccuguaaucccagcacuuugggaggcugaggaagguggaucacaaggucaagagaucaagacuuccuggccaacauggugaaaccccgucucuacuaaaaauacaaaaauuagcuggguaugguggugcaagccugcagucccagcuacucgggagacugaggcaggagaaucacuugaaccugggagguggagguugcagugagcugagauugugccacucuacuccaggcuggugacagagcaagacuccaucucaaaagaaaaaagaaaaaaagauugaagagggcaaaucagaucaguuguaauauaagaauaaggaauaagagaugaacuugcauugaaauugaaaaagaaacuuucaccuuuuauucuacuucaacuuuuuauugugcugaggucuaaaucaaauaaauuuaaaaaguguuaagcaccauagaugugcauuuuuaggaauaagaugaguuauucacugaagaagagcucugcaggaaggugaaagcucuccuuuaaauucaugguacaguuugcucuuugaaggucuuuuaaaucucuuuuaagauuaucaucuuaaauauuucauaugguuauguaagcauuuuauuaauuccuuuguagaaccaucagaaccagcuagaaauauuugaugggaacguggcucacauaaguaccuggcuuuaucaagcugaagcucuauuggaugaaauugaaaagaaaccaacaaguaaacaggaagaaauugugaagguagcaaacacagacaucaguaacgcuuuugggaguggcauguuuuguugucauguuuucucuucuggaaugcucuaaguuacuuagcucucauuccucccaagcauuagauucauuaacauuuauuuugaugggagaaacugagacaauaagagacaaaauaagagacgaacuugaaauugaaagacuuguaagagauuucagcacaaucaaccggaguaagaccuauucacauaagaugccaaugagucuugcugauugcugacuuuuguauucuccauugagugcugcuuacuucuguauucuccagugagucuuacuuacuuuuguauucuccaaugagucugucuuacuucuguacucuccaaugagucuuacauacuuuuguauucuccagcgagucuuacuucuguauuuuccaaugagaauuacuuaccucuguguucuccaaugaguccuaugugaacagcucucaccugguugauuaugcugaaaucucuuacuggggaucccagauauuuauuuaaacuaccuuuccuucuguauaagcaucacacucauguuuggguuugauuuuucccaugagauaauuuuguguuuucuuauaauuagcguuuaguaucugagcuggaugaugccaaccuccagguugaaaauguccgcgaucaagcccuuauuuugaugaaugcccguggaagcucaagcagggagcuuguagaaccaaaguuagcugagcugaauaggaacuuugaaaaggugucucaacauaucaaaagugccaaagugaguaauuaugcuuuuagaguaaaccauuuuuccuauggguauguaucuaaaugauagucauacaguacauacaucaacaauuuuguuuuauuauuuuaauuuuauuguuuucucucucugucaccgaggcuggagugcaguggcaugagcucacugcaaccuccgccuucugggugcaagcuauucuccugccucagccacccaaguagcugggauuuccggcaacugccaccacacccagcuaauuuuuguguuuuuuuuaggagagauaggguuucaccaucuuggccaggcuggucuugagcugcugaccucaagugaucugcccgccuuggccucccaaagugcuggaauuacaggugugagcugcugcacccggccaacaauuuuuaaauuaaaauguuuuuaaucacuuuuucuuugaauggagcauuuguccguauuuauuugugauugugcauaugaaggagagaaaacaagcaauuaguauugaagaaaauaaccuauuugagaaaagguuucaaagacucagucaaagguuagaauugguuaugaaaugaugaaacuaauucccaagcuagggaugaauauuaaacccuuuauuuuauggucacacucuauauaugucuucacauugcacacaccacagaacuuguuuuuuuuuuuguuuuauaugacgacaaaucuaaaaguuacagauaauuucacaguuuaauccuaauguaggaaaguacuaccugauuuuauaaauuuaauaaagagcuuuagacauuuaauuaacaggguaauaaauaggaccuuuaugagagugcuaguuuucccacacuuagccaaccccagaugguauuuaucugcauuuaguuuuauuaaaauuguuuuauugaguuuuauuuaaacaaauauaaaauuuuucuacguagauguuaucugaaaagaugacauugagaaauaugcacuucuuugacguuuguguaugaaaauccaaggggaauucuacugaggaaacuuaacugggagacauucugugaggugucccugcccugggggcuggguggcuguucuuccuuucuguggccaugguaaggauaguuucuggaucauggccauaguuuccugcuaugcucgcauguggucuccaaauccacgccacaacacucugggcagccacaaugaauugcaauacuacgucacaucccuggcuagaguuuggagaaaacgggucauucagagaagucugaauugguaaaaucauugccauauaaaugaaugaaacaaaaguuagcugagcugaauagaaaagucaguuaaaaaaguguuaguuucucucuugacaccccaucucucugauuaaugauggaaagucaaauuaaaaaucuauuuucagagaauucuuuuccuucuacaguugcuaauugcucaggaaccauuauaccaauguuuggucaccacugaaacauuugaaacuggugugccuuucucugacuuggaaaaauuagaaaaugacauagaaaauauguuaaaauuuguggaaaaacacuuggaauccagugaugaagaugaaaagguugguucaaggagauuucaaaaccaugguggucucauuuuucuucucuauuaauuucauuuuuacaucaagauguuugcccauauaaucugucaaacaugaugaaacagauucaaaugugauuuuuugaugugugucaauguaagagucacaugauucaugugcuuaaaaagaaaauagacucaguuucugaacuagacauaauccuuaguauuaucuaauguuugcuaaacucucuuugagacauuuuaucuucaaauauaaaauauauuuaaaaaaaacauaaauuuuuugaucguucagguuaacauaucuugacguauacuauacuaaguagguuaguuuuccuccuuaggaguugauaggaagugaccuuaugcauuuuucuuuugagucauuuuuuuuuuccuuuuaaaaauuuagauggaugaggagagugcccagauugaggaaguucuacaaagaggagaagaaauguuacaucaaccuauggaagauaauaaaaaagaaaagauccguuugcaauuauuacuuuugcauacuagauacaacaaaauuaagguauuaugauuggagagucucuguugcauuuaaauaccuuacuuaacucuugccauucagaugugugaugcugcaucacagaugcuuuaaaacacaccaguuggaauaucaucuccuccuuucuaguguguguuacuagauguguucauauuuuuggauggugcagaacucaaaauggaaauguaaaaccuuauuauuggccaucucuuuuggauuucugauuauguuaucaaaccuaaaagagaucuaucuauuucagaaguggcuuccuccaauuccauauuuuauuugugaaggucuugucuaugucaaaaaaaauuucuaguuuaaaaauaacucaguuugugaaagugauguaauaugauuuauauucuaguaaagauucacuaccagcucccuuuuuauuucuuuauauuuuucuuuuuuuuuuuuaaagaugggguaucucuauguugcccaggcugaucuugaacuccuaggcucaagugauccuccuaugucagucucccaaguugcuaggacuacaggugugugggccaccauauccagcuccagcucuuuuuuaaacggcaaucuuucuagcugcauuuuaagugugcuguuguucccugggguccguucuuugguaguuccuucuagaacgauuuuuauuugaugacuuuggaaauuaaguagaucgauuaugguacuguauuuuuacuguaccuuuucuauguuuagauauguuuagauacauaaauacuuccaacuguguuucagaauugccuauaguauucaguacaauaacgugcuguaaaguuuuagccuaggagcaauugacuauaccacacagccuaagugugcaggaggcuguaccaucuagguuuguguaagggcacucuaugauguuuguaugacaaugaaauaaccuagagacacauuucucagaacaugucccuguuauuaagcaaugcaugacuauacuuuaaaaacuagccauucucucaaggcugaagccucaacauccuucuuaacuauuucuuguuccucacauaucuucucacaucacacugaguaggcauuaaaacuguugagacugcuugaagcaacauacagguuugaacgugaaguuagauauugcucuaccagcugcuuguuuuaugaccaucagaaagugccuuagcuuauuuuacuucacuauccuuuccauaauuuagacuaaugauuuucucccaugauauuauaucccauggacauauucuuaugucuguuuuuucucacucuagcauguccuuugucucuuccucacaguuauucuccccaaagucauggcugaucaugucauuccuucaucgaagaaacuguuuaggaaaauauugcaaaauacagaaaaagcuuuaaaugcaaggucugucaauauaacgacauacaaagucuucagucugaccccuggcuccuuaugucuuugaugugcugucacuucccauguaguacagcuaugcugguuuuucuuuacauuuuccuaaacacaucaugugccuuagcacaucugggaacuuauuaauuuuauuccgauucccuagagugaguuuugucuuuuuagguuagcugaaaaaugcguuaucuuuuaaaacucagcuccauuuuuauuucuaacuucugucagauuauauuauaguucucugcuuuauugugacuuuuuaaaguaucuuucuucccuaaugcuucuccaaguucaggcaauaucuuuuucaucuuuggguccgaaaucagaaauuauuacuggcacaaaauagaaauaaguuuuaagcuuuuaauacauaaauaaauuuguuuguuaaaaguacuaauauauacuauacaagcuaauuucauucuggcuuuacuaacauugguaggcgaacuauguuacaaacuucaaaucuauaguuuucaaacuuauaugauucuuaagugugaacaugagaauuacugugggggagcuuuaaaaaaacuacagugcccaaaucuaauuccugaaacagguaaaucagaaucucucaggaccuaggugugggcauuuacaaaaacaaaacacaaaacauuuguagaugauuuuaauguacaauuaggauugagaagcacuaguuuacaggacucauugucuuaccugaaauauauguuaagugaccuuuuccaauuuguuuacuagaguauuacuguuuuuaaauuauguaugagcacuuuauaaagauauuaaccacuugccauaauugcuauaaaauauuaucuuauugauauuuaucuucuaauuauuuuaucuuuaagauauaaccauuuaaaauuuuuguuuagccacaggugacuauguuuucccuuagugauuuuucagggguuucuguuuugggaucuaaaaaguuuucauccuccagaaaguugaugaauauucaauucuguuuaguuccagguuuuuccuaugguuugguaaaaacaaaacuuagaaauuuaauaaaacacucacuuaaaaaucucuuuaaucuuugcuauaugaugugagcuacgucauguaacacugucucauuuaaguacugaccucuaguauauuuguguuucuguguccuuggagaauucuuuaaaaauaaaauuguccagaaguaaagucucggucagaucucgaggacauuuuuuuaguccuagggcauuuugauugaucacucucuugggggaaaaaaaucuauuuugggaauacagaaagcacauguuuaagucuugaacggccuugcugcuucugcaagagugggaaggcucagaaaaauccuggauuguccuauagucugaaaagaaaaagaggcagucuuaaugaaugggaauuuuuuaaacuuggaucuuuaugauaccuacuaaccucccuaguuuauucuaaagcuucagguacacguggucuugcagaaugacaauccguuauguaacugaagaagcagcacaggaauuccagucuugcaguaguagcugagguauaaaaguggcucccaacauuuaccuaauggagcagauuaaaaaacaaauguggcauguauuaucuaguggugcuaaaugaggaaaguacuacaaagguaaaugucccuacaagcauaauaaaguaguuggaugucuggaguuuuuuggucuuuuggaaaacagaugaccuuucagcaaaaucuugguuaauggaugggaagccaagaaggaaaacgggucccacuuuccucuuuuacuuuuucgacaugauuacucaaccuagaaauacuuucauugggcuauuuucuuuuccuuaaaguuaagagggagaacaauugagccuaguuuucugaucuuccaaaauaaaaacacuggcuuauuugaaaugaaaauccaaaagaauuauuuuugauuuuuucuuuucuuaaaaaauacuuagcaucuuuuuauucauaacugguuucuggguagauauguuauuuauuucagcauucuuuuauauuugcuuaaaacacagaauuuguuuccuuagacauauggguaaauaucuagaaaugcuuucugacuaaaauuuaaacuugcggcauuaggauaauaaaauuaaucuuggagacaaguguaauuaguucuguuguuaaagucaagaaauguauagaccugcuucuaaccuggcuauccagaacuacccucaaaugauggacgcaguaguuuaacaaauucuaggaggcaauaaugcaguccucuagguucaacaccauguuauccacucaaugauuuuagucaugagucuuggauuccuuuagagauuggauuguaaccauuuucaagaucacuaacugaauuaacaugcauuugugaucguuuuaccuaucaucuugaauuuacagaugauuaucauuuuuuagaaguucaacauaggagaagugaaagugucaaggaagguaccuuaauucaugagcagcugcaguuuggcccuuugcaagugguaauacguagcacuuauuaaauuguggccaucuaggaguaaaggguuugaacuccugaaggacuggcgguccaucccagagagcacuuuauuguuuagaaagcucugagaagagggccgggcaugguggcucaugccuguaaucccagcacuuugggaggcugaggucagcugaucacuugagguuaagaguucgaggccagccuggccaacauggugaaaccccaucucuacuaaauauauaaaaguuagcugggcaugauggugcaugcuuguaaucccagcuacucaggaggcugaggcagaagaaucgcuugaaccugggaggcagacggugcagugagccgagaucacagcacugcacuccagccugggaggcagagcaacacucuguccugcacccccccaaaaaaauaaaaaugaaaaagaaagcucugagaagaggauccagaaaaucuauauuagggcagaugaguaguccauagagccucaagucugucuaaauaugacacuucaugaucuauuuucuaauguaggauauuccugcucuauaauauuauucucagagauuaagauuacauacugaauuaccuggauauuacuuuaaucaaaacccuuugugcauuucauguuguguuauggaaacauguuuaacuugcuuauauuuuuagcaaugagguccaauuuuaaaauugugauauuuuuaaaagagugaaauaauguaucaaaauguuuuauuucauacaaaacuuugugauuggcaggauauucucauucuuucaacaacucaagaaaggaauuguuguuuuuuguuugcuaacugaguuuagauggcauagaucuuaaagccugucaaauuaauaacauacuuauacuguuuaauaucaugcugcagaugaaaauuaggauacagauuguuaagguuuucuguugcaagguagguuuauaauauaaaauauuaaaacuaaguuuuaaaaauuugguucaugauauugcauuccuucacacaauagucuuguuauuauucauuguggggguauuuuaagagauauauauauauauauauauuuuuuuuuuugcuguuuuuguaggcaaucccuauucaacagaggaaaaugggucaacuugcuucuggaauuagaucaucacuucuuccuacagauuaucugguugaaauuaacaaaauuuuacuuugcauggaugauguugaauuaucgcuuaauguuccagagcucaacacugcuauuuacgaagacuucucuuuucaggaagacucucugaagguagaccucugggcacuguguuugaauggccacaguuaauguagaaguagaggaagaaauuuguucuugugccuacuuagauggucuauaucuuuuacaauuugugccaggggauuaauaauauguaugacuaguaaagcuuuccuauauugucaaagaaaauauauuaaauuuugaauuuuuaaaaaguggguauggauuguuaaaugugcacaguuauaaauuauuugcaacaucagagccuuguuuaaaauuaaacagagacauagaccaccuuccugucuuauaaacuagauugucaguugauguuaauugucagcauuuaucaggcaaucuauaaugguuuaaaauuggccaguugagguauggaauggcaucuugauuguaaguuaauuaaacuuaaauucuagcaaggcauuuucauguaacuugauugcauuuauauguaaaaucacaauaaauucacugauaauauggauuugauagugcauuccucucauuuaaacuaacauuauuagauauuugaaaauaucacuauuuccagcuucaaaugccucauuaccuauagagaauguuacugaagccuuucauguguucuguacaaaugcuacuauugugaggacuuuuuuuccugccuugaguauauuauguagcauauuccacacacuuugguuaaaacagaguaucauuuaaaaaaaaaaaguuuucaguuuucaugauuaacaaugauuaugucucauuauuauuucaaaugaguguucuacaauauaaauaucuggucaucugugauuccuuuuuuuguuacuuugcuggauuuuguuaaucuaugacaauauauuuuuagaauaucaaagaccaacuggacaaacuuggagagcagauugcagucauucaugaaaaacagccagaugucauccuugaagccucuggaccugaagccauucagaucagagauacacuuacucagcugaaugcaaaaugggacagaauuaauagaauguacagugaucggaaaggguauguguaaaugaaauuaauauuuaauuuaaaaaaaugccugcaaguucaugggcgugaagaagaucauguggacacugagauuaaugagaacauguuucauauccuuguaggaugcccuauuauuuuuuuuucuuuuaagaaggagucuugcucugucacccaggcuggggugcaguggcaugaucucagcucacugcaacauuugccucccagguucaagcaauucuccugccucagcuucccaaguagcugggauuacaggcgcacaccaccacgccuggcuaauuuuuguauuuuuaguagagaugggguuucaccauguuggccaggcugguauugaacuccggaccucaggcaguccgccuugccuuggccucccaaaaugcugggauuacaggugugagccacugcacccggccuuaugcccuguuuaauaaauugugaugaguauaguuccuuaaaggaggaaugugaucauguauagaugaccauuuauaacauaauaucuuaaugauauggaagcacuucuaauuuuuagugucuaaauaguguccauucucuuuaaaaaaacuaaagaaauuuuucauuaauguucacuuucucagcacacuugaugauuaaugugagugaagaacagaggcagcuacagauaauuagaauccauauauaguaccaaacucuuuuuuauagccuucuguuuaaaugaaugcuuuugagccuucuuacuagauuuugaccaggacuauuaauagguagaaaugaaaacaggcaagauuuuugccaguagcuguggaugugauggaaaggcaaauaaguuaugaaauaacccaguggaaagcgcuguauaagaggaaagggagcacagaauaauacauuggguaacuugagagacauacgcacaaaaacuaggcaucauguuccuucucuuuuuuucuauuuuagccuacauauuucaaugugacuaauccuugaaaagauagcuuuuaguggccuuugguauauuccuuuguuuggauuuuacaaauuuucucuuuguaccuuuggagaacauucuuuuacauacaucuuuauccauacuuauauuucauuaggcuugaucauuagaugaagacaaauuucuuuaaaaauaaugacauuuuaaaccccuguauuauaucaugaaauugguuacuauaccccugccaacaguauuuguaaaaauauccuucuuuuugagcccuuacuaacauugacagguuuuuuuuuuauuauuuaaaaaaacuuugccaguuuaauagugauagauuacaucucaauuuuauuuucauuuuuaaauuuuuagugcuacuaauuuuuguacgucaauuuuguauccugaaacuuugcugaauuuauuuaccaguucuaggagcuuuuuggaugagucuuuaggguuuucuagguauaugaucauguuaccagcaaacaguaacaguuugaguuccuuuuaaccaauucggaugcccuuuauuucuuucucuugucugauugcucugucuaggacuuccgguacuauguugaaugcaaguggugaaagugggcauccuuuucuuguuccaguucucagggggaaugcuuucaauuuuuccucauucaguauaauguuggcuaugggcuaaaagucauagauggcuuuuauuaccugaagguauguuccuucuaugccaauuuugcugagaauuuuaaucauaaagggaugcuagauuuugucagaggcuuuuucugagucuguugaggugaucaugugauuuuuguuuuaauucuguuuaugugguguaucacauuuauugacuuguguauguuaaaccaucccugcaucccuaguaugaaacccacuugaucaugguuuauugucuuuuugauauacuauuggauucaguuagcuaguauuuuguugaggauuuuugcaucuauaucagggauuuggucuguaguuuucuuuuuuguuauguccuuuccugguuuugguauuaggguaauacuggcuucauggaaugauuuagggaggauucccucuuucucuaucuuuuggauagugucaguaggauugguaccaauucuucuuugaaugucugauagaauucagcucugaacccaucggguccugggcuuuuuuuugcugguaauuuuuuaaucaugauuuuaaucuugcugcuuguuauuggucuguuuagaguuucuauuucuuccugguuuaauuuaggaggguuguauauuuccaggaauuuauccauauccucuagguuuucuaguuuaugcauguaaaaauguucauaauagccuugaucuuuuguauuucuauggcaucaguuguaauaucacccauuuuguuucugauugaacugauuuggauccucucucuuuucuugguuaaucucaccaauagucuguaaauuuuauuuauuuuuuuagagaaccagcuuuuuguuucauuuuuuuuuguauuuuuguuuauuuguuucauuuucauuuagcucugcucugaucuugguuauuuuuuuuucuucugcugggcuuggguuugguuuguucuuguuuaucuaguuccuugaggugugacuuuagauugucuauuugugcucuuuuagacucuuugauguaggcauuuaaugcuaugcacauuccucuuaguaccgcuuuugccauaucccaaaaguuuugauagguugcgucacuauuaucguucaguucaaagaauuuuuaaauuuccaucuugauuucauugaugacccaaugaucauucaggagcagguuauuucguuuccauauauuugcaugguuuugaggguucccuucagacuugauuuccaauuucauuccacuguggucugagagaguacuugauguaauuuuaguuuucuuaaauuuguugagacuuguuuuguggcuuaucacauggucuaucuuggagaauauuccauguguucaugaauagaauauauauucugcaguuguugcauagaauguuccguaaguaucuguuaaguccauuuguucuaggguauaguuuaauuccauuguuucuuugucgacuuucugucugggugacuugucuagugcuaucaguggaguauugaaguccaccacuguuaauguguugcuguuuauuucauuucuuaggucuaguaguaauuguuuuacaaacuugggagcuccaauguuaggugcauauauauuuaggauauaauuuccuguuggacuagucuuuuuaucauuauauaauguccuucuuugucuuuuuuaacugcuguugcuuuaaaauuuauuuugucugauauaagaauagcuacuccugcuugcuuuugguguccauuuggauggacuguuauuuugcaccccuuugccuuaaguuuaugugaguuuuuaugugucgggugagucucuugaagacagcaguuacuugguuggugaauuuuuauccauucuucuauuccguaucuuuuaaaugaagcauuuaggccauuuacauugaauguuauuauugagauaugagguacuauucuauuuaucaugauauuuguugccucaauaccuugguuuuuuuuuuuuuuucauuuuguuauuguuaauagguucuuugagaucuaugcuuuauuguuguuguuguugacaggucuucuucugucacccaggcuggagugcaguggcaugaucucggcuuacugcaaccucugccucucagguucaagcaguucucugccucagccucccauguagcuggggcuacaggugcccaccaccaugccuggcuaauuuuuuuuguauuuuuuaguacaggugggguuucacuguguuagccaggcugaccucaaacuccugaccucaggugauccaccugccucagccuccgaaagugcugggauuacagacgugagccaccacaccuggccaagauuuaugcuucaagaagauucuauuuuguuguauuucuaggauuuguuucaagacuuagagcuccuuuuagcaauucuuguagugcuggcuuaauagcagcaaauucucucaguauuuguuugaaaaagacuaucuuuccuucauuuaugaagcuuaguuucacuggauacaaaauuccuggcuuguaauuguuuuguuuaaggaggcugaagauaggaccccaaucucuucuagcuuauaagguuucugcugagaaaucuucuguuaaugugauagauucuucuuuauagguuaccugaugcuuuugccucacaacugucaauauucuuuccuucuuauugacuuuacguaaccugaugaccaugugccuaggcaaugaucuuuuugcgaugaguuuuccagguguucuuugagauuuuuguauuuggauaucuagaucucuagcaaagccgggagguuuuccucaauuauuccugcaaauauguuuuagauacuuuuggauuucucuuuuacuugggaacacaaauuauucuuuggucuuuuaacauauucccaaacuucauggaggcuuuguucauuuuuuaaaauucuuuuuucuuuuucuuugucagauuggguuaauucaaaagccuugucuuugagcucugagguuucuucuacuuguucgaauuuauugcugagacuuuccagugcauuuugcaucucucugaguguguccuugauuuccaaaaguuguuuuauuuaugcuguuuauuucacucgagauuuuuuccuucauaugcugugucauuguuuugauuucuuuaaguuggacuucaccuuucacugguguguccuugauugguuuaauaaucgaccuucugaauucuuuuucuggcaauucagagauuuuguccugguuuggauccauugcugguaagcuagugugauuuuuuuuuuuuuuuuuuuuugagauggagucuuacucuguugcccaggcuggaguugcaauggcacaaucucagcccacugcaaccuccgccucccagguuugagugauucuccugccucagccuccugaguagcugggauuccagacacgcaucaccacaccagcuuauuuuuguauuuuuaguggagacaggguuuccccauguuggccaggcuggucuugaacugcugaccucagguuaucugccugccuuggccucccaaguugcugggauuacaggcaugagccacugcccccagccuagugugaucuuuuuggguauuuuaaagaaccuuguuuugucauauuaccauaauuguuuuucugguuucuucucauuuggguagagcaugucagagggaagaucugggaaucaguggcugcuguccugauucuuuugucccaugaaaugcuuccuugauguagugcucuccuccuuccccuagggauggggcuuccugagagcugaacugcagugauuauuauuuaucuucugaagcuagccauccagcacagcuacugggugcugagcggguacugggaagugucugcaaagaguccugugaugugaugugaucugucuucaggucucucagcuguggauaccagcaccugcucugguggaaguaacaggggagugaagcggccucugugagaguccuugguuguauuuugguuaaguucgcugguuuucuguugguuggcccccagccaggagauggugcuuacaagagagcaucagcugcaguagcauagagaggauuaggcggcaggcagggccauagagcuccuaagaaauuaucuucuuugucuuuggcuacuggggcgaguagagaaagaccaucagguugggcaggguuaggugcugagucagacucuccuugugcauggcuuguuguggcugcuaugggggaugggggugugguucccaggccaguggaguuauguucccagggggauuauggcugccucugcugcaucacacagguugccagggaagugagggaaagcgugcaguugcaggccucacucaguuuccaugcagcccacggcccaaaaggccagucuuaguccuaucaggaaccccuuccgccacccccacacccccacuggcccaacagcauuggguuuauuuccaggcagcuggugagcaggguugagaacuugccccaggugacaagucucccagcugagaacgcaagcugaucuccaguuccucggcucucccaugcagcaugcagcagcauuccaccuccuucaaagggucuguagauucucucaguuuuccugguauguuccugcgguaguucuuggaacaaaaguccacuaugugucugcacaugcugcuguuugucugagugggagcugcaaguuagaccuuccuccuauccaccauuuuuuuuucucucugucacugaugauacauucuaaguuuaauguuuguauuuucaaagucuuuagaucuuuggaacagucuuauagcaucucgaauuuggaaauugugauuguuguguaguuauugugaauuuuugcaaaugauaaugagugucaauaucaccucauagugccuuuuuuuuaagugcuuuucuuuuuccaugcucaauagaaaauugcuuuacugugggcaguauuagcaaaauguuaaaaguaauuuucauggagaaagacgauauacacauuauuuagggguuauugauauuaggagccauuuuauuuaaaaaauauauauuuuauuaauauuguuaagaucucagagaucacuucuaaaacucagcuccauuacucuuaaacaaaaagauaggagaaaaaauuauuuaggauccugguccaauaaagcuuuuccuuuuuaugcuuauuucauguauccugaauauaacaagcacuggguuuuacuuugccaucuuuaaaagaguuugguuuaaacagaaaucucaauagcccucugucuuauugcauaacgggcucugcaugcaauuucauacuuugcuguauuuagguaaaugggacccucaggaccagucauuacccgaaguacauuaaucugcucaggcagccguuauaagauaacauagacuggguagcuuaaacaacagacauuuacuuucccacaguucuggaggcuggaaguucaagaucaaggugccaguagauuuggugucuagugaggucucucuuacuggcuugcagauggccaccuucuugcuguguccucacaugagagagcucuguggugacucuuccaccuauuauaaggacaccaguccuuucagacuagagccccacacuuaugaccucauuuaaccuuauuuguguccuggaaagcucuaucucuaaguacagucacacugugggguuagggcuucaacauaagaauuuugauuggacauaauucaguauauaacauauagauagagggguauacgggcauuuugaaguguuuuggccuuuugugcuuuauucuugccgggaacuaaguguucugguaguaaaacaacauauuuuuccccaagaaaauaaugaaucauauuuuauauuucacaguauuuaaauguuaaauguauaaaguuggaugcguuaacaugccuacaacuaaucgauccugauuuuucaagccagaaaaggcugcaucuuuuuaguuaaaaagcugcucgagugugugugugaguguguuugugaguguguaugugagugugcauguguguauacgugagugugcauguguguguguaugagagagaggauuugguagcugguggugugagcagauugcuuugcccuuguuaugaugcauauaucucuaggaggaauuauuaccuguaucccacuacgaaaauugguuuuguggagcaauaggcugugaauucaguuguuugaggucuuucuguuuaaaugaaauuugauuuucuuuuuuagaaaaauggcuuuaggcaguccuggaaaauuuggaaaccuauuuuauuuuguguauuguccucuaguuguuuugacagggcaauggaagaauggagacaguuccauugugaccuuaaugaccucacacaguggauaacagaggcugaagaauuacugguugauaccugugcuccagguggcagccuggacuuagagaaagccaggauacaucagcaggugagugcuuucuguuagaggagggggacugcacauaugguuaguguaugccuguuaagacagauuucagaaguagggacaaaauauauuaauuuuucagaagucaauggacaauuuguaauuuuuguuccaauucuuguuaccaguuauaaaaguuuaagaaauuggucaaucacaauuuucaaucaggauuucaaagaaauuuaaauaaaaauacuccuugguggcuaaugugaaaaacaauuuuauuuaaacaauuuuauauuuagaauaaaauuuguaaacuguuaugccuaagacuauaccaagaacagaaaaaauauuugcaugccucaccucuguuuuuuguacuuaaacacuuaggcaucucauuuuucuuuguaucauugauaauuaucauaaaguaaauuauucuggagcgacagcagggcagcugcucauguaagucuaauucagucuugggaaaauauaacacaaaguuaguucugauaacaauaggucuuuaaaaauaaugguagaaagcacacgcaauuucaauucuaccauugauaaaaauauuuucucuuuuauuaaguuuuuuaaauguauuuuauuuagaaggacaugacaauuuaaagauaauucauuuguuuuucuuauaaauguguuaauguggccgggcgcggugccucacacuuguaaucccagcauuuugggaggcugaggugggcggauuaugaggucaggagaucgagaccauccuggcuaacauggugaaaacccaucucuacuaaaaauacaaaaaauuagccgggcaugguggaacgcaccugcagucccagcuacucaggaggcugaggcaggagaauugcuugaaccugggaggcagagguugcagugagccaagaucgugccacugcacuccagccugggugacagagcaauacugugucaauaaauaaauaaauaaauaaauaaauguguuaaugcauuuuucuuauuuuuggaguuacagauaaguguuuaaauuugacuugaaaauauucauucaaucuguuacuuaaacauuuguagaccaguguauuagucuguucucaugcugcuaauaaagacauaccugagacuggguaauuuauaaaggaaagagguuuaauugacucauaguucagcauggcugaggaggccacaggaaacguccagucaugguggaaggggaaagaaacauguccuucuucauauggcggcaggagagagaagugcugagcaaagugggggaaaagucccuuauaaaaccaucagaucacucucacuagaacaacacgaggguaaccaccccugugauucaguuaccucccacugggucccucccuuggcauguggggauuaugggagguacaauucaagaugagauuuggguggggacacaaccaaaccauaucaaccagugaagcaauaucuuaguaaaaugugcauuuagguuuacuuguaugugguaggacacaaggauauaaggauuuauugggguauauaauuuuuuaaagcaaugccuucaagcacuugcuugaaagaagaugagcaauucauuuucaucaaacaugauugaugcuuaugcuuuaauguaaacagcuguuauucauuuuaguuauuaagcugcccuauuuccuuguauuuugccugaugacauucaugaagguggguuagauuucaaaauaaauuucauuuagcauguucauugaaauguaauuaaauuguuuuaaaaugccuuuuuuuucuaacauaaaauaucuuuccaggaguuuguuucuuucacacuuaaauugauaccacaauacuuggguggauucauugcaucagaaucauuuacuuauuagugaaacuaaucuugaguugugcucuguuacaggaacuugaggugggcaucagcagccaccagcccaguuuugcagcacuaaaccgaacuggggaugggauugugcagaaacucucccaggcagauggaagcuucuugaaagaaaaacuggcagguuuaaaccaacgcugggaugcaauuguugcagaagugaaggauaggcagccaaggugauuuagcuaugauuguuugcaggcacaggagugaacauauuuuggauagaaucuuuuaagaugcaaucuaaugaguucuuuuauuguuugacauuauaauaggaauuuuacugacauuuaagaccuccacugcccacguucucccuuccuguauuuuuaggcuguccauaaagucucacuuuucuacucaaaugcuacauauguaaaaaccaaacaccuuuauuccuuuuauuuacaacugcuuauuaugauauggugauuaugaugggaauuuaaaguaguugaaauaacugaaacuccagguuucagguuugaaggucuggguucaagaucagaccuucccuuugcuuauuuccugauugagccuaccuuaguaauacgucucacuaaguuauuuuggugucaaauguuguguucuauucaugcuuugccaauaauaaaguucuucaucuauguaauauaauauaauauaauauaguauuauuaauuuuuaugucagauuauguuacagugacucagauuuuauuugggcaucuuccaguugcaaauuuguuuugcaauuggaauauaaugcccaacacuauagacacuuuccauauuuaaaauuauuugacauuauuuucugagacagucaagauuuaugaaugauuucuacuuuguuucauauauuccgucauuaaugaucuuuuuuguuuguuuguuucuuguugguaguuuaggguuaaaaacuccacgauuuuuuuuucuguuaauuuuaacucuguugaugaaguauuauuuuagugauaagcuaucauuuugugaaaggccaaucuaauacuuuaucagguccaguauuauuaugcaaccuaaaauauucaaguaucaugugaccuacaguugcuuuucauuuaaaaaaucuauuauuuuguguguuuugguaagagacaaauaauaauuaguacguuuugguugagagauuaccacauggcagagagaguaucuggcaccuugcacacauugccuuguuuaggagucaugacucaccucuuaggggacuguuaagccuuguacagcuuuagaaacugaggcuaagagaggcgagguuaaguaacuuguccaagaucucauagaaaguaagugaucauacugucuuaugcucucaauauuaugcuguacgaacuuggaaagagcacagaacucucuggccaaagugucuuccucuggaaaugagaacuaugauaucaccacagaggacugucaugaggauuaaaugcaauaguguuuggaaaaugugcaugccuugacuauucauaguaaacacuuaaaguaucuauuucuuaugaaagcaaguuaucuuagaacuuauucucuaagcauauugcugaauuuugccaaugauugauuaaugacuugaucgauauuuauugagcucuauguuuagcacugaagauacaaguaugauuaggaacucaaagacuaagaagaagaaaaugaugaaagaaaacaucauuaaaaagauaaagugucacagaggcagauaugaugcgcuguggaauuuaagugucacagaggaagcaugccgaagcugaguuuuaaagcauuuauagcaauuuucuauaaauuucuucuagggagggccuucuaggcagaagaaguaaaacagcagaggugggaggcauaaauagcaucgucgugugagagaucugcaaaggauugaaaggagaggaggguucaaugaccaggggaaggauuggaaaaugaggucccauaagaucuuauaugucaugcuauucaguuugcauggagggucuuagcuugaaaugauuuaucuccuagaccuuuauugguuuuuugagacagagucucgcucugucacccaggcuagagugcaguggcgugaucucagcucacugcaaccucugccuccccggcucaagcaauucucgugccucagccuccucaguagcugagaugacaggugccugucaccaugccuggcuaauuuucauauuuuuaguagagauggcauuucaccauguuggccaggcuggucuggaauuccuggccucaaguugaucugcuggccuuggccucucaaaguucuggaauuacaggcaugagccacugagccuauccucucuuauaccuuuuuaaggaaaaacauguaccugcugggaggguuuuaacaauaaaugcagaaauucuucuaaagguagauaucuguggagugugguaauuacagcuccuaaaacuaauaaggugaagcuaauacguguuuuuacucauuuuuuggaagugaaaagaauaaugaaucucuuccccaacagcuuauauuuugacuaaaacaauauuugucuuuguaaauuaacgcuaaacuucaccuuagguugguagucuauauuaaauugggaccauuuuggguagauuguauauauguuguuaacaaaguaauugagaauuaucacacaguucaauuuguuuuuguauugagugccuguaguuaaguauuugcauaguucagcaaccugcagaguuauuucuucccuuuuuuggagacaaggucuuguucugauacccaggcuggagugcaauggugcaaucguagcucacugcauccuugagccccugggcucaagcaauccucucacccuagucuucugaguaguuggggcugcaagugugugcuaccacacccagcugauuuuuaaauuguuuguaaaaauaaggucuugccauguuguccaggcuggucucgaacuccuaggcucaagugauccuccugccucagucucucaaagugcugggauuacagccgugagccaccaugcccaguggguuauuccuuagugagcaauuguuucuucuguuagaacaugaauuuauaauuuguuuuuacucuuggggauaauauuuaaaauguagauuauauuuagcuaauuugcagaugaaaauauugggugacucaaauauaucuuauugaaaucacuuuauaaugcuaguuuucuucauaguucuguuuugaaaguacuaaauuagucaugaucuugaaacauuggacgugaaauuucaacucuuuuuuagaaacaaaggccuauaauaguauuuuggguguuuccaaaguugucauuuaaguuaaauacuuuucacuauggaggguagauuacuuguuuuagucuuaguaauuagugcuguugcuguauuuauuuauuuuuaaucuuaaaggagcauucuuucuugauggauacuuaaaaauuaugauuuuguagugauuuucauuuuuuuaaacauuauacaucaaauauugacuguuuauuaaauauagaaguauuaucuaauauuuuauuacauguauugcacgauuaugugagaacuuuugugauuaaaaaugaaaacuccuagcugcaaaaacauaaauucuuauuaggaaugauacaauacaauuuauuuaaaaauugcauucaguuuuuaaaccagcaguuaauuauagcagcuauaaaaauaaagauaccaccaggcuuuuaauagcuuucaaauccuuuuaaaaaacacauaaucuuauuugucauaugaguucuaaucauauuccucucuucugacagaugguuuauauucuuauaaauguuauucuuauaacacuauaaagaucuaauugaggcaguuccuuuuuuauauucauuugacuguuuuccuugcaucauuuaaaauuuuugcuuuguuuuuuucuauaucucuuuuuguaacagugcucuauucaaauauaauaguuauuuuaauaaacaagccaaauucacauguuucuugucuucccuaauacuuguaagauucucccauucuugauaccuugcuuuguucuuauucuuucuguucuaugaauaaagcagaguaauaguuaccaccuaaugugauaacaugucauauaaugauuccuuucaauauucgugaaacacucaaagagaauuaugcuuuuucccuauuauuuuagauaaagacauuuuucauguuuuaaaaaauuuccauuauguugcggagugguaucuaacuguaaaaaaggcuuuuguauucaauuucuacauaacuuuuuaugaugagggaagauaauauucuuuaguuucaauguuuuugaauuuaacuaaggaaaaaagcuucuuggucuauuauuaagcaaucuuuauauuguagaauauauacauuguuucacuuaaaauauauauuaaaauaauuauuagaaauuauuuauuuugggaaauauuuagucaggauauucaaagcaaauauguaagguucugcuuaauuggacaguuuuuccucaauauuuuuaaauaauauauucuuuuaggcuaaaaggagaaaguaagcaggugaugaaguacaggcaucagcuagaugagauuaucuguugguuaacaaaggcugagcaugcuaugcaaaagagaucaaccaccgaauugggagaaaaccugcaagaauuaagaguaaguuguuuauuucugucuauaugccuuuuggugcccgaacauuauacuucagagucacauacugcgugucucaagaagaaaagggaaaagaaacuuuguacuuuuugguaaauguggugaaccugaaagaggaauaucuuuuauuuuuuaaagagcaguuauaauuuuggucuugcagagcuuaaacuucacuuauguaaaaagaacaaacuauuauggugucaguauuagaccaaagguuuuuaggauauuguaaacugaccuuaucauuuuaaaauacaauagggcuaugaaauaucguuuuuuguuuuuagauuuggaagaaaauuacugauuauugucuauaaagcugcaaaacucaacuuuauagauaaucaguaauuaucagagugacuugcugaggaacaaaaugcagcuugcaauagguuuagugucaugguuguauuaaucagauuuucuuuguugguuugcaacuaacaaguauuguuuauaguuguauauguauauaaucuauaaaaauucauacauauauagauguauaaauauauccaaauauccauaaauuuuguauucauaaauauuuauuuuuuguguuaagaauuaaaauacuuguugcagaacacucagcauaaugugcucacauuuuuuuuuaaaaaaagaaauugugggcugggugugguggcucacgccuguaaucccagcacuuugggaggccgaggcggguggaucacaaggucaugagaucgagaccaucuggcuaacauggugaaaccccaucucuauaaaaauacaaaaaaaaauuagcuggccgugguggcaggcgcauguagucucagcuacucgggaggcugaagcaggagaauggcaugaacccaggaggcagagguugcagugagccgagaucgugccacugcacuccagccuggcugacagagcgagacuccgucucaaaaaaaaaaaaaaaaaagaaauuaugaguguguauucauacauguacaagcauaagugugugugaaagguuacuuacuaauucagagauuuugucuauaaaggaguaugauugaagcauuuugagaaagaaacauugaauaaugaugaaaaauauuuuguggaacauauauuaaguuuucuuuuuaaaaugugacaauaucuaacaagcuuccuuuuuuaccuaaaaauuucagugguuuuuuugggaaugucucuuuuguaaacaauuugaggagaguuagaaaagguggaacaguauauuaggauggaguagcaaggaggagauaagaacagaauguuaaauuagcaguguaaaaauaauauaugacccgguuaagagacagugaguaccagagagcccguuugugcacaggagugcaaaaauacacacagaaggcaugugcucacucccuuccuaguuaucauuuguuagcaugagcuuaagcuucuuauaaguuuauuuuuucacuuaacaaauuagaaaguuacauuuguaauaauaccaaaaagguuucuaauacaguucuugaauuuucccuuaucugacuaccuucuaaccacaccuaucuuuuaacuucuccaggacuuaacucaagaaauggaaguacaugcugaaaaacucaaauggcugaauagaacugaauuggagaugcuuucagauaaaagucugaguuuaccugaaagggauaaaauuucagaaagcuuaaggacuguaaauaugacauggaauaagguguguguaaaguuacuaucacacauuucucauauuuauugauuuuguugucagagaugugggaucauguaacugcuuuacuuucaaguauguccaaauggggcaaauuuuacuaaagcuuacuaauguuuauauuuuuuaucugucauagacagaggcauauauucuagaagaauacuuuuuauuuuauacagaacucuuuggccuaggggauuuauacauuauauacuacauuaaauaaugaauauauguuggaauuaguaagaaaauuccagugaugauauucugaaaaugaagaccuuaaaauagcauucugagccggguguguuggcucauaccuguaaucccaacacuuugagaggccgagauggggggaaucacaugaguccaggaguuugagaccagccuggccaacacagugaaaccccaucucuacuaaagauagaaaaauuugccaggcguaguggcacacgccuguaaucgcagcuacuugggaggccgaggcacgagaauugccuauaccugggagguggagguugcagugagcugcagucacaccacuggaccccagccugggugagacagggagacccugucucaaaaaaaaaaaaaagaaauaaauaaagaaaauagcauccugauuuugcacaugacuuuucacacauguauguuuauuuucaaugauuuuuuucauuaaauauauauuuacuagguuccagugaaauguaauggcaugugacuacaaauacaacuaauaucuuucccuccuaccauuauuuuuuuuuugccauugaaacgguuaaaaguagauaaagucauagauaucuuuuuuguuugaccugguacacaccauuucagaguaugacgucuguauaggacauugaauggauaugucucuguccuugguuuggauggacuccauaucagucauuuucucucucauccucuuuaaaugguagccauuauccuauagcuaaugaugcaggugcuuuauugaucuggucucucugauugggaaucacugccuguugagucacugugauucacacauguguaucucuggucuggaccuuucuccauacucuaaacuuguguaugcaacuaccugcucaacaucucuccuuaaaugucuaauaggcaccucaaacuaacauacacaaucgagcuuuugauaucccucucccuucugugccuuaauauacaucucccaccuuagucaauggaaguuucaucuuauuauuacuuaagucagaaauauuggagucaauccuaugguauaugaauucuaucacaaaaagaaacaaagaaaacccccaaaccaaaaacuauaccucagucaccauuagcagcuuuuccuucaaaauacguaucuacuggauggaugguuuauuggauagccagauggcuaugugugauaaggcaaauguagcagaaguuugacaguuguagaugucagagggcacauagauauuuccucuacaauucuuucgacuuuucuuaggucaaaaaauaucauacauuugacugcuucuuacaacccccauugccacuaacuuguuucaagccugccaucaucucuugucuugaugacuacaaaggcugccccacucaucuccccugcuucuuccuuugcccuuuguuauucuguucuagacaaagcagccaauaugauugguuaaaacauaauucagaucaagugacuuaucugagcaaaguccaccaaugguuuucuaucuugcucagggugaaagccaaaaugcuuuuuuggcuuaugaggcuucucauggccuggcguccugugaucucuccuacaauauccacugcucucucuccccuacacuccuuuccagacauguuagguccugugucacuugccagaaagguuguccauauucagucggagcacacauauuuauuuaacacaaaggguaucaguggguauucugcagaaaagggcacaguuguuaauuugggugcacuaugucagacaaagcuagagcuuugguuauugcagaauuucauguaaauuuuaauauaauucacuuuggugaauuaugaaugucuaagaccaacaaugcucauugugcagaaaaucucaacaaacauaauuugggaaauucuaacaugguuuauuucauucauucauacagucauucauucacucaauagguuuuuauuggagucucacuuucugccagguaucauuuuaagagauaggaaugcauuaaagaguguggcauuccuucuaacucaaagagcuuaucauggaugagaccagcagacaaccaauuauaacauccagguagugauggguacauaaagguggagcaccugcuuggcuuugagggguagcuguggaagguuuuguugaaaagaucacauucugguuaauuuacgaaggaugaauaaguauuggucgggugaagaaugagggaaagugcaguguagagagaaguggcaaaugaaagugucuagaagagacagagaaugagcacaguguauauagguccaggaaguagcccacuguagaauggaaggcugagggauguucucagagaugagauccuggaggacucacugugcaucacaaggaauuugagcuccauguugcaaacaaucuaccacuuugaggguagugggcagcuauugauggguuuuaagcagaggaaagucauguuuuugaaauauugcuauagcuucacuacggagauagaugaagugauccuaagaauugauauagaaagaugaguuagaaucuucagaagaguuuaugaaacgggugucagggaagauagggauaaggaauucagauguggacauaucugaauaucuaguucacagagagggcuggacugaagauauguuuugggcagucuuuagccucucaaaacuccauuugauuccugaaaucuuuggaaaccaggacucagggagagcccagggugaagggcaagaagagcaacacagcugcccugaaggauauugguauuugauggaugggcagaggaaaaggaguuggugaaggaaauucaggagagccagccagagagguaggaggaaagccagaauugcagaguaauaacagaauucaagggagggggaguggacggcauuaacuggugcacaggggucaggacagcuaaggacugguugguguuuuugauagcaaugucaguggaguuaggggcucaaacaagauugcaauggagagugaagguagagccagaaguuuaggucguuaggggaagaaaaguagcagagcugccauucagaauaacaccucuucuuuugaacuacagucaucuuuauuuacguaguauucuucucuuucuguuuguccugaugcgguagauuugcagagaggugccuaccacccugaaggaaugcauccaggagcccaguucuguuucacagacaaggauugcugguaagauauguuuaucuuuaacaaaguuuuuuaaaaaaucaguauguaaaauuuugugauaugagccucauacaugaauuagaaagacuuagaaacgucgugccauuuucuuuauuuaaucuacuuucaaugauuuggaaagaacaucuucuuuaaacccaagacacauuuggcugcccaguguggguaaggcauuuguucucgcggcagauaaggcuggccuuucucuggacuccagugcuaccugggcauccacagguccugccgaagggaagaugagaggcuaggugcaaaaacuggggacuaguuuucuggguccaggcagcuuuucaggaaaucagcuauaacuuguuguguuaacaugagcuugguuaacauauguaauuagacccugaucaugacugagaacaaaaggcuuagauauccugggaagcaggugggggauggauauuuagaagcauucuccaaccuaggagacaaauacuucucacuuggauguggagaaagaagaauguuuucucacuauuuccuucucucuuuauccagauuagaucgcaggcuccugccccauagccacuguugccacugccuugcaaguuuucugaaccaucaugcccugcucuuccucuguugagucaccuggcaaaaccgcaaaugugaccaacucuaacuguccacucacucccugacagcugcuucugcugauucuuuuuauugcuccuccccgcuuuuuucuucucccuuguccuucuccuccuccuugacuuccauguccaccuucuacuuucuaccucuucucucguccuccaccucuaccucuucuaccucuuuuuuuugggaggguucuuuuuauuucucuuauuccucuuauuuuucuuuucuuuuccuucucuuccuccuccuccccucaaguuuugaaaaaagugaugacagacaauauauuuuuuuucauuuuucgagauugcaagcuaauugaggaccaaguuuguguuuuuuauuacuuguauuucuggaaauuugcacaaaaaguaccuggggccugaucaaguuucuugauuaauauucagaacacuugaguugacauuuggguacugcugcuuugcaaauacaggcucaacuccauaaucauagggaaagaauuugaugcauuuuauaaaaucgucauggguuaucuuacuuuuuaaaaccucuauaugguaaaggagcagggaaaauuugaauacauauuuagaaguauaaaaagcuaacagcaaagcuacaacuuccauuagguggauggcucauuuuuaacaggauauucguccuugggauaggccugagaccugaagcuaaucuuaguaugucucucuccuccuacgcaguguuuuaauucaguuccuucuuuuuaacauuuuauuuagaaaauaaaauuaaccauuuuaaagugaacaauuuggugacauuuaaugcauucacaauguuguacaaccacuauuucuaucuaguuccaaaauauuucuaucacuccaaacuaaaaccucuuacucauuaagcaguuucuucccauucccuccuacucccagccccuggcaaccaccgaucugcauucuguuuccauggauuucucuauucuggauauuucauauaaauggagucauacgaugcuucuuuuacuuagcauaauguuuuugagguucauccuugccaacaccuugccgacuguacucauuucagagcuaugacuauucauuucaaauaagcacucagcgcuaagagacaguccuaccguacuuucuucugaguacuccuugguacucauuucucaacuagugaccucaucucauuuucaaaagaaaaaaaaaaccuuuuucguuuucccaccagagaauccaucaagcuaccugcggcuguacccauauacuuuacacacuuccuuccuauucagugaaaggguuauuaucucuuuuccuaagaccagcuccuccacuuaugcauaggaucccauauucucugggcugcuuacguauccucuuucucugauagcuacuagaucauccuuauugccauaccuuuugaagcauguagcucuagucuacucauuuaaacugauguacaguauuacauaacauuggauauacuacaauccucuaaauucucuuuucuaccuaugcuuaccagucccagaacuguagacauuuuuuuuuagaugauucacccaguccuuaggccaauaaacuuguagucaaccucaacucuucucuggaauuaauauucaauccaucagcaaguagcaucauuuccauguuccauuccaccuacuuccguggucuugaacacccuuaucuuucuaucuagauuauuggaauaugcuccuaacucauaauccugauuuuauucuugccucaguacuucuccaugaccuauuccucugauagcagauagagugauucuuuuaaacgaguuugauugugucguuucuuuguucacagucuuuuaaucacuuccauccacauaaaugaguuccaaagucuggccuuaguccagaacaccaugcauaucugccugucucuuuaaucacauuucuuacuacuuuucccuuuguucauucuguuucaaauacacuggucuucuugcuguuucaaacaugccaagaacguaaucauuucuggucuuugugcuugguguuccuucuucuugucuuccccaaauguucuucucuuagauauuuucauguuucacauacucacuuccuuuaguucuccuucagauaucccuuucuagaauagcccuuucuugcccacaauaucucagauacacccugucucugucuucuuguauugauuuuacuucauaacacacauccauuuuccugauagaaugcaagcucuggcagggcacgguggcucaugccuguaaucccagugcuuugggaggccaaggcggguggaucaccugaggucaggaguucgagaccagccuggccaacauggugaaacucuguuucuacuaaaaauacaaaaauuagcugggcgugguggcgggcgccuguaaucccagcuacuugggaagcugaggcaggagaaucgccugaacccaggagguggagguugcagugacccaagaccguaccauugcacuccagcccaaacuuugucuugcacacucucaugccugcagcgucuagaauagccccuuacacauaauagguucuuaauagguauuugaugaauuaaaacaaugaauuuuuuuuaucuacaaaaaaaguuaaagugaagauggggcagaaggaugugugagauauucuguaggguguauaucuagugauggaaucacuggguuuagcauaugggugccuucuacuucacuagcugccauuagggugcugucuggauuacuuggcccaguuuacacugacacuggcuguguguaauggguucuuauuguucuacagcauuaccagcaccucaacacuuugcucucaggaccccuuuacacuuguaaaaauuauugaggacccucaaauagcuuuugcuuuugugagugauaguuauccguauuuaccuaacuagaaaaauuuuccauuaauucauuuauuaaguuguuuaaaaauaauaauaaagccauuauauguuaacaaaaauagcauguuuuuguaacauuagcauaagaugcugggcacagugaaucaugucuauaaucccagcaguuugggaggcugaggcaggaggaucacuugagcccaggaguuugagaccagccuggguaacauagggagacccugucucuacaaaaaauuaaaaauaaaaaaaauuagccaggcuuggugaugcaggccuguaguuccaacuaaucaggaggcaguggugggaggaucacuugaacucaggagguugaggcugcaaugagcuguguucgugccucugcuucccagccugggugacagagugagccccuaucucaaagaaaaaacaaacaaacaaacaaacaaacaaacaacucuguuuucuaaaacaaacaaaauccuggaaaagcugcaguuuuauauuuuuugaaaucucuuaaaugucuaguuuaauagaacacagcuguauucuuauuucugcuucugcauuuggucucuugugaugucacguuauguagacuuagauaaaacacacuguacacgugggagagacugagccuaaaaaggcaaauaaugugcugaugauaauaguguaggcaucuuaaccuagagcuucucagaugucacuuuucugauggugguccuguggauguaggguauuucauuuuaauuuguacuaucucaguuauagaagaggucagacauuuauuucacauuuuuauguuuauugccuuuuuuauuuccucuuuuguggauugucuuuagaugauuuuuuaaguuuuagaaaaaguauuuuggcuaucaguucuuugucugcaaugggcauugcaaauaccaucuccuuucaucuuucaaaggcuuuuaaaaucuuuacuuauggugcucuuuggaauucuuaaccauuaaugguuuauuaauagcuucccuuuuuuguguuuuguuugagagcuacuucaguccucugaaguaauaaaaguauuccuuauuuuuaacuaacaauuuuguuuuucauauuuagguccuuaauccacuaagaauuaauuuuucuaugguguaugugagguuaaaaucagucccaucauuucccugcugcagccguggugacucacuuaauugaacaguaaauucuucuucauugaucuguaauucagucucugccaaggucagauuucucugccaccuacacauugugacucuucucuucuguuggucucuuuaaaugucucagucuauaauauacugaguuaauaauuauuagcuaaauaauauaacuuaauaucugggagggcauauuccucuaucaaaaaauaauuugacuguuuuuuguccuuuucucuucaauauuaauuuuauaaccagaaauuugaauuaaugauuuuguuacauucaagccuguugggauuuuuauuaggauugugcugaauuuacagauuggcuauacauuuuagaaaauuauuuaagccucaucuaauauaucauaccugaaguagguuacagauaguuuuaauuacuaauucaacuacuuauuguaucaaaaccaaucaauuuggcaaugaauauuaaauacauacuuuuuuuuguauuuucugacucaguaauucuacuugggaaaucuaugcuaagauagagaucagaaaugugcaaaauacucuacaugaaaagauauucuuugcaaguuuuuuaaaaaauuaaaauaaaauuucaggagcaaucuaaauauccaaggguuaaauaaaagugaauauggguauagguuauuacauagguauucauaauuguguuuacuaagaauaaaauaugcucacauuauaaaguuaaaugaaaaaaauaaaaaauuaugaauaaguuggcuuuauaauuaaaaucaucuugccaaaauaaaauaauacuuccaguucucccacauuuguacuuuuaauuuuucucagugucagugcugauuauguuauagaauguugcaaaacuguuuuguuggcuugauagcuaccaaagacauauggauauuacagguaauaccauagccauuucaguaugaaaaaauaaccucuuagaauuuuuuuuacuuaaacuaaauuuuauuuaaauacacauacacgugucaccaugacaccaccauaauuaaaacauccuguugauuaauuucucuuuugcuacauuuuucauuucagcucauccuaauguccaaaagguggugcuaguaucaucugcgucagauauuccuguucagucucaucguacuucggaaauuucaauuccugcugaucuugauaaaacuauaacagaacuagccgacuggcugguauuaaucgaccagaugcugaaguccaacauugucacuguuggggauguagaagagaucaauaagaccguuucccgaaugaaaguaggugcauaguguaaaagcuugucauggaaacgccacaacccagagguagaccagaucuguuugaaucccuuuuguuuauccuaaacuaugagagaaugagguuuaaaaaauucuguaucugucaaacaaccauucagggcuaacuacaaagcauagagcuuuucuugcauuuauacuguugugauaugaucagguuuacugacuuaaacuaaagacccagugcauuuuuaaaaucuaaaacugauaccguaaagcuaggcacauuaguauaaauauaagcuggcguuagcauuucaugccuguugugugauguaggauaaucuccuaaagugccuuugcaacuuauauuucauaaugagauuaauuucugauuuuaaaagugaauaucuccuauaacuuuacuacuauacauguaccaucuaauauucauuuguaaaaauucuuuuucccuauuuagugugugcuaaguucugggcugugagugguacaaggauacugacaagaauauucuagguagaaauugggaaacuacaaugaaauaauaauaacagcucuugcuaaauuuuauuaagugcuucaugugugcuggucauuuuucuaaguauuguacacguuaucucauucaauucuuuaauagucuugugagauagguacuguuuuuauccccacauuacaaauaaguccacaccgaggcagaggcacugagugcauaugaguugacaaauuacuguagcaaggcaagagucuaauaaaagccucaggagaaguacaggcaaccuguugggggagccaggaugaggaaggggaucacuucuccagugauggaaagcaaacugugugggauuuuggcaucugggacaaaguggugacauuccugguauagggaacagagugaauaaagucaugugguacaggaggcacaaaggacaguagggccaacauuugugcaauuaagaaauacagugugaaacaaggcaggaaaagcagcucaaauucccuuugugaaggagccugcaggcugugcaaagcccuuuggauuuuuagucuguaagcaauugguaaacaucuuccuucccauuucuuuuucuuuuuaaaauuguguuuaugaacucaugauaaccgugcucugcuuuaguagaagacuaggauggauuggaggcaagaaaugcauaaaucaaggcaaagagcccuuucugaaaugacuaagaugaugcuguugcaauuagcagaaauaaggaauagaagaaauugagugugaaugaggguuugagugauuuaguuucagacguguugugguggggaguccuuaugccauuuagaaggaagugaucaguauucauuaccaugugcccugggauuuaggauugaaaguugugagcaauccauuuagaaguaauauuugacaccaaaggaguagcuggaaucuacaaaacgggugaauuuguaaagaggaaggacugggaaaaagucauuugccacuauuuguauuuuuuguaaauugcuuucuagucucuaugacugucauuaguucuguacugaaaacacaugauuuuccugauguuguuaccauuucucccauauuuauuagcacugagagacaaaccaucuacagcagcaguuuuucgugucuaagaggauuuaauuuauaguuauuccucuuagcacuuuucugugucacccccaacccuaugacauuaguuuguguucguaccugacacagaacagauaugcaagucaucaucagcagcaauaacugcuaauguuuucagggcauuuuucagcuuuugaagggauuuucuuuguuuaauguccucagacuggauguaauugagcugucaguauuuuauuauuucuuuuuugugaaaacaaaaacacagagagguaaagcuccuugccuggugacucaggugcuaaauggaagaacugagauuugaaugcaggauccuugacuuuaaaucaugcacucauuuucugccacguugcugaugcuucacuaugccauagaggaggaaaacaacgacaacuuugaugucagcacaacuguuuugcuuauuauucuucucauauggcuuauuaaccuauccgaauaaucauuucuacuuaacagauuacaaaggcugacuuagaacagcgccauccucagcuggauuauguuuuuacauuggcacagaauuugaaaaauaaagcuuccaguucagauaugagaacagcaauuacagaaaaauguaaguuuuuuaaaaaaaguuauguauuaucauccacuuucccugcaaauggugacacacacacacacacacacacacacacacacaaacacauuuucaaagauuauucaacuagaaaguaauaguguuuaauauuuguuacucuuuauuuauacagaaauguagcuuucccuuguuuuuauguuuugugaacauuguuacaauaaccuuaugaaguccuuaauuauuaacaucacgacucuuaaguaauuacuuacacauuggguuuucuucucuuaacuuaggcuuucuuuuagaggaauaaaaaaagguuaaaggaacucacaagaaugcaaauccuuucucucauuauacuuuauucucuaaaaucaggucuuacugugucuuuuaacucaacccaaaauucaguccacaaauauuuauugagcaacuacuaugugcuuaugugacuggcauuaauuuggggauacuuuaguuauaaaugagagaaaacaacaacaaaaaauaaacauacaaaacaauagcaaacaaagauccuugcuugggguuugcauucuagcucagaagcaucuagguucuacaaacccuucuuagugggaauguacuaccaauagcaaacgaagucuaaauucucaagagugacaccuagggauugucacaaucugcugccacuaccccuuuucucacuucagcccucagcccggccuguaauuaugcuguuauuccuuaaaauauccugacauuuccuagucuucuuaccuuuauuugcauuauuuuauuucucuuggccuuuucuucccaggugcaauucuacgcagcagcuaaaaugucauccccuuugugacaucuuucccuccucuucuggucccuggugaauguuaauuucuauuuuuaguuccuucuauggccuuuccccccauugcuuuauuauagaucuuacaacuacuuuaauugucucucucuuccauagauugugaauauccgucuuucugcccuugggccuuuaacagugccaauacaaauuaacuaccuaauaaauauuugugacaaaauauaaacuggaaggauaaauccuaauauuugucaagggaagaaagucagcuacucucccuguaaaaaguauguuuugauuucaaaauagucaugguagcaacaggguuauuauaggagauacauuagaaaagaacuuuuaaugucuaacaguguuggcuuauuuuuacuaaauacaucauuuuccuucuuuucucuuuuuaugaauggauggauugugccuauuauggaacuuuggagugagcugguuucccucacaucacaggggagcuccucugcucuagugauaccaaacuauugacaagccauuuccaguuugcuuuuucuaucaucuugauguuuucuuuuaauuauuauuuuuuccaucaccucucuuuuuguccaaaacuucuuucagguguuuguuuuuuuguuuuacaagacuucuccuaaauaucuucccuuucccauugaauguacacacucuauuuucucucuauauauaaauauuucuguguguguagagguucuauaaccuucaucacuccucauuauaugaaaaacccuucccagggggaauguauugcuaccaauaguaaccucguuuuagggcuuaacucacaaugaaugggauaauuugccuauuucuuaugauaaaccugugauauuuacucucgcuugaugucuuugguuucauuuguuuacuguuaaaggauucuauuaguaauagaauuggucauaaguacuuuauguaacuuuuuaacugacaagagaacauuaugauagauuuggccucucuuccuuaaguuuaaaacuuaagcaauuuauuuaaacagcuaagacagaaugaaacagauugucucauugagcaaguuuuaaagaaugaugacauguaaguauaacuuaaggccugaacagccuuguugauagcuuuuuuguuuuuugagauggaguuucacucuuguugcccaggcuggaugcaauggugcaaucuugacucacugcaaccucugccuccugggauccagcgauucuccugccucagccucccaaguagcugggauuacaggcaccugccaccaugcccagcuaauuuuuauauuuuuaguagagacaggguuucaccauguuggccaggcuggucuugaacuucuggcuucaggugauccaccugccucggccucccaaagugcugggauuacaggugucagccacugcacccagccaguugauagcuuuuauguuucacuauaaccauauauuaucccaagaacuuugccaaaguguuccaugauaacucagcuggaauguuaucuuguaguuacguuccucuugggccugguacuuaacuauagccuuucuuuuugucugauauccaaagcaucuuucagcagcgugguuuuaacauucuaccuacuuauuaucagcagguucuugcggauauucuaaguuauuguuuauuaguaccucaguucaagauuaugaacuaacucugaagugauuaauaaaaaauuuaaguuuccagccgggugcguuggcucaugccuguaaucccaacacuuugggaggccgaggcagacagaucacgaggucaggaguucgagaccuggccaacauggggaaacccucucucuacuaaaaauacaaaaguagccgggugugguggcacacaccuauagucccagcuacaugggaggcugaggcaggagaaucacuuguaccugggggcggagguugcagcgagcugaaagccaggaucgugccacugcacuccagccugggcgacagagcaagacucucucucaaaaaaaaaaaaaaaaaaaguuuccuuagaucugucuguccuuaaaaccuuguuaaaaauagagaaaggagaagagagaaagcuugaggagaaauagaaagagagagaaggugauaaugagugaaaggaaugaacaauaauaaaagaggaaggacaagagccaguauggaauuuuuaugaugaagagcugcugggugcacaguucaugagucucuuuuacuuuuagcauuucucuugaacuugaauauauaaaauuccuuuuagagaguuuuccugcuacaguaaaacaaaugcaaaaaaaaauucuuacacaguucaguuucuucuaaaaucaagacugccuuagaaaauucuccuuugaggguaacaggugacuaucucucugucuuaaaguucugucaugaaguacuguuaaacccuaccuucaucaaaccaggucuauaaauacaacuguaaauacaaaauuaaauagaacaguauuuucuuuauaauuguuuggcaguaucaguuuauaauaguagauauuuuuuugggaguuguuuuagagcacugaaaauaagaguucaagauuuuuuuuucucaaacaccguuucagaaauauaucaauuguauaggauggcagauguauauuaaaauuccuucaaaauguguuuaucagcuugccuucuucuguuuauagacuuauuugugauacauuugauauaugauauuuuuucuuucuccugaggguuacauguugggauuuuuuuuucuuuuauaaugcuacccucaguggaaagggucaagaaccagugggauggcacccagcauggcguugagcuaagacagcagcagcuugaggacaugauuauugacagucuucagugggaugaccauagggaggagacugaagaacugaugagaaaauaugaggcucgacucuauauucuucagcaagcccgacgggauccacucaccaaacaaauuucugauaaccaaguaagacucaucagauauuuuuuggcaguauuguuuuguuggauauacuuuuuuucuauuguucacuguaauucuuaacaauaggacccugccauguuuuuuccuaaguucuuagagugucuaaugaaauuuauaugaagaauuugaucuggaagauuuuuuucgaaaaauuucuggaggcauaacaaguaagaauaugcaugucuccgagauuuauagcucacugacuuuuugcaagugaaacacacccucaaaucagcaucuagaaagagaacacuuucaagauuccaggaacccucuuuugcucccuucuguacuguauuagucuguucucacauugcuauaaauaacuaccugagacugaguaauuuaugaagaaaggagauuuaauugacucacaguucauuugagggcuacuguagugaagcaugacugggagguaccaggaaacuuaaaaucaugguggaaggcaaaggggaagcaggcaccuucuuuacaaggcagcaagacagagagagauagaagggagaagugccacacauuuuauuuauuuauuggagacauugucucacucugccgcccaggcuggaaugcaguggcacuaucucagcucauugcaacagccaccucuuggguuccagcgauucuugccucagccuuccaaguagcugggaugacaggcgugcaccaccaugcccagcuaauuuuuguauuuucuguagagacgggguuccgccauguugcccaggcuugucugcaauuccugagcucaaguaaucugcucacuuuggccucccaagugucacacacuguuaaaccaucugaucuugugagaacucacuaucacaagaacagcacaggggaaauucauccccaugauccagucaccucccaccaggcuccuccuucgauuggacaugagauuuggguggggacacaaauccaaaccauauuacuuacuuacccugaagguuauuuuuauuaauaaguuuuuccaagacuuucauuugaggacuacuauagugaacaaaucagauaaguaaguuuaguuuccuuuaaugacuuuuuaaccaaacuguuuuaucaauuucguaauagcagacaucuuuuuugucaucaguucaguuauagaguugauaauauugaacaacuaugguauuuuuaaaagugcuuuuaagauucucuguauaaaauuauaaaauauucuugaauuggagguuuuaguugugagguuauaguuugguauaacauuuauuugcccuucagcuagccuaagauggaaguguauauuugugaagaauuuaagaaaguauauguagaaaacaaucgaaaauguggaaguauguuuuuauucuccacaaaugcagacuuuacuugguuacaguuuuaaaagcaaguggccaguuauaugcauuucuggaucauucuguguguuugugauacugcugacuguuuccaccaaaugacucccaaguaauagugaagccccuggccccuuaacuagaggaauacaauuaaaagugaugucaguguuucaguuaucauauuagaacauuauuuuuuaaucagcagugugauucuuuucuucugaaaccuuaggcugauuuaaaaucuucccaauugcuacaaaaagcauuauauuaaagguuucaguugucauuuagauuucauggugaguaccuugauccagagacucucagaggcugaaaaacuaugucaaagaaccaaugccaguggacaaauucagcaucaguuuggcuauucaagcaaacucucaguaaaccuugcuuggcagcuugauccauucaagugguuaucuuuguaaacacaccuugugauccaggggcaagagauggaagacguccauguuguugauucuucacguuucuccaggcauguaugcaggaacugucucuguauucaguccuuuaugacgcauguccguguaaggaucagagagguacagcagaaggaaugaaaaagacaaaugguuugaggaaggaaaauaucucaaaaagaaaaugauaauaaucuuguaauauugucaucuauguacucgaucacuuucuuggacauguuucuuuucacuucuacuaauuuugguuuaagcuuacauauaacaaaaggguuugcccccagucuguuuucauccugugauaucuguaucuaaagcaugucaaaaucugcugggaguaccauuguuuugauuauacuaauuacugagugaccaagucuaacaaacagaccugcacuugcaccucagauacugcuucaagaacuggguccuggagaugguaucgucauggcguucgauaacguccugcagaaacuccuggaggaauaugggagugaugacacaaggaaugugaaagaaaccacagaguacuuaaaaacaucauggaucaaucucaaacaaagguaagucuaaggcccuggcagguaaauguauauugucaaguugagaauuugauggcuuuggcuuucucguggaaaccugccaaacauguggcuacuacaaguacauuuuauuauuauguauuuuuauacugugauguucugaguuaguauuaucauacuuaguacagaauguaugcuuauacaauauguuuuugaauuuuuacaauggaguuuuuuauuuuauuuuuuuaaaucagccuaaaccuugccaaugauuauguguucugauugucuuacgcucucaguauuaucuagaauacacuuuguagucuucugaugguaaggagugcagguguuuacagaugcaucaggguaaugguaucccuaaagguaauuggaauagcgugcuauuuggguggggcauccuaaguugaggaccagacacacauggauccaacacuagaucccugaaauaaucuaugugcauuuaggauuuuaguuaauuuacuaucuuuuuucccauuacuuugucuagucagaguauuuggaacagcccaaaauagaauauguguuuacaagagaauuuucugucacuugaaucacuugaacaccuagaauuugagaaacuauaaacagugauuagcaucucuuuaagacugcauauuuauauucaucauuaguaaaaaaagauguuuacaucaugcauauaguacugggaaugccugugucuaggugaaauuacgcacaucuuuauuaaaaugcaacugucuuaaaaccaauuugguaucaaaacacaucuauuuugacgugaauaaaauggguauuagagcacuuuauauuccugauauauuccugcuaauaaaguauggcuaagcauuuaauaacauuuugacauggauacguuuuauacacuuccagaguguuauuuuuaguuacaaucucugaagcucugaaaacucaaagaagaggguuaugauggcacaaugugagguugaauguguuguuagauauaccuuggauacuggagaaaauaagacuggguuagcaaagacaaaacuucacaagugguuaaagcagaguggcuauaauauuggucuuucuaacauuuuacuacaacuuuucucuuuuauuauaauagguuauuuggauuuaguaaggauaucauaacucaggcagggaagaaggugaauuaaaaacagcuuuaaccuuaagagauagcauuaggagauauaccuaauguuaaaugugagucaaugggugcagcacaccgacauggcacauguauacauauguaacaaaccugcacguugugcacauguacccuaaaacuuaaaguauaauaauaauaauuaaaaaaaagaaaagaccuacaaucagacaaagcagguuagagaauuucuuuauggccaucuccaagacagaaagguaggggaagacuccugccuucaggagagaaagaaggaggugaaagggcaggagaaggucacagagagagauuguuuucugaggccugcuucugagcccugaggcaccccaauauuagaacaaaaggcuauaacaaguguuaugggaguuauguugcaggaacuguggaugaaaacauauacguauuacaguaaguacgaugaauaaaaauuauuugcauaauauagcuaacauaaaaaaaagagauauaguccuuaaauaugcucugucuuuguguuuccaaaaauuccauguauaagaguuaggacuuuguuuuccuuguaaacuuaacaaaaaauuuauccguuaggaauguguggccugcuuuauuuagcaccuccaauucuucuucuuauuuuuuuuuuuugcuuuuacuuuguaaauauuuuaagacagccuacagcaguaguuggauuagauggaagaggcaauuaaaaaugaauuauauugcaaggugauuuuucguuuaucauagcuaagacaauuacaauguuccaguuucuuuguaguuacaagugguuguccuuauuguguuuucucucugcauuuuccgggggguggaaauaaguaauuauauuaauauuuagacaugauuuagauauauuguuaucuauaaaacagggaaaacagagcaaaacuggcucauaggaucccuucgugaaugauaacuagggcuucuauauguaaagagaguuuucucuuuuaaacccagugaacuuuacaauuuuuaacuauuuuaaauggacaucuuuguagaauauauaaaucuuucuuugccuucuuaaagcuugugaauguauauuuaacuuuuuucugaauucuugguaguauuguugcaaagauagaauuaaggaacuuuaauggauacgagugaccuuagaguucuucugaaccaguguuucucaaccuuucuuuacauuaucgcuucccuaaggagccuguguagacucaucuucccaugaaauuuuaauaccaugauauacuguguacuguaugguugugcuuuauacauaaaaagaauacauuuuuucacccucccccugaaaagaaauaaccauuuauuaccuguguugagaauacauggucuaaucuaauauucucaggcucagagaaguuaagugacauguucaaagucaugcaacacagucaggaugauauuuuucuauacuaaaugguaaugcucuucaugcugugaguucugaagaauuggcaguaaauuuauucaggcugcuauacuuugugagauuuggggcuuuguuuugugcguauaaauuuugagugucgucucauugucaggcacuguacugaccucuucacacacaucauuucauuuaaucuucacaacaacugcaggagagagguagcauuuucaucaguccuauguuaaugaauaaacugaaguacagagaaguuaaggaauuacucaagacuacacagcuuauaauggcagaguugggauuggaauucaagcuugacuggcaagccaggcucuuauugucucuaaaaacaguuucauuuuuguucuuugaaucagacugucagccguugcugacauucuuggugacugcuuuguguacccgccucucaguucugucuguaauuccgcuuacugauucuuaucuguguugaguuuagaagccauaucagaugaaagauacggggccuuuuuuaugcauaauguaaugcacuccaguacguggccaucacaccccgucuaauggcugcugagaggccuuuuuaccauggcugcccucuuaucuuccagccuguucuuuauauacaucauugucagccaaauucuggaggggugaaggguuguuauauuugcacauggaauacugugcagcauaaugugugaaguucaauaucagcuuucaaaggaaauguuuuguaugaauugcaguuagccuaaauaauuuagcuauucacaauuauaaguccacaaucccuuaucuacaaugccaaaaucuaaaaacagcuuugauaacagaaaucuuugaauuaccaugcagcucuuuauuaaagucuuuauuuauucugguuaguaugaauagccuuuuuccuugcugcagaaauauuaauguguuugauugcuuccccagacccuguucagggguaguaauuaauauaguuacuuucauaauauuaguuuucuaauguucaaaaauaauauuacuucugaaacgcaacugaauccugauuuuuuggauucuuugaaaaguaggccugucucuaauguuucuaacuaaucuauauauccugaccacuacuuuuuuuacuuaucacuuuuuuuccuuccaucucuuaaugcuaauuaacaaauuuucuagugccaguugagauagugauuguugaaauguguuuauagcacagucaguguggaugccugauuugggucuaaaaugcuauuuuagcuguauauauuuuggcacuccagggcaaaaauaacauuauauauauauauauauauauauauauauauauauauauauauauauauauauauacauacacacacacacguauacacaccuguguaacacacauguauauauacauacacauauauguguguguuuauacacacacauauacacacacauauaacuguguguauagacguguuugcacaugcauguauauacagguauguauauauaugcacacucauguauauacacacauaguuaucuacacugaaguauuguaaaggaaaugagacaguauaacugugugcuauaaauaguuucuuagaaaucacuaauuacucuguguuuuucuccuuguccuuaucgcauuuuaccuugccuauguuaagguauuucuagguuuguacaggcagaacagaaagcacugaguguaagguauauggggcaauccuugguuaaaagcccaucuuaggcacuugccuucugugcuaaccuauaggaaguuauuucaacucaccgagucaccauuuccuugauucuaaaguggagaacaugucuaauaugugggguuauugugauaucaaaaguuauguguaaaaguucuugguagguaguauaugcuuaagaaaaagaugcccaaagugucaucauaugcucuuucauauaaugucuuucugauaaguccacuuccuuuagucaaaugcacaguacuuucugggguuaaauuagcagaagguugagucauuaucaguuguuuguccauagucauuucuaacucuuucuacuuuaauuaaugauaaaauacuucuuugucugcuuuucugagugcaguauagauauucuaaaauuuuauuaacagaugaaauuucuuaaaaaaugcaguuuccuugguuugcagaauuaucacaguugcugaauuuaccuugcaauuaagcauuuucugccaaagcaaaaguccaaccauccugggaagaaaagauacggaauuuaaaaagacacaauuauuuauuuaaaaaaauauuuuauuuuauuuuauuuuauguuccaggauacaugugcaggacaugcagguuuaugacauagguaaauguggugguuugcugcaucuaucaacccauuaccuagguaguaaguccagcauucauuagcuauauauccugaugcucucccuucuccugcccccuuccuacaggccccaguguguuguuccccucccuggguccauguguucucauuguugagcucacauuuauaagugagaacaugcgguguuugguuuucuguuccugcauuaguuugcgguggauaauggcuuccaguuccauccaugucccagcaaaggacaugaucucauuccuuuuuauggcugcauaauauuccucgguauauagguaccacauuuucuuuauccaguccaucauugauagguauuuggguugauuccaugucuuagcuauugugaacagugcugcaaugaacauacacauacauguaucuuuauaauagaaugauuuauauuccuguggguauauacccagaaaugggauugguggguagaaugguaguucuguuguuaggucuuugaggaaugccacacugucuuccacaaugguugaauuaauuuacauucucaccaacagcauuaaagccuuccuauuucuccacagccucaccagcaucuguuguuucuugacuguuuaauaauugccauucugacuagcaugagaugguaucccauugcgguuuugaucugcauuucucuaaugcucaguaguguugagcuuuuuuucauauguuuggucacauaaauguccucuuuugagaagugucuguucauaagacacaauuauuuaaugugggagcacaaauacagauuuauucaguaagauaacuuuauuuucuucuuuugaaaugcuauuaucuuucucauuaauauuuauuaauuaauaauggccagcuagacauguggaauguauauaguuuucaaaagguuauuuaaauauuguguauaguaaagacugauuuuguaacuauucugaaaacagguuaaguuucaaaaauuuaauuuugauugacuuuccaaguaauuuuguuguauauuuggaagcuucuauuauaucuguuauuacuuuuucaguaaugauguuuauugucccuauagauuaauaaaaaugaagcuuuuuucagcauuuauucuuuguccaauuuggucaauuccuuuuaacagugaucaguagaagauacuuauauugggauuguuucauaaggccugauaucagccaggcucaaccuucaagcucuuaaaaaugaaugcuguagcagcugucauucccgaaugaaugggcuuaggugaaaaguacagguagccuuauccuccuagcaugcccaccaauaugagguucagagauuugggucagucaacuugauuuauccucucggaagcuuacuucuuucccugaaaaucaccuuuauuuuucaacuuguuuuguuuauuuucuuugcuaggauuugauuuuuaguuuucccuuccaagcugggaauaaagcuggccaaaaagagaaggguaaaaauuauagucuucuauauuuuccucuucuguuacguuguuuuaauauuucaaguaucauuuuauuacuuuuuuuaaaaaacaauugccaacaaugucuuugugauaaaugccuaugaauguuaauguuuucauuuuguaaauaucaaacucaagcaugcggauauuuucucagcacauuuagcuccauaucaaacaaacuaaagagccaaugcccacagaaacaaugcccacagucuuuguuuuuguuuucauuuguuucuuuuuccauuaauugauuaaucaaccaguuaaacaaguauuuauuuagcuuccuauuugccaagcucugugaccagcccuaaagauucaaccauaaauacaccucauuccugcucccaggaagcugacauugcauagggggagccugcaauguacguaagugguaaauaggaaaauaauacauaauuauaggagguuguuuuggagguaagagaaauuaaagaggugcuauguaagagagggacuuaacugaggcaaauuuagaaagcauaacuugguggcauuugagcugguucugaagguuaagaaggaaccaucugaagaaaauuacagagugaacagcaaauauaaaagucaugaggcaggaaagagcacagcaugugguugcaauauaaugaauaugaugguaagagcuugagaugcgguaggagaggaaggcagaggccagaucaugcugagcuuuguaagacaugggguauuaguccguuuucauacugccauaaagaacugccugagacuggguaauuuauaaaggaaagaguuuuaacugacuuauaguucagcauggcaggggagaccucaggaaacuuacaaucauggcggaaggugaaggggaagcaaggcaccuucuucacaagguggcaggaagagaauugcugagugaagggggaagagcuccuuauaaaacuaucagaucuugugaaaacucacucauuaucacgagaacaacaugggggaaaccauccccauuauccaauuauguccaccuggucucucccuugacacauggggauauagggguuauaauucaaggugagauuuggguguggauacaaaaccuaaucauaucacaugggaaggaguuuggauauuaaaaguacaauagaaagcuauuggaauuguuaaggaagggagugacacugucuaauguguauauauauuaaaauuuaaucucucuggaucuuauguggauaauagguugcuaguggguauaguagaauaauugcgaagaucagaaaggaagugaugguugugguccaacugggacauggugguccccguggcuacuguaugccagcaaugauggaaauaagauguuagauuugcgauaugccuuggaaguagaaaagacauuuugguggauuagauauaugccuuaagggcuuggaaacaauccaagaugguauuuuguaaaaggaugaguggugguaccauucaccgaauugggaaaggaugugggaguuuuggaagaacaaaaauugcaaguuggauuuuguuaaguuugagaugccuguuagauaucuaaguauauagguuaaauaggcaauuauguauguuaaucuggaacucagauguucuggaccucagauaugaauugagaguucucagcauucacauuggagguugaacaugugggacuggaugagaucaccagggaaggagugaagaugaagaagagagggguaugcuuaacugaguccauaaggccuaggguuuggugauugaacaaaaaaggaggaaggagcaaaagggacucagaaaaaauuuccaaugaagugaaaaaacgcagauuugucauguucagaaauagagggaggagaauaucucuuagaggaaauggagagaggagaauguuucuaagaaagaaugaucuacuggauugaauugggcugaauaaccaaauaggaugacacagcacacuauuuugguaauuccacagcuuggacauuccuggugauuuuggaaagagcaauuuggaggaaguaauguggcuggaagcuagagagugagaugaaggugaagaaguagaaacaguuuguggaaacaacuuuagagaaguuugugugaagagggacagagauuuuagguagugcuuagugugggggcuguaagguuaagagagucgauugacuuuucuguuaaaauggauuauaguaaagcauguuugugugccuaugagaaugacccacuagaugagagacugaugauuaaaugcagaggggacaaaggaaggaggacaggaaggcuuugagaagauaagaaagugagauuuagagaauuggguuugguaagaacuggaaugcauuuuucauuaugaccagaaaagucaacgagaaggugaguuuagauguacgugaacuagaccauuagugguggaagaugaaagguucuccaugcaagaacugagcuuuaugaucuaucgagcacauugucagugaaguuggagguaggacuaagagaaguuggaagagagaggauuggguguaaguucagaucuuugugagugggauggagaguuuccuaggguaaauauaugguauugcugggcaguaaugagugccuauuugugguuuauauuauuaaauguaaggaaagguagcccuguugaacuacucuuuaauagcauucaucuacucaaugaggcaaugaagaagaaugcagauggaagugggagaaagauggagcagggaagaguaagaucuuuggaaaugagaggagaacaggauugccugugguccauaauagugucuaaugugucccuuucucuggguggugucauuccucacuagagcuauggcuuggcaaacagaccuuaaguuggauuucaaacuucacuuccucauugaggcaguggucaaccucuauauacagugccccugaaccugaagcucaguauaggaacagaguggauacauguguugugcuuucuacagugggauuuugccuggaagaugggugaacaauaaccuggagguagcaguggggagcagggaggacccuuauuccagcuucucaaacugaggcauaaaggaucugagagaaaaaggaaaagacuucaugaaaaguuugcagggaaccccaugcaguagcucaugucuguaauccagcacuuugggaggcugaggcaggugaaucgcuugaguccaggaguuccagacuagccugggaaauauggcaaaaccucaucucuacaaaaaauacaaaaaucagcuggguguggugacacaugccuguggucccagcuacuagggaggcugaggugguagguucgauugagccuaggagguggagauugcagugagcugugaucacaccacugcacuccagccuuggcgacagaaccagacucuggaaaaaacaaaaaguuugcaggagaaauaauggcccuauggaaacugguuucagugaagacaaaaagggauuggccuggggagauggaagguacagcagagucugcugauccuagaagaggagcucuagagcaugguggaagaaggguuggggaguguguuggagcagacuggggaagguauuggaguuaugauucaauauugguugacuaaugaagaccaaauaucugguagugacuuagcuaaaggggaaauaggauguggugagggaaauccucucaaagaaauggcucuguggucuugacuauuuauuuccugacaaucacagccccaagagagaugcuccuuuggguucacaaggcugugggcagggaucaugggguagcagcaggggauugugaaaugaagacugacucuucuuucaacugcauuuuuccccacagcaugcuuuaauguauuucccaggugaauauuauuuaaaagaacaaaauuaccuugugaaggugcucacugaaaaguuuaagguauuguuucauuguaaguuuucuaccugccacucaaacuacugaugcugcuguuuuucauucuaaaagagauaaauguauuuaaauauuauauuaauguaaaggucaccuuuugagcacaccaaaauuuggcaacacacauugauggguuuccugagaugcucuuuucauuaaacucuuuaaaaagagagacauaucuauucauguucaaauacucuuuugaccaauuauaaguaaaugcacaauugauuaaauaauauaucuuguagcuuaaaauaucaaguauuauuuaacaucuuuaaaauaacauuuuaaaaaggcaaguaugucauguuuuauuguguuacaaaaugauuauaggcuauagggugucauagcugcuuuuauuacaaaaauaucuuuuaaaagcuaagcguuuacauuuaaaaaaaauccuacuucccuuuacuguaaaguguuauaaaucugucacccguggauguccuuaaaucuuuuuugggaagcuauuuauauuuuuacuuggugucauuucuugcaguaaagacuuuuauagucuguugcuucuucuguuugaaguaaaaaaaaaaauuauuucugcuaauguuacccuucuaaacuuaaaauguuguaucuuuagguuuuuagucuguguucuuugugauuuguagauuuaacaaaagauuuagaaaaaaauuucuuugccuuugucuucuagccacaaauuccuaagcuuaaaaucauuucuuuuccuguaacagcauuccuucccuuguauuaucucguuauuuuucucaauacguccucuagcuguguucugaucuuucuugagacguagcagucagaacugccaaauaugaaaucuacauugagaaucauagacgaaugcaaguucagugcuggaugcgaucuuagaacucuuccacauuaaugcuucccaaccuuuuuugcgaucggcacacuacucaucuauucccgccagucaucuuucguuuacaugcagcaauucuuaaugaagcugaauuugaaacuagggauggaggugagaguggaggaacacuucuaguagguuuugugauuccugugauggauuauguaguuuuaaaaggaucucuggagauuuugaaauggguaauuuacugauccaguacaagccccuuauuuuaaggaugaaaaaaauaaauuggagauuugaaaugauuuaccccaagccauacagcuaguaaaugguggaggugauagaauuaggucauugucuuuugagagcaguguacacaaauggcauuaaaggugguauauucaccuguguaauaaaguaugaauacguguuccugagacucuaauuucagugauuuuauugacuuaugauauuaugauaaaucauguggaguuccuugagaauggauaaaaaaucuuguaauauugaguauaccauacucuagccuagggucuaauuuuuaaaaguaagaaaaaauaaacuggagguggaggaaacaacuaagcuauagucuauuagaaauuuuauauaaauuauauuaauuucaaaaaucagaauauaaaauaacauguauaagcuaugauuuuaaacuuaaacacauacauucauuauaauaauaugaagacaauuugcacugcuauaaguaggguuugacuuuuaguauagucauuauguuuaguaguuaaguuuaugauaaaaauuugauaccagcuauauaugcauuaaaaaaaaauuccaggacacuuaucauuaaauuucacauuugcaugcaauaagcaaaauuaauugccuaguauuucaccaaauucauacaugagguuagggaaaauauuuacugaguauucacuauaucuugauacauuuauauguguauaucucauuuccuccuucaaauauugcugcaauauggagauguuauuccuauugcuguauaaguuuauucaauaaauacuuguugaguuucuacuguauguagguccugguccuauugggugcacugaugagcaacagcuuuaaacaggcaagaaaacaauugcuuacugucaugaucagagauacaaugaggaaggcagaaaagugucccccaaagugauuauucuggauuuucugggugagccccauuucaucccaggaguccuuaaagguggaggagguggcagaagagugguucagagagaugugauuugacgacuuuaccugcuguugcuggauuugaagguggaagaaguggcuaugagucaagcaauguggcaaccucuagaaguuggaaaagaagaggaaccagauucaccccuagacccuccagaaauaaaugcagcccugcugauaacuugauuuuagucuaguggagacccguguugaucacugacaaaacuguaagauaauaaacuuguguuguuuuuuaccacaaaguuugugguuauuuaugauagcagcaaugaaacaccaauagccaugguaggggaaacuaugggaugccuuggggaagguaccaugguuuuggaaaguguuugcacccaggucuggauggucaguagaaguuaacuaggugggauggagaaaauuaguggaggcuggaggaaaggagcaggaggauauuuaagguaaaaaaaaguaaaauguagaggucuggaugcgacagaggcagugaccacucagaggauuaauaauugguucauuuuuauagauaaauaacauaugaagugugaaguggggagaugccuccuggggaggugagccagagucagaugauggaaaaccuguguaucaggcaaaguuuagggaugaugaagacaauccuugcccaagcgcucauggcuagugagcaauggagcuuugucuaccuuaauccaaaauccauauuuuuuuacuuauauaaccaacaaaguagacaucucuuacaaaacaacuaaaauuuguuuuucugaaaguuucauacaaagugaauauuuuuuaaaguaguaucucuuuucucacugaugaucaguagauaauuugucaauggguggucuagcuucuggauugagaauguuccacuggucaccaaagugugcugcugaaguuacuuuacccaguggaauacugucugaggccaagugcucauggucccuuagcucacuuuuccuuugaaguaugaccguagguugucuaccuccccucguagccuuguccuuuauacuugcuagguauuuaaauaucugucauauaagaagaaucaucugccuuuacacuuagguuucuuggacauuugcauccuuuucccuaguuuggacauucucaggguuuaauagaauuaaucuguaaugaucucuuuuuacauuagcuguugccauauaaccuauuaugugcauaugaauauucuuaaauaauaaaaaagaauucugauuaugggaaaugaagguguuugaccuuacuaaauuuuuuaaugacuaaauuuuauauauugaauguucuuaaaggagaaucaccuguguguaguggauugauugcauaugugcacuccuuuaaucuuuguuuucuagugccuuuuuagcacagccuucauuuggcuauucuuaauguuuuuucuguugauguuuuaaaaauggaaaauaugggcaggguuuggggaaggauaaaacaccaccaacaacaacuacucaaauucuaguggguaacuucuaaauuuuaaaaauuaaaauucaccuaugauuacaaaaaaaccaacaaccacuaagcacugaaagguuuauaacagaauauaguucuuuucccucgacucacugcaguccccuuccuagaggcaacuauucuccuuaccuucuucuaucauuuuuacauuuccauauucuaaauaaaauggguaugccaucaucuuucaauucuuuaguauuagaaauugucugcugauauccuauuuugguaaauacauaggaaguugcuuagggaugcuacuguucuuuucccugcuucgccauugaauuuuagguaaauacauauacaguguugacauuauuuugcuuguccaaacauuauuaccagcuaaaaacugagguuuacuguaauuuuguuuccuauguguuuguuuuaccugaaauuaauaauugccuuauuuuuauaugccuaguuuucuuugcaccuauugcuaaucccucccacauuuuccagugaccugacaguacaauuuuccacaaagccagucacauucagcaggcuaucacuucuaauauuguuccuugguccuuggugaccucucuucuggagacaugcuuucuaggccugcugcacagccaucaugcuggguauuugcuuugcuccuaguuuagaaucccuguugcuuggaucucauggaaguuuuguguuauucguuuguuuuugccuuuuuuguuuguuuguuuugguuugguuuauuuguuuucuucuuggggcgauuuccucauuuugucugaguguauccuuuguaaguuuugucacguuaaaacaggaauacagagugguggcaacgcugaagacagcccauaccugcuccaguuuggauucagacccucuuuucugugaucuccucucaccauuaacaggagagccccuuugcuucuuccugggcuggaucucuuuuuuaugcuucucauaucuuccuccuucuugauuugcaaacugaguucugugggggauaucuaggagcuucuugaaaaaugguauguaggaguuauuuuuuauaauuagcucaauuauuauuuuuaguuuuuuuaaaaaaauuuuuacuuuaaguucugggauacaugugcagaaugugcagguuuguuacauagguauacaugugcguggugguuugcugcaccuaucaaccugucaucuagguuuuaagccccgcaugcauuaggcauuuguccuaaugcucucccuucccuugccccccacccccugacaggccccggugugugauguuucccucccuguguccauguguucucauuguucaacucccacuuauaagugagaacaugcaguguuugguuuuauguuccuguguuaguuugcugagaaugaugguuuccagcuucauccaugucccugcaaaggacaugaacucauucuuuuuuauggcugcauaguauuccauguuguauaugugccacauuuucuuuauccagucuaucauugaugggcauuuggguugguucccagucuuugcuauuguaaauagugcuacaguaaacauacaugugcaugugucuuuauaguagaaugauuuauaaucuuuugcauauauacccaguaaugggauugcugggucaaaugguauuucugguucuagauccuugaggaaucaccacacugucuucacaauaguugaacuaauuuacacucccaccaacaguguaaaagcauuccuauuucuccacauccucuccagcaucuguuuuaucccgacuuuuuaguaauugccauucuaacuggugugagaugguaucucauugugguuuugagcuuuuuuucaucuguuuguuggccgcauaaaugucuuccuuugagaaaugucuguugauauccuucgccuacuuuuugauuugguaguuugauuuuuucuuguaaauuguuuaaccguaggagcuaauuuuaaagacauagcauggccgggcacaguggcucagccuguaaugccaguacuuuuggaggcugaggcaggcagaucacuugaaguugggaguucaagaccagccuggccaacauggugaaacccuaucucuacuaaaaaaaaaaaauacaaaaauuugcugggugugguggcacaucccuguaguuccagcacuuugggaggccgaggcgggccgaucaccugaggucaagaguuugagaccagccuagucaacauggugaaauccugucucuauuaaaaaaauacaaaaauuagccagguguaguggcaggcgccaauaaucccaacuacuugggaggcugaggcaggagaauuacuugaacuugggagguagagguuacagugagcugagaucacaccacugcacuccagccuuggugacagagcaagacuccaucucuagaauaaaauaaaauaaaauaaaauaaaggaauauuauggaaagauugucauuugguaaauacuuguauaaauaggacucaggaauaugaagguauaaaaaguucugcugaaaugcaguuuauagaauggguggaaagauacgaaaacuauauaauguaguuaaaauacaauuuaagaaugaaacaagaucaucauucaaggccuuuuuccaggauucaugugauuaaucauuguuugaagaggauuauugaccuuuuacgaacucauaacaaggauacugaacugggauggaauauucuggaagagguaguccuuaacccuuaaaggagucguaggauugugguaggauugugauaaauggagagggucagcaagacauuuuuauguggauauaacauuuucguguggacacaauauuaagaauauucuagagaaaaaggagcacaccacuauuaccuaaacagaguauugaagaaaacuaggggauaaaguuugagaaguaaacugggaucaauuauggaggaaauuaaauuccaggcgaggaaauuugaacugauucugcagguuaagaaguaagugcuaggaugagguugaugacauucaagaaugucauauaaacagaauguuaguauguagucuuuagugucugguuucuuugacuuagcagaaugcaugugagauuccaugcauguuguugcauguaucaguaguuugcuuauauuuauuguggaauaguauuccauuguaucccuguaccaaacuuucuuuauccguauguaauaccaguugguauuuggguuguauucaguuuuuggccauuaccaauaaggcugcuauauacacuggcauacagauuuuauguagacauauggugguuuuuuuuguuguuguuuguuuguuuuugagacaguuucacucugucacccagacuggggugcaguggcacaaucuuggcucacugcaaccucugccuccugaauucaagcaauucuuacugccucagccuccugaguagcugggauuacaggcaugccccaccaugcccagcuaauuuuuguauuuuuaguggagaaggaauuucacuauguuguccaggcugguccugaacuccugaccucaaguaaucugccugccuuggccucccaaagugcugagacuacaggcaugagccacugugccccaccuagacauauguuuuuguuucucuuggauaaauaucuagggguaagauugcugaguuguaucacuaaugcaugguuaacuuuacaaaaaacugccagcuguuuuucaaaauggcuguacuuuuaccugcaauguaugagaguugcaguuacuccacauuccugccaacccuugguauagucauuuucuuaaagccguuuuaacaugaaguaaugucucauugugguuugaauuuacauuucucuaaugauuaaugugcugagcauauuuucauuuguuuauuugucaucuaaacaucuucuaugguaacguauagguuuaaaucuuuugcccauuuuuuaaaaugauauguuaaaaaaagauacugcaucauuauaaaauaaaaaaaaugccaaaaaguacaaauaggaaaguaaaccaacuuaaaucccagcacccaaaaauaacuguuugaauauuaaguuaauauuccagacauuucucccucuauguauauauacagauagaaggacggauggauggaugaauggauggacagagagaaaaaauacguguaaauaaagucuauuagauaugcugauuuuuacugugauacaauuuguauacaguaguccccccuuaucugugguuuugcuugcugugguuucaguuaccugugguauauacaaaaagaaaucuugagaaagagagagaucacauugacggaaguuuuacacaguauauuguuaugauuguucuauuuuauuauuaguuauuaucaucaaugucuuacugugccuaauuuauauuguaaaaauagguaugaugcaugggaaaaaacaugguauauauaagguuuggcacuaucugggguuucagacauucacuggggauguugaaauguauccccuacagaucaggagggacugcuguaucacaaaauucaucaggauuuuuaguauauucaccauguugggcaaccaucacuacucuuaauuucagaaaauuuaucauccuccaaagaaaccccauaccauuaguagucagccuccauuguccuccaccaugcaauccuaggcaacaccuaaucuacuuucucuauauauaugaauuuaccuauuuuggaaauuuuguauaaauggaauuucaccauaucuggcccuuuguguuuaacuucuuucacuuaacauaguguuuucaaaguucauccauauuguaacacgugucaguacuucauuccuuuuuaugggugaauaauagucuauguauaaauauaguguauuuuguuuauuaauuucugucucaauuuagguugauucuacuaguuggccauuauagauaaugcugcuacaaacauuuguguacaaguuuuucuguggaaauauuuccaguucucuuggauuuaaauaccuaggagugaaauuaucgauacuaauuuuuaaaauugaguuguuuucuuauuauagagcucugaagaauauaaaguuuuaaauguugaauuuacagguguguguaucucuuaacucauauaacuccaagauagcucuguguucuaauuuugauguagauuuaaugaaggguuuauagaagcucauuuguccaaugcauucuaaauauuacuaaauaagaaaccaacuuguauauauaugaauuguuuaaaauauauaaaaucagcugcuucaauuauuuuuauuuugucuuaaauauuucuucagauauuauuucuuccuagaauucauuuagccacugacuguaggaguauuuguugauacugucuuuauguaagucaacacaaaagguaauuguauugacuuacauaaaggcaguaucaacaaauauucguauagucgcugacuguaugaauauuuaauccuuaaaggagugguaggauucagugacugaaugaauagaauugccuuuuguauugaccuacaacauaugggggaauaauuuaacuuacaauuaugagcuguaaaauguaguuauaauuauuuuaugauauggaugugauuuuaauauuuuuauggcucucccccuuucacucuucucagaauucacaugaucccuccacuaaggauuauucaagacacacauacagauaaaucucccaguuaccuauggugacuugaauaaaagguccuuugggggcugccuguuaguuuuuuauuuaggggaugcgugauguggaaugucacaacacuguaaguaauggagccgugcugucauauuguuacuuucaguauugcugacagacagaacgccuuggaggcugaguggaggacggugcaggccucucgcagagaucuggaaaacuuccugaaguggauccaagaagcagagaccacagugaaugugcuuguggaugccucucaucgggagaaugcucuucaggauaguaucuuggccagggaacucaaacagcagaugcagguaagugcaugggaaaccacaccaguaccuguguuugcccugugugcuuuugaucccucugcaugcaaauguguuacccuuaaaaggugaaguugucacuuuauucucuuaugaaauccgugcucuccugugaauaauagguuucuugaaauaagcucuauuagauauuuuuacuuaauguuagaggggaaaaaacccaccuuguuuuauggaaguaauaauuguuuauuuagaguuagaggcucacagcuauucugcuuuuugucauuuuaagcccuauuaugguuagcuuuauugaauccuaaauuauaagggcauuuucccuuaaugugaaguuguuucuuucuccauuuauuauacauacuuaauauaaaagcugcaaaagcucuauggcuuaguuuauaacuaagaauauuaggcuugaugauauuacuuuuaugucauuagcuugauaacugugauuguauauguagucugagguucaaauauuucuucuacacaaaaugugcuaauauaaaacuuuucauuuauaaacauuauaaggaaucuuaugaaauacgucugaaucuuuuuuugcccucaaguaguucugcuucaguacucuugaaccuuccaguucaaaaucugauucaugcggaguguggugccucacgccuguaaucccagcacuuugggaggccaaggugcguaggucaccugaggucaggaguuugagaccagccuggccaacauggugaaaccccaucucuacuaaaaauacaaaaauuagucgggcgugguggugcgcaccuguagucccagcuacuugggaggcugaagcaugagaauuacuugaacccaggagguggagguugcagucagccaagaucgcacuacuacacuucauucuagguggcagaacgagacucuguccacucccaaagaaacaaaacaaaaaccuauuucaauggggaagucuccuugucaaccauaguauuacaucugauuacuuuauaccaugccaugcucacaucaguuugacaacuauuauuucugauguaccugugaacacguguuccauugucuuuuguuguuguuguuuuguugcccaggcuggaguguaguggugcaaucucagcuugcuacaaccucugccuccuggguucaagugauucucaucccucagccaccugaguagcugggauuacaggugugcuccaccaugccuggcuaguuuuuguauuuuuaguagagaugggguuucaccauguuggccaggcuggucucaaacucuugacuuuaagugauccaccugccucggucucccgaagugcugggauuacaggccugagccaccgugccuggccuccauugucuuuugauacaugucucugcuugucccaguuggucacaugguucuucaagggcagagauuauauuaucuguauuguugccuacgcagugcccugugugcaaauccuaagugaauacugacugcuguccuuggaccuugacucaccguuaugaaacucagcauugaaaccuuuuuuaaauccguucuuaggaacucuuuucucugaaaacaugaaaaagaccauuuuguaaaaugucaacaaauguguggaucuggaugaaggauacagagucuuucuuugaacuacucugauucuuacaauuguucuuuaaguuugaaauuauuuucacugaaaaguuacacaauuugaaaaacagaucuuuuuggaaugagcuuauuuauaaauugucccugugcaugaaaacucaugguguuuuacuguugaguucuuaagauucauuuguugaaaauuucuguuuaaauacauugcugcuucuaucuuauucauugcgcaauacauuuugugacuugguaaugagugugaccaggcaaguaucaaaauuaaaucuguuccuuugacucacucuuuugagccucaugaggucacuauaaauguuaauugauaaaauauuuagccaucaucuguauuuuaggaggucauagaggacucuaaguguggauagaugcuagauuauuuauuuuuuuaugauuuaaacaagaaaaagccugaccuauaaaugcucacaguuaguuaacuuaugcaaugguuuaauuucaguagcuaucuaggcugugcacuugaguagguaacaguuuauacacaaugaauaaaggaggcuuuaaaugaacccugguaaugagcaccagcaaaacacaggccuauucuagaguuuaaugaugucuucugacauauuuuaucuuaggauauauucuuaccauagcuaagacucuucucaauauuuaaugaauauucaaacaguggaagacaaauguaaauagaaauguuuaaaaucuuucaaaauaaaaauaucuaagcacaggauuacuuauggcaaacagcaucaagaaagggugcugauaaaaauauuaaaauacauuauaaugcuuuauaaaauauaauacauuauuacuuuaguguugcuaaaaauagucucuuuuggcugguagaaaguaauaaagaggacauuuacuaagaguccacuaaaauuccuuuguuuaaagauaaauauguacauuuauguuuagaauguuucacauuacgguaauucgcaugauuuuucacucccuugcuuuguuauuaaaugcucuuaauuuuaaaguguucucuccauucuauuuuuaaaaaaguuccaugguuuuauuuucagcaccuuauagauagaagauuguuagagauuuaguaccuuuuacugaguuuuucugaggcaagagaauuuuaauuuuuuuaugguguuguauauuaaugauucuccuuuuguaugaguaaacagacauuuaaaauagaaacuuguuuggaaauggagagacguuuguuggagaaaaugacuguacagaagcauggcaaaucauaacagaaaaguucugguggcauggugguggcagugguggugguggugcugguggugcacagucuuugugcacuaaggaagauggaauaaggagcuccguguaucuuugcugcaugcacaggauguguauguagaacuacuuagcugacacauucgcuguuuauacuugcuucaugucuuaugacaaccagauccaaggccaugggaguauuucaggaagauaaagcaguuuauucuaugcucaguuuaaggugaaucuugggugaauuuugauaaggauaggucuaaagcacauggaagaugauuaacuuuugggaguaugcuaugauacaugccauucuuuuaaggauggaugaugauuuggauuuauguaucuauguuucauugcccugcugcaaggcuguuaggauuuauuccccagcagaagccuuuuggcaagagaaaagccgauucuuuggagcccugcaggagagacaagcuccuugagaacugagcaguccagcucauagagggucuuaaaugccaugcaaguauuuauauuuuaauccaguggcaaugaagagaagucauaaaggauaguaacaagagugaugcaaugggauuuuugcuuuauaggaauuuagcugaugguaugaggaauggacuugaacuagacaagagugacagaagagaggccuguuaggauacucauguagccauccaggcuacagguaauaauuaccagaaaggagacaauggcagggguaguagaucuaaugacucaauaguauacauagacugaggaaggggaaaggcagauugccaagugguguuagagccuaagacugggaacauagaagaaaaugucagagcaggguugcaaguuagcgggaaauguguggggauggcaaauuucaucuguuuugacuuuguugaaaugaagcauuggaguaacauccaggaggaauugccugguaugcaguugucacugugaaucuauauucagauaagaguauuuggccaaagaugcagaaacuuuauuuuuugcuuuuguaugaaagcccauuauugacuuccaacuaguuuauuaguucaagugcauuuauucuuaaugugcauguucauauucuaaaagauuguuauucuuuuaauuauauuuaaaaauuucagcuuuacauuuggcauuaccaauuaauugaaaugcucugauucuuugcuggguaaaauccugaguucugcugccuuucuggagugguguugucauggguggcugguuuugcucucuaauaauuuacguuuuaggauuauuacacuuuuaucuccuauguuugcuuuuagccucauuuucaucgucuuguuccauagaugcagacuuugauuauagauuguuuuagauuuucuccugugcccagcugcaugcuuagcacuguguuugaggggugaaugccuaucucauggggacuucaucugcugguucuaggacaggaauuauagcuucauacuuauuuaauaacaacuuucuuggcauauaauucacauacuguacaguucauucauuuaaauuuuacaauucauuuguuucuagucuauucacgauuguacgaccaucaccacaaucaaguuagaacauuuucauuaccucagaaagaaaccccuucccuuuacuagcaauuucccauuccuccccgccaauucccuccccucugaacaaucacuaaucuauuucuaucuauuugccaaauaccuuaacauuuuauacucuauccuuugaauauguucuccacuuuuggcuuuacacagauauggugacauuguuagccucaccagagggaggcaguguagauucucaguauggaccugcagggaaaaaagauacaggcagaaguccacagaacacugccugaugaacacaguucuauaagacccaauaaagucggcaaagcacugcuugauaaacaccguucuguaagacacaauauaggacuuuaaaucguuguaacaugaaggacuaagaaaggcaaaugaaguaaaggaggaaaaacaaauacuugaaaauacugcauuucuuuuaaagaaucaugacaacauuagacagaggugaaauugcagcauuagcccgguuaccaguuugagcaggacacugauaaugagcaacaucuggguucuauuucuggcugugcucuuugacccagucauuuaaucauccaggguuauuuugcacaucuccugauaguacuuuaccccaguugauauuugcaaugauguucaggcugcaguagagaauaugucucaaguguguguauauauauacacauagaaccccaaaauuauguacuggauuuuuauaugauauaauuauggccucauauuuccuauucauaaaauuaaaacagcuuuauggcaaauacaaugagaucaugaagaugcugucuaaggggaaauguggcaauuuggaauguucaguagucaauuacagacuuuuaauuuuuuauucacuuagcuguuuaauuagacaaauccuaaccuauuccauuucuaauggcuuuccuucuaggcaggcagaugagaauccacuggaucgcucugcuuuuagggugucuuagucauauaaccccugcaaguauuuuuuguuuugcuuuauuuuuguuguuuuguuuuguuuuaggugauuuugggcugagaucugucugggggugauuuuuuagcacuuaauguaugggcuguugucaucagagucagguguacccuucugcucuucucaagauuuauaacagggucuccuguucacuaauucacagagcacagcuagagcugcauuuauuggguagugaacauaucccucuuuagagacggugaaugcucuguucucucuuaauagaaaccagcuacagggcaugcaccguggugguggcagugauauguugaaucccuguucccaggggauguccgcuuucuaucugcagcuuuaauguuucacuuaauauccucuuuggcuacugagcgcacuccucucccgcagccggcagcgcuuggcugcucgacaacuuccuucauuucuggccaugccgggcugagcaagugcugccugugagcaucugcuggggggcuuucucuguggcguuugucuguguuuuuuaaauugagaaguugaaggaauaccagccuccuuuuuccuagaaccuaacccccuguaucuuucaaaugcuuuccuggaaacgagcaugcucagagaacugacaaaucauuguccagugaccgggaggaaaugaucguugcucuucauuuauaaugcaaauucugaggugucuccagaagugugguaaacuuaaaaugauggcuguggugagaacgucucugcagaaaguugugguuuuguugcaucgcuuacaaaggauggcaguuucuucuccucgguaucagaagcucuguaagguaacugagugauugaaaauaaggaucucgggugucugacaguucuacuguuucucaggcucuaaaaacuaaucuuucagguucuuaucaaggaaagauucccuuucuuaguaacugauugugaaagcuguuaaagugaauugcauaauuacauuuuguuuaaaaaucuaaaacagguuuuaguuuuaguacauaguuucuuuugcaauugacacaaucuugucuucugagaugggcuagugaaauguuuggagaaaauaugaugcaaaacuacuacauucauuaagaccuguuaccucucugguacuuugcaguaucuuaauagugaauggcacauuaaucuuauguaaauuuuaguaaaauuaaaagaagagugccaaauaaucuuucaguagauuuuuaaaaaauguuccauuguuuuauagcuaauugcuuuuucaauuaaaacaauuaaaagacauuuuaaaaaaaugaucagacugaauuucaucauaaaacauccccuauauucuuaaaucuccauauauuauaguuacacuugaagaauuuaauuucacuuggauggaugaauuaaguagacuuacuggagacaacuuguuugacaguugcaaauuucuaauacuacgucaucccgaacauaaaccauucaaucagcugcuguauuuuuuuaagucagcuguuauauguuugaucauaguuuuguuuuauucaaacuauguugauacuaugucauuacuuuugucaaaauuagaguguuuugauauaaaaggagagaguuauaauagcaauuuuuacacuaccgcaguacuauauuccuccuuccuaucauauuuuuaguaccguucucaagaauguaucuuguugcucuguuagcugcccaaacucauuugugaucaaaacaacugccucuaagaaaauauuauuuuucugaugauauacaguauggcauguccaggcaucuagaugaugcuuauauggcagcagauugaggugggaagcaguauuccauuaacuuuauuauaucacacuguaauuucuuacaauuuggccaauuagauauauugcugucuggaaacuuuuuuuuuuuccggaaguuuugggagacagauucagguagugggguauucuuuucagaaauacuuacaagaguuuuauuugcauaagaaguuaauuaaaacuuaauggagcuuaauuaauucaguuacaaagauuuguaaaccuaguuauuucaauguguuguguuuugcucuacuucaguggauaaguuuauucugguaaaacauuuauguuuuucaugaaaaggcaauuuugauaauagauaagaaaagcucauucacuaauucaugcuauuuaauuuuuuuaacuaccaguaugaauguauaaagcuuucuuuuuuuuaagagcagggucauuuuccugauccguuuguguguguacuuucacaaaaccaaauauuuuucuaaagucgaagguauuaaguuagugcaaaagaugaaacagcagaagucaaguauuggagaaaguugcuaauuaguuugcuaauucuaccgcaaauaggcacaaguuaagucacugaagucauuggauaaauuaccaucagaagugcuuuuugggaagacuucuugauuuauaauuuccuaaagauaccaugaaaauuuaaauguuuagaauaaauguuacuuauuucauuuagagaauuaaaauuuacauuauuugcuguugaaauacuaucuuccacguauucuuucccauaugcaaaauuaacaacugccugauuaacgcaaugagaaauguacaauuccaguacauugcagcaggugucaguauaaggcagugacauaggagauuuugccuaaagaacuggaaauccagauuaggaagcggcacaauuacuaugaaauaaauaaacuaguaacagauaaauuuuauuugugugguuauauuuugaaaacugaucuaaguuauugagcuauauuaauguaaugaaaugaaaauuuaguuguagacuuaaauauuaacaguugccaucucaaauauugauagagguagcuauaccaaccaaaaauacuuaauuguauuuuaauuaucaauaguccaugugucauaccuaaaaguuuaaauggguuugacauuuauuugcuuuaagacacuguaaauucccuucccauuaaauuguaaaugcugucuugacuuucuccuuauuccucccacauucucuaaauuuaguuucuuagaaaaaaaugcuuuaaguuuguguaucuccauaaaaauacagaaacagucuauuguaaauacauguagagaccaaaaugaaugagaauaaaauguggcauaaucugagggaaauuugacuauuuaaaauucauauuggcauuuugaaauucagugucugaauauuuuuaucuucuuuuaaauuccucuugaggaucauucuuuuuauguauuauuuguuuagucuuuuguuagacuuuucccucuguggcagcucgucuuuucugcuuauuuucauacuucucuuguuugucagaagauaguguguguguuacacgaguagauacuuguguagaauauucucauuuuguggguuuucuuguauguuucaaagagaagggaggaaugaaaaaaggcaugucacagcucucagaguuaaaauauacuccccucccacaaucuauuuacacauucacguguauuuuuugccuuuaaaaauauuucuucucgguuauacauccaauaaaauuugagcaggaagcaaaaacguaagugcugcuuacuuggagauauaauuagcagcauugaaauugcccugaugaccuaaaaucacccuacacuggaugcuaauuuucucagauaugguuuuguuugcuuaguuucuuuaaaauuuucaugccuauaaaauaauuuuucuuuuaguagagcacaguagaaaaaaagcugauguaaaugauuugaaaaauaauauugaauuuaauuuguuuuuauuguuacgugauuacuuugggguguuuuauaucaugaagucuuuagauuagaacuggguuauuuguguuaauguuaaaucagaagagauuuuuguaaguccuccuuauuuuuuucuuagugccaauuucuguaaaauauuuagcaauugagggcaugguaaaaagcaguuuccuguaaaguagauugggauaugaacauuauagaaaaaugagaaaaauuuaaaaauauuuagugcuguaaauugacuccuucgugacucaagcauuuuagaaaauguugauuuaagugauauaacuucuauuugcuugaauguauauguaaaucauuuuaguuuaagugguuuuagucaccccccaaacuauucugaucauauuucuucagcaaaaaucuuuuaaacaucuagcuguauauagauguguauucauuuaaaaauuauacauauaugccauggugaaaucauguauuaaauauuaguaguguauaauuuuguucuuacuuucuacuguugccuuuuuguaccacaguugauucuuuuucucuaugugguauacacaacacgauuuuggugacuagucauuuacauacagagugaaacuauggcuauucuuagccuggccuucuagggggcuugagcuuucaguguggugcugaucucaaagucuuccccggaauacugugucuucugugguauuaaagcaacuacuucugaauauucugugaaaaauagaagagaccagaagauuccaccugggaagucacgauugaccagugaugucuacaaaaggcuugcuuuguggcuguguguguguguuuucauguguggacguggacaacacagaacuauguaguugcuuguagugcuaaugaguaaauagauaaugaacaugaaggcacauuaaucucucagcagguuuuuauguucacugaugaaguaaggucacauauuauuuuucaucuacauguacagcucccuguauuuagagguaguuaagguugaguaugugguuuuuuagaagacacugaauggagugguguauuuucgaccgguugaauuuuguauuuuuuacucucaaacauuuccccaccuuuuuuucacaggagaacccugcucuccuuggacaauuaaauccugaagugauccagggcaauggagauuuacuuuaacaugaucugauuguugagauguguguauuuuaaggucaacucuuggauucccucaguuucucucaauaaccaacucauacauagauuguuugaaccauggagcucagagucaugacccucuagucugcaaguuagaauucccacuugaucauaugaguugucucuucuuggcuucaugagaaagucuugguuagauuaguacagaaacugugugaagguugagguuuaauggagaaaaauggcguauguagauggguuugccuccaucuaacccucucuauggaugcuguagguguguuuccugggagcuguauggauacccacacagacuacuuucucuacucugcguuuguuucugcacuuccuagucaggucaagauuacagacaaaagugagacgggaucaaggagaaaacaccugcaccccugccugccacuaucagacaugauuccuguggcuuccaagagcacaagugccauuuuagaaagcucuuggaccucuguuuugcuguaguuccccaaguugauauguguugucaaaauuauguuuuuaaaaaguuauccaauuaacuaacauuuucuuaaucagaaaacucaugcuaucaaugacuuggauaaagucaauauaauuagcuaaaaacaguauaauuagaucugaugcaaugcuuugucacucacuuaaagaauaacuaauacauucuauaagguagcauuuuaaaauucuuuuauagccaagauaucauuaucauugguguaugucuagaaguguaauacuaguacaaauccggaacaaauagaagguccuucugagauggaguugaaguaguauuaaggauacggauaaaaggucucuuuuauuuguagaguauuauuugauaauuguaacuuaaaggguugaugauuuguguuuuccuagaggcaaaguuuauuaaauuucaaguggaaauuuccuagcuguagguacugcuagauuuuaaaugugcagacauagcuccuuccucuuacucuuaacugugaucacuaccaacuucucuuaguauauuugguaguuuauuuuuaguucucuaaaauaaguaauuaguagaguuccuaccauagagauaaaagaauguagaaaauguuaugccuugguagcuuucucaguuucacaaagcuuauucauuucugggcgagguaaaugaguccaaauaauugaaauuggaaaggaugugaagugcaucagaggguugcuuuucauuuuucaucuucuaguuuguucaguucuguggaacucuaaaaagauuaauuuauaacaaagcucacuuauaaaagcagacagugccuuuuagugcuuaauaaauaauaggcuuaugugaaaguauggcuucauaaaguuaagcaagaauuuuggaaaaacaucaaauggaagaagauguugaacuguuugcacaauagacaacuauuuuguuuuuauuuuaacagaauugagagaaaaauggcugacuacaacaauagaauaacuguuagcuguuaugaugggaaaauaucuugauacugcuaguacaguuuccuuacauuuuuaguauuuuagaguuuacaauguguuuucucauauauuacaucauuaauaaauguaauauuaacaauauuauauuaucuuguguccuuaagagauagauaggaaagaaauuuguuuugcaagucagcaagugaaggaacaugccaguaguuaguugcucagcuaguaugcggugcagcuuguguucaacauagauuuucugcuucaauagccagugucucucuaccuguaauuuuagauagagaauuuuuggaauuauauugggauaaaaugggucacucaguauagaagauauagaaagagagauuacauuaacuaaguaauagauauuguuuuguucugaauuauuuccauaugcauuuccuugucuaaagaaauuucaccugcagucuccuuuaaaacaugagcuggagcaugagaacauuccauguuccuuuaaaacauggaauucuggagaaugaggagauguuggaaaucaucugauucaaccauuucauuuuggacauaaggaaacagagauagucuauaauggauguuuuauugcugacagcuuuuuuuuuuucuuuuuuugagacagggucucugucacacaggcuggaguacaguggugcuaucauggcucacugcagccuugaccuccugggcucaagcuauccucccgccucagccucucgaguagcugggaucacagcuacugugcaugccaccacaccgggcuaauuuuuuuguauuuuuuuuguggagacagggccucacuauguugcgccggcuggucucaaacuccugagcucaagcaaucugccugccucggccuuccaaaguuccugacaguuuugagcagguggcuauguacuuguuuuccuagaaguuuaaaaguaaggaaauauauucuuuucaaaacuauuucgauguucgauguucaaguauuggcuauauaauguuaaggaaauaaagauuuuuaaaaaugaguucauuuugcacuuugauaagaaagauggauugggucauuuccauccauauuaaaauaguugguucugguuuuugauuuauaacuuaauuugguuugauucuuaacaguacaaacguuaaauuauguguucauugaacccaguucuccauacccacauguaguuuuuuaucauuauauuuaaaaggacauaauagcucccuaagaaagaaacugaaaggagucaacuaacuuaacagacugaguuguuuaaaauaagaaauauguauauauuuuuaaaaaauuuaauucaaagaacauguauugaauggcugucaugcaucagagauaugugcuaagcagcauaaauguaaaaugcaguguugcauuuuccaugggaaacaaggaaguacaaauauguuguucugaggaauuuuagucguucacacgagucuagcgugagacuaaauucaaacaguucuggcuuugccacuuaccaguuauguaaccuuggcaaauccuuccacaucucuguguuucaguucccuuuucagaagauaggguuggaauuagucucucucucucucucaaucuacacacacacacacacacacacacacacacacgcacaugcacacacacacacacacauaagguuguuguaggaguuaaauaaguuaauauugauaaaaugguaaaaacaaagccuggcacauaucugcuauguggguuggcuacuguuguuaccguuaccacuauugguaggauuauucucccaccuugauugaguguggaucaaaugagaugauccaccugacaugccuagcacagucucaugucucuugguuguggugauggcaucauaaucuucauuaucuuuaucucugaaguaacccuuacaucuuaacaaggauguucacauuacagucgcccagagaauuuuuccaaaggauucaugccccugcagacuuugacucacugggguucagaugcacccuggucaccccacugcgaagaugccauaaacuccugcuuucaacagugaaggagaaaauaaaucuuugaaauuuucccugggguuguuauuuucucugagucucagcuugaggaaaugcaagaaaaaacuucccuugaccaguggggcuugugauagaagauccuguaggaugcuccucaauuuaugaagccuuuucuggauuauagauuaggcucugagauggccccuaaaaaucuaguuaacccacaaagaaacugauauaaugcugauugacauaaaaccucauauuaaaaagaauccuauuccauugccagaaacuaaacaaagcaaaggaaagaagucgucuuuacugugagugauacaggaggaaaaacaaacaugguugcuuaguagaggauggaaagaaauacugagaauuuuaaauguacuucuggaaaguauacauuuuaagaauuaugcuuuuuggugccaucaguuuugagucuaaacucaccccccaaaauccgaauuuaguauucuugguauaaaucuaguauuaauuauagccggaaaaaaaaaguucuugauucuuggcucaaaaauuuuauaaaaugaagaauuuuccuuuuucuucaggguaaauguugcaagaguuaaagagguagagaaaagggggaacuuuuuuaguugaaaacauuaucugauuguguauuuacucuggguucagaauuuuaaaagucuagaguguagcugcaccuacccuggcauccugcaggcuagggugguuguaauauagaaguacgggaaaugcaauuugcucuguagcuuuauucuaggauuuuauagccuuccuuuuacacuuuacacaucgugaaugcuuuguaggucaugaaugcuuuuuuuaugucuuauauugugacuuuuuuaaaacaauguaaauaaaauucuauugaguggcugcaccauaauuuauucagggaacccacuaugguuagguaacuagguuguuaccaauguucucaugauaaauaauucuaugauccuuauacaucauuaagugcauccugauuauguccaggguacguuauuagaauagcauaacuggaccaaaaggaccagaacaaugaaaagcuuuuuaaauuuuuaaauuuuuuuuuuuauuuuuuagacaagagucuugcugucaccaggcuggagugcaguggaguaaucucagcucacugcuacuuccaccucccagguucaagugauucuccugccucagucucccaaguagcugggacuacaggcgugcaccaccacuuccagcuaauuuuuguauuuuuaguagagacggaguuucaccauguuggccaugauagucucgaucucuugaccucgugaucccccugccucagccuccuaaagugcugggauuacaggugugagccaccgugcccagccaaugaaaagcuuuugauauuuauugccggauuuccaucuugcaagguagcaccuguuuacauaaccacuaccagcuugaaugccugauuucuuguauccucacagacaauaggcaauaccaauuaaaaauauuuuaugaaguuguuagaugaaaaucauaacccuguuauagaauauaaacggaaaccuagucaaguugaaugauuuaccugugugggaucaaauauucuaucccagaacugucugaauuucagauacugagaacccagucacuguaguuucuaaaaugggaugcaacaaauacaguauaauaaaacuagaaguuguuugaacacagaagaaggggcaguaaaaucugaauuuaaaaugucagagaaguguuaguacuaauauggaucuugaggaguagauagaauuuuaguagagcagaaaacucugcgaauagacugaaugaguaaacuuguuaccagaaugcaaagucuugacugggagcuguccacguucuuggcgcaaugaacaaagaauugaacaaaaugcacaaacaaagcaacaaaagaaugaagcaaugaaagcacagauuuuuugaaagaaaaguacacuccacagagugggaaugggcuugagcagguggcccaaaagcccugauugcaauuugcuuuagggauuuuauuaaacuaaaaaaauuuggugacaccccuagguacccuuagaggccuccaauugguuacaacacccuauaugaaagaaggauuggccugugaccaaucauaggcugaagugaagccuuggcuugcgaccaaucagaggcugaagguaagcuuuggccugcaaccaaucagaggcauuucccauuuguaggcuaggguagagggauuuuguaaagaggggagucucuggccucuucucacuugggcauggagagaugggguuuuccuuuuggcccaauuccaagaacucagccaugacuuggccuuaggcugccugucuccagacccuauucuucugccucagacauggagcacaaaaguaugcugauuguauucagagaacauuggguacuuguccaucauaaaugucuacaaaguucauucauuuacauuuuuauauuaauaaaaaaguugcccuuuugauugccagcuauguaugccagaucuuuuugacuguuuccaaaauuuaguucauuuucaaaggaaaaauauuugugaauauuggagauacucaaacacagacagcauuuccaaaaaggaauucuaaaaaagaaauugcauaauauuuguaucuuuaaaauaaggacauaauucuucagaaugccucuuuuaaaggaaacagccuucuuuuggauguaagucaguuugguaugggagugacaaaaauguuauacuuuuauguuaugacuuaguugaugagggaauuacacaauauuucaagcaaaaaugaaaaauaauucacaguagaagucagucugucuagaauuaaauuauagauuuguagaacauuagaguuuauggaaauuguagaaaugaccaauuuccuuauuuuauaaauagggaagcagugccuuaacaucuauguagagcuuugcucuuaaagugcuuuaauauauuuuuuuugugcugcccaaggucacacaacccacugguacuccauauuuaagcucccaggagauuacuguaguaucuuucacuacaucuuaugugcauuuauuuuuguggaacuuguauuuaacuuugccugguacuauaauuagcuauuuauuucuuuuugaccuucugaauuguaaacucuugaauuugggacuauaccuuguuuucuaguucuguggacaaaacaguauuuguaaauauugaauaaauaaaccaaauuucaauuuuuccuuagauuuaaaaauuaguacaguaaagcagaaguucuauauacuuugacuuuaguuuuuuucuuuucaaaauagucuuauugauauauaauucauguaaaagucacuuuuaaaauguacaauucagugcuuuuggcauguucacaggguugugcagccaucacuauaaucuaauuuuagagcacuuuugucucuucuuaaaaagaaaucccucacacucaugagcagucauuuccuauuucuucccaccgcacugccccagcccuaggcaacccugaacacuuucucuuuuuaauauuagauugacaguaagauuuugaaaccaugggauuagguaaaagucauggaaauauaauucuaauucauugugauaaauuuacuacuuuaucuuagagaauuugauaguuuugaguuuucuuaguacuaucuagggcagcuuauguuaaaugcuauguaaaucauaucuauaaaauaugcacaguaauguacuuuuaauagaaauuauuuagaauacaguacaaguaaaguauaaugggaaaaaugcugaauuuggaaucacaagaucuagauuugauuccuuacuuguuugaucuuauguaauacccaagugacauaucaguccucaguuuugucuucuagacagugggaauaauuuacauuccacauauuuuagaaagcuguuauaggaccaguguauuaauguuuaugaauuugcuaugcagagcuggaguauuauggaaaucgaaauauuaaauuuccuaugaauaaaaacaacaaauaacaaucaaugacaauauuuaccuacauuugaguuucucaccaugcacugcugaaaugcguuuugaaaacagugacuaacucaaacuucugugugucucaacugaggcggaagaauguugaauacuaaccaccuuaggucuuucugcaaugcagggucaguucauuuuucuucuuuccuggggcacacagccagcuuccauauugagguacauucucugccaguaaaaucauacuauuuccaaacaacuuagauucaaacuggggcuacauaaaaggguccaugucuucagagcaggacuaauagccccugagucugcagcaucuagucaaaugaaguauuuugaagucuuuauucaauccagaauuagggcagccauaauuuuaaaaaucuauacauuaguaaucuuagaugcugggaaggcuugaagaaggaagaucuuucuugaauuucaauaauaauuaaacauucugguaaaucucaaguggcuuugcauaauauguuuuuugagagugugauuuugauagguagugaauaaccugaauuaaugaccauaaugacugagugcuguuuugcauuaauucuugaaacaaaaccuagauugcuucauuacauggccugucuuuguggaagauccuuauacgguguggugguaaagaaaggggaacauuugcucuauuuugaaguaauugcuucuaauggaagccuaaugaccuauuaugcuuauuucuaaaagcugagcaguaagcuugauaggaagcuagagaaagauuggagaaauuaugucauauaaaccaaaauuucaggaaguugcaugugguugagaaucaguaccucauuagacaacuuaauaauucaauaguuuacuuaugccaaaugucauccuuacuuuaaaagcuggagugauuucuagaaauguguccacauccuugcggguuaggguacggggcagcuucuggccagcugucguccaggugucuuaugguuuuuccgaguuucauaugcagaucaaacagggcagugagaguagaguuuuccuguggguauugaaaugguaacauuuaauaaccuauggugacuuuggauauucucaaguuuagcuuccugauuuuuucaagaucaggagacagaagcuuaaaagaguuaauccuauaggauuaauuaguaguggcaaugaccaaacugcgaugauauggauauauuccauuuuuggguuucaugggacuguacuaccaaaguguauuuuauauguuucuaauuuggacuauugacaucaaaugaaucaaauaguuggaguaaaugauuuacuugaaggugguuccaaaaauuaauuaaugaaauguaucucuuuagauaaaacacauaugguaacaucuuaacagcuguugagucugguugucaguauauggguauuuauuuuacucuuuuuucaauuauucuguaugcuugaauauuuuuaugauaaaaugucuuauagguaacaacaacccuauucuaauaaaagcuugucagauuacuugagcccuugcauacuuuacuguugagcaucauaaaagaacuugaaaugcuuuuguuuuuggauucuucauguuucaacuucagauggugacaagugcaaaauggcuuaaaagugccuuggcuaggcacaguggcucacaccuguaaucccagcacuuugggaggccaagguggacagaucaugaggucaggagauugagacuauccuggcuaacauggugaaaccuugucucuacugaaagugcaaaaaauuagccggaugugguggcacaugccuguagucccagcuacuggggaggcugaggcaggagaauugcuugaaccugggaggcgaagguugcagugaaccgagauuguaccacugcacuccagccugggcaacagagugagacugucucaaaaaaaaaaaaaaaaagugccuuaacuuaccuggcaauaaacauuuauugagucugcagcuuucauucauuuagcucauuuacauuuaacugaaacacauuuaaaaauucauuuuuuccuuuugcaaaagcuaggcaugccuacuauaaaaguuugcaacuuuucaaagcaugaaauauguagaguugauacccucauuuauuauauuuuacuaauuccuguagagaugagcaacaaaauuguccuuuaugaaagcugucauucucuaaaauucgauauaguaggaaaguugguguguaaccuuauuuaacaaggcuugcaacugauaacuuuuguugagacaggcaugggggcccuucuuuugguguugacauaauaucuuuuugucuuucuuauucaucaagguuaguagaaaguugucaaguuucuauucuuaagcucuagaacuauccuggucuuuaucuaugaaagaagcauaaacuuugucaaaggaaugauuuacucauaauaagucaaugugaagcccauucauaacuauaccuuuuuguuuugcuuuucucauuucucugagucauuacuuaaagcuggugcuuuauaauuugacuuaaucacauauggugugauucuuuuagcacacauacuguuguuuuuaaaucauuacauuuuaaacuucuuuauaucuagaauuuuuacacugccagauaaccugaauuuuccccugcuuaucuggugaaagaaugauaggaauuacaauguuugaaacauaggguuguuccuuauuuacugaaaauuauauggaacaacauauaucauucuggcuuccaaggaugaaucugugaacgaaaagagucaaacucuguaauauuugaagagauuuauuccaagccaaauaugagugaccauggcccaugacacagccccaggagauccugauaacaugugcccagggugaucaggguguagcaugguuuuauacauuuuagggagaaaauagacguccaucaauacguguaagauguacauugguuugguccaaaaaggcgggacaacuugaaguggcuuccaugucguaggaggauucaaagauuuucugauuggcaguugguugaaagaguucaucuaaagaccuggaaucaaucgaagggagugucuggguuaagauaagggguugcagagaccaagguucuuauuauugcagaugaagccucuaguuagcaggcuucagagagaauagauuguaaauguuucuuaucagacauaaaaacguaccagacucuuaauuaauucucuccuggauagggaaaaagaccuggaaagggaaggggauucucuauggaauguagauuuuccccagaagagacagcuuugcagggguauuucaaaauaugucaaagaaauauauuuugggguaaaauacuuacauuucuuucagggccugcuaucugucauguugauaucuuguuacuagagagagucuguuuugucaaucauaaggucgcuguauuaauguuaaugcuagucagcugugccugaauuccaaagagaggaaguuauaaugaggcauguccaaccacccauucccaucacggccugaacuaguguuucagguuuacuuuagaaugcccuuggcccagaggagggauccauucaguugguugggggccauagaauuuuacuuuugguuuccaaaucagaaugaauauugcuagacuagaaauaacucaaagguuguuggagaauuuuaaaauguauuuauuuauuuaugacaucuaguuugugcucuugauuaauugcucuugauuaaccucccucgucuuuaaauuaaaucaaaauuagcaaauauuuauugcggucuaggagaaaucucauuuaaggcacaaagcacuguguaaagcaguagaauguuuucuuuacuaauaaaggacagaaauugaagaccaggaauuaaccagcccauguauuuccugauauauaccugauuuaguacagguguauuuggggaaauggggugguugguuagggcuggaagaaagugaggaagaguacucaauuaaguaguucucuugauauuauuuuauauugaaaaaaucuuuaagagguuaaacaaauaauuaagguaauuaacgaagcagugagggacacacuggguuggaggcgggagguuauuauucuggacauaccuuuaacugugaggagugaaauggauaugucaacuaugcugaaacuuguuuuuuuuaaaucucuaaguugauuuuguaagguauaaaaaauguuuuuuagaaaaaccucugaaugucaaagaaguauaaugacagcuugaauaugcauauacagcaaaucacuuauaauuuuguuuggcaaaugaaaauagauuucauuagcuuuaaaauagcauuuacacuuuuacucuuggauauauuaaaaagaaagugcacauuuuguaaaauguaguagaaaggaaggaagaagaaaauaaaacuuaccaguuaaccauacuauucagaagggaauauuauuaaugucuuacuuucauuucacucuucuuuucuguguguacacaggcauacccccaucuuaucacacauagcuuuacugugcuuuccagcuguagcauuuuuacaaauugaaaguuuguggcaacccucugugaaacaagucuaucaguguuguuuuuccaacagcauguacuuugugucucugugucacaguuugguaacucuugcaauauuucgaacuuuuucauuauuauuauauauuauuuuacccagugaucagugaucuuugauguuacuauuguaauuguuuugggcaccucaagccacacccauauaagaugcugaacuuaaucgauaaauguuguguguggucugacuguuccaucaacacaccauucccaucucacacuuuccuugggccucccuauucccugagacauaacaauauugaaauuagaccaguuaauauccuuacauuggccuccaaguguuuaagugaaaagaagaauugcacaaugcucacuuuaaauaaaaagcuagaaaugauuaagcuuagcaaggaaggacuguccaaagucaggauaggucaaaagccaggcaggccucuugcauccaacaguuggccaaguugugaaugcaaaggaaaaguucuugaaagacauuuaaagugcuacuccagugaaaacacaaauaauaagaaagcaaaauagccuuacuguugauagugagaacauuuuaguggucuggauagaagaucaaaccagucacaacauuuccuuaagccaaagccuaauccagagcaaugcccuaacucucuucaauucuaugaaggcugagagaguuaaggaagcuacagaagaaaaguuugaaucuagaagagguugguucaugaaguuuaagaacagaaaccaucuucauaacacaaaaguacaaauaauaagcagcaaaugcugauguugaagcugcagcaaguuauccagaagauggagcuaagauaauagaugaagguggcuacacuaaacaacaaauuuucaauguagaugaaacagcagcuuucaauuagaugucaucuggcacuuucauagcuagagaggagaagucagugcuuaacuucgaagcuucaaaugacaagacugucuuguuagugguuaaugcagcuggugacuuuaauuugaaaccauugcucaccuaccauuccgaaaauccuagggcccuuaagaauuaugugaaaucuauucuaucugugcucaauaaauggaacaacaaagccuggaugacagcacaccuguuugcagcaugauuuaaugaauauuuuaagcucaauguugagaccuacugcucagaaaaaaagauucuuuucaaaauauuacugcuauugacaauguacuggucaaccaagagcucugauggagaguaaugcuauuuucaugccuacuaacucaguauccauucuucagcccauggaucgagaugauauuuugauuuucaagucuuauuauuuaagaaauguuucauaaagcuauagcugcuaaagauaguaauuccuuugauggauuugggcaaaguaaguugaaaagcuucuggaaaugauucacugcucuagaugcuauuaagagcauucuugauuaauggcaggaggucaaaauagugacauuuacaggaguuuggaagaaguugauuccuacccucauggaucauuuugcgggguucaagaguucagugaaggaaauaacuacagcugugguggaaauggcaagagaaguagaauuagaaguggagccugaggaugggaaugaauugcugcaaucucgugguaaaacuugaauuguuggaaaguugccucuaauggaugagcaaaaaaagugguuucuugagauggaaucuacuccuggugaagaugcuaugaacauuauggaaaugacaaugacagauuuagaauacuacacaaacuuaguaaaguaguggcuuugagaggcuugagaagaacaaauccaguugugaaacaaguucuaauguggacaaaaugcuaccgagacaucuuucaugaaaggaagauucaauaaauggggcagacaggaagaaucagugaauggagcagacaucauugcugucuuauuuuaagaaaaugucagucaacccuuaacugagcaaccaucaaaucagggcaagacccucuaccaacaaaaagguuaugacuugcugaaggcccagauagacaaucguuagcauuuuuuuuugcaauaaaauauuuuaaaauuaagguauguacaguaaguccuuccuuaacauuguugauagguucuuggaaacuacgacuuuaagcaaaaugucauauaacaaaaccaguuuuaucaugagucaauugauauaaagaagaguuaaauuccuacagcauuuuuuuuuuauuuuucuuuugagacugaguuucacucuguugucaacgaggcuggagugcagggguacgaucuuggcucacugcaaccuccgccucccagguucaagcaauucuccugccucagccugcugacuaacugggacuucaggcacgcaccaccagucccggcugauuuuuuuuuuuuguauuuuuaguagagaugggguuucaccauguuggccaggcuggucuuaaacuccugacaucaugugauccacccgccuuggccuccuaaagugcuggaauuacaggcgugagccacugugcccggccuccuacagcauauuucucaucacaaaagaucaccaaacuucuaaauaaagaccaaaauacuucuaaaacauugaauuguaagcuaugcauacauuuaagaaagacuaguaaauacaagugagauacuuauuuacccaguuuuaggugaaucaaugagugaugucugucauaguggugggaguagauuaauaaaggaacaaauguuugcaaagugaaaauucucaguaucgccuccucccaccaugcaauuccaaaacaaucacaaacaagcacuacucacugaacacugaacacuuucagugcagacuccauacagacaggggcccugacuggaagcauuguuuuuucucaucaauauuauaaugaaagaauguugaauuaaaugacauugaaugaaacaacauuauucuaggaccugcuguguauuauuuuucuuagacauaaugcuauugcacacuuaauagaguaguuuaguguaaaauagcuuuuuuaugcacugggaaaccaaaaaaauugugugacucauuugcuuuguuguggugauguggaacgaaaccugcaaugucucugagauacgccuguaugcauguaaagcaucuuugcacaaauuuagaauugucuuuuauagaauuccuuuuguuuuuaugaauuuuuuuuguuugauucucccuaauaguacuuuauaagcauauuuguauuucuuuaacuauuuuaugucauauuuuuagggcagugguaaacauucuguugcauuuuguguucuggacaaauagcuuucugauuuugaucuuauaagguugcaaugaauuuuuuaugcauaucuuuuacuguaacaaaugauuguguuuuguuaggauagguuucucuguguaugugcuggaucaaagguuauacauugcgagguggcuuuccagaaaggcugucccaaugucuacuccuauagcauaugagaacacucaucucgccauacucugauuagccuugaauuuuauaauuuuuauaucuuuguuaauuugagcauuuuaugcaucagugauuacuuguaagaauuuuuuguuauauuuauugacccuuuguccaugacaaauuguuuauuuccuuugaggugguauacguguguuugauguuucaacacgugguuaacaucucuuugauguuaagaaaugccaauuacuaggaagcaguucugucaucgaaguaaugagguauauuuuucccuaaguauuugagaacaaaauuucagucuuuaucguaaaaacuuucgauauuucaugaaaaaaguagacauuccaaugauuuauuaaaaauaccuagucauugauauauccauuaguuccuaaaaagaaagcagaaguuacaagaaugggcccagcauuauuaaaauaacuaguauuuuuaagggaauuuacuuuuauauuuuaauuaauucagaaauggucuagucaacucuugacacagcagugguauaucaauacucagagccucauaugauuuccaucaaauaaaauguuugaauuauagggguguguuugaaauaugaugcuuuccagaauaugaauucuaccucugcauccugucuccauuuuucugcuuccuuguaauuccagauccacugggcuuuaaaauuagauacuguuuuacauuugauuauguuacuuucgaggucuaugagcccuuuucacaucuaggcaguagaaacaguaagucauaucucugagcucguaagguaaaccaugcauggccaugucuuacccagcacauugccuacacauguauaagguaugccauauaugcuguaguuauacuccguguggccuucugaaaagccauauaggauuaugagagaaaaagaagagugugaaguggggcaacuuccacucaauuaugaaugauguugccugaagaaaucaauuagcugauuuuaaggcuuuaaagaauuaaaaauugcauguuguuacuauacuucauaaaauucuaggccgaucugcaagauuaugaaacugacuuuagacuaauauaauuuguuuaaacucaggagcuuuguauaaaugaauuauuauuauucagcuaaugguguguucuuucuaucaugaagaaguugucuuuuucugucaugugucuccccaguacaauauguggaauacuuuguaauuuuuuuucaacuuugaauauuaaaguuugauagcauaaaaaggccaggcguggugacucaugcuuguaaucccagcacuuugggaggcugaggaagguggaucaccugaggucaggaguucgagaccagccuggccaacauggugaaacccgaucucuacuaaaaaauacaaaaauuagccgggcaugguggcaggcaucuguaaucccagcuacuggggaggcugaggcaggagaaucacuugaacgcgggaggcagagguugcagugagccgagauugcaccguugcacuccagccugggugacaagagcgaaacucggucucaaaauaaauaaauaaaugaaaaauaaacgacaaaaaaaaaucacuaaaguuugcaaauauuuuaucugagccuagucucauauuuauggaagaauccacuucucacgauauaucguuggcuucccugcagcucucuguugcuauugaguaaaacucuauugccuugaaaaaguuauucuaauuacuaaugaacacagaucucucuuuggaaugucuuggucauuaccccuuggaucuuaggcuaaugguaucaccuuuguaccaggucauaggaccuucucaguuaauccuauuuuccaugacaguuauauauccaaaacagcacgguacaaaauuuuuaacaaaauuaaauuuuucaugcaucaaaauuuuauagcacaucugccaaagguuugcuauacacagaaucacagcccugauauccagcauuggcauauaauagguaugcaagaguacuugaugagaugaauuaggauagaauagaacuaccaguuugcuaggcagggcauugauaauagaacuuccuuugcuguuucauuaugaaacuccaauuccaggucuguucccacucuuauuucauugugaccgaauaacuuuuccauuaccauucaguuuugacaagagauaaccugucaauuauuuguauaaaauuacuuagaagugaaucaauauucuguuuauugugucaccucuacuuuaaaacgcuacaguccuauuucuugcagcuaaucucagaaucuguuaacuucagugugggugccauuuuuuuuuuuuuuugguauuucauguuuuguaucuaacaacugaacuuaauacuuaaguauaaaguaagaaaucuucauuucagauuuucauaguauaaaugcaggcuaaguuuccugauaucugggauauuuagaaauuaagcagaagaaauuauuuugaggauuuuaugacagcuuuuuacucuuauuuuaaauucuccuuaucuuucuuuguaaauguuugcauuuuugaguuacuaaaaauaauuuucaaguuuuguaccugucuuaguggcauuuauguccauacugcaaaaacucuuucuuggaaauuuaauauaguauauguuuugugauuuuuuucaugucuuaacauuuuaauuugagguuauuugcuuguuauaaccaaauggaaauauauucuaauuguaccuugucgaccugaaaugugacaaugcagugauuggugaucauaaaugaacuuaguuuuauucaguacuauuuguaaaacaauguuugacauugggaaguuaaacaacugaucucuuuguuauuuugaugugaugacaucauccuacacaaaacacaacuucaaaucauaugcagcuuauccaugcacagauguaauuaccaauacaaaccaaaagagagagcaagaaagagagcgagcuagagggugucuaugaccuauaauaauuagcauuuucaguaacaacaucuguugcugacaauauuggcaguagcacaggaaaaagcaaucauuaaaauuagcuaaugcucaguuuaagugcuacacaauguacugacauuuucaauauuuucauuaguuuugcauuuucucauuccaguaaguaucuguuuucaaguuugcaugaaugccuuguauuauauuaaaaauguuucucagaccuucucucaaauugaucugggucuuaaagcaguauuuccagugggucaaaguagcacugaugcaaacucuuagaaauauaguauccaacacucucgaauuggauucuauaaauuugaucuuacauaauuuagauacugaauuagaaauucuccauaaccugcaacacacauuuuccuaaaaucucauugucuuagcuuucuugaguuuuuauccuggaauuucuguuugagguguaagugccaauauuaacuuuaaaaauuuagugaaguguaagucaauuagaauaauuuuacaggugaccugcaauuccucgcucagagagagaucuguuacccaggaugcuucaggugaacgccuguaaggaggagagaagugaggggcuguggcuccaccacaugauguccuuggccucauuguacauccuuuacccauuuauuugcugguuuguaaauauguuaaagugaaagaagaaaaguaauuuucucuuuaaagguaaaacucacuagugaaucaacauuugaaucauuuacuaagauacauaaacaaauauggagucugcaaaauugcuuaugagaaucaauguugagccagaaauuauguuucugcaaauauuuugaugagcugaaauauuuucuauguaugucuuguuaauccugucuuuaacaaacuggaucucuguugaacccuauucugggagauaguguguacugugaaagugauuucuguggcccaguuuggaaaauucugcaaauuaugcuuuccuuuggagcugcacgaugcacauuauauuuuuaaggcuaugggaaguucugcuauuuaacuuuguucaucucaauauucucuaaacaucuucucaugucaauauuuucuaaacaucuucuuuucuucugaaccaacuuuuaccauggaaauaaguuuaggaaaugcucuuucugcuauaccaacauuucacugauaaucuuguuugagaaaauuugcaaaaaggaccauagguuucacuggguaaaggcuauuugucugauuuuuugggcacuuugaaacuuugaugacauuauccuggugggcuuguacacuagacuucaucaguacacuuagagauggacacucaucaucaugaucaaaauucaccaaaaacuucuguauaaacuacaguacauuuuuucauuauuuugguaguuucuuguccaaagacuguugugcccaugaaucuguauaacuuagaaggucagagauaaacuggaagagauugaaacaagaacaaggacugaugaaauaaccuugcuuuagagugaccuuguuuuguuuuauuugggacugucucagcauuagcauugaaauccucuugcucugagaaaccccucagucccagauaaagcaggcuggucaaucacucuacugccuucuaacacaaaucuuguguuccccagauuucauuuucaucucuccacacuaaugugauuguuaauuuuguguguuaacuugguuaggccaugguauccggauuuuuguucaaacuagauguuuuaugcaguuauuuuuuagagaugagauuaacauuuaaaucagucaacuucuaguaaagcggauuauccuccauaaugugggugggucucauccaaucaguugaaggccuuaauagaaaaagacugaccuccucagaagaaaagggaauccuacuagcagauggccuuuggacuugaagagcagcucuucccugggucuccagucugcugacuuauucugcagauuuuggauuugucaagccuuugcaaucaugugagccaauuuccuaaaauaaaucucaucagcaaggugguagaauagaaguuaucgggccucauucucuguuccccucucucccagaaauucaacuaacaacuaucaucaggcaagaauaccauugugaauaacccagaacuugagacauccacuugaccacagaacugagaaaagcuguggcugaacaauaagcggaacaguuuucuuugacuguaccaccccucccccaagcugggacaguggcacacacagagaauuucccuagacccaugguuucuacagggggaaaagugaauuggaggaggauauuccauuuccucgccauuuugggucccuuugugggagggagauaugugaaggacaugaaaaaguucuuguguggcuauuuuagaaaguacuugagauagguuuuaucucagacauccacacacgaccucucuaugugcuuugcuggcugcaauuuguuuggguuugagaagaguaauuucaucuugguaucugcaacuuuuauacuacaaaguaaaaaccuauaguaguugcacaaaguauaaaaagaaaggauucaaaacauacaaccacagaaaaccagaaaaaccacaaaggaagacaguacagaggaagaaggaaacaaaggaucuaaauuagaaaucaaauuccaaaacggcaguagcaauucuuaccuaucaguaacugccuugaauguaaauggauuaaauucuucaauaaaauaaccaagacuggcucaauggauggggaaauaaagaauagauuaaacucucuauuauaaaaagauacagaguagccaaauggauuaaagaaaaaguaaggucuaaucacauguugccuaguagagacuugcuuuccuaauaagcauguacauagaaagugaaggggugaaaaaagauauuucacacacauggaaacccaaggagagccaggggagcuauacuuauaucagacaaaauagauuuaaagucaaaaaccauaaaagauacaaaggaggcuaucacauaaugauaaaaagguauuaauucacagacauaauuguaaacgcauaugaaugcaacauuagagagcaccuaaauauauaaagcaauuauaaaaugaccugaagggauacguagacugcagugcuaagauagcaagggaccacagcaucccacuuugaacaguggacagauuauccauacagaaaaucaguauagaaacuuuggacuugaauugcaguauagaccaaauagaccuaacagcacauuccauuccacagcaacagaauacacguucuucuuaagugaacauaaaauaaucuccagaauagaucagauguuaggccacaaaacaaaccuuagcaaauguaagaguauugaaaucauaucaaguguucuuucagaucacagugggauaaaaccagaaaucaauaacaggagaaaucuuggaaaauaaacaaauauguggaaauuaaacaauaugcuccuaaacagccacugggucacagaaaaaauuagaaugaaauuuuaaaaugccuucagacaaagaaaaauggaaacacagcauaccaaaacuuaugggaugcagcaaaauuagcagaaagggggaaauuuauagcaauaaaugccuauaucaagaaagaagaaauaucaugaauaaacaaucuaauguuacaccucaaggaacaauaaaaagaagaacaagcuaaucugaaagugaccagaaggaaggaaagaacaaagaucagagccaaaauaaauggaauacagacuagaaaaauaaaagaaaaauuucaacaaaacuaagagauucuuuuuugaaaaaaaaaaaaucaacagaccauuagcuagacuaaccaagaaaaaaaaaaagacccaaagaaguaaauaucagaaaugaaaaaggagauauuacaauugauacucccaaaauacaaaggaucauaagaacugaacaauuauacagcaacuaauugaauaacauagaagaaaugaauaaauuucuagacacacacaaccuaucaagauuaaucaugaagaaggagaaaaccugaacagaccaauaauaaguaagaagauugaaucaguaauaaaaauucucccaccaaagaaaagcccagaauuggaugacuccucuacugaaaucuaccaaauauuaaugaagaacuaauaccaauucuaagcuuuucuagaaaaucaaaguagacagaauacuuccaaacuaauuuuacaaagcuagcaauacaaaagcuagacaagcccaggcaugguggcuuacgccuguaaucccagcacuuugggaggccaaggugggagaaucaccuaaggucaggaguuugagaccagccuggccaacauggugaaaccccgucucuacuaaaaauacaaaaauuagccgggcgugguggcacuugccuguaauccuagcuacuugagaggcugaagcaggagaaucucuugaaccuuggaggcauagguugcagugagccgagauugcaccauugcacuccagccucggggacaagagcaagacuuuguuucaaaaaaaccaaaccaaaccaaaccaaaacaaacaagaaaacaauagggcaaucuccauaaugaauacaggugaaaaaacccucaacaaacuauuagcaaaccaaauucaggagcacauaaaaagagucauuuaccaugaucauugggauuuauccccaggauggaaggauggcccaacauaugcaaaucaauaaaugugauacaucacaguaacaaaaugaauuacaaaaaccauauguucaucgcgauaaaugcagaaaaagcauuagaagcauuugaccaaauucaacacccuuucauaauaaaaacucucaacauauuagcuguagagggaauguaccucaacacaguaaaggauguauagacaaacauuuagcuaacaucauucccagugguaaaaaguugaaagcuuuuccucuaagaucaggggcaaggcagggaugcccacuaucacaacuucuguucagcauaguacuggaaguccuagccagagcgauuagggaagggaaagaaauuaaaggcauucuuacaggaauggaagaaaugaaauugucuccauuugcagaugucaugaucuucuguauagaaaacccuaaugauuccacuaaaaaacuucuaggacugauuaauaaaguugcaggauacaacaucaacauauaaaaaucagcaguguuuucauauaccuaugacaaauuauccaaauagaaaauuaaguaaacaaucccauuuacaguagcaacaacaacaaaauacuuagguauaaauuuaaauaaagagguaaaugacuguguacugacaacuauaaaacgcuggugaagaaaaauuaaagaaaacacaaauaaauggaaagauauucuguguuaauggauuagaagacuucauauugugaaaauuuccauacuacccaauguaauuuacauauuuaacacaaucuuuguuaaaauuccagugucauuuuuuacagaaauagaaaauaauccucaaauuuguaugaauccacaaaugauucuaaauagcuaaaacaaaucuggagcaagcaaacaaacaaaaaacaaagcuggaagccuaacauuccuugguuauaaaacauguuauaaagagacuguaaucagaacagcauaguacugucauaaaaucggcaugcaauuccacguugauccauggaacaagauagaaaacccacaaauaaacccacacauuuauagucaacugauuuuugacaaaggugccaggaacacacaauggguaaaggacaguuucuucaaugcauuauguuggaaaaacuggauauccacauguaaaagaaugaaaguagaccccuaucuuacaccauaggcaaaaaucaacuucaaauggauuaaagacuuaaauauaagaccugaaacuguaaaauuccuagaagaaaacauggggaaaaaguuuccugacauugguuaaggcaaugauuuuuuuaauauggccguucaccagcaaaaauaggcaaaugggauugaaucaaacuaaaaagcuucugcacagcaaaggcagcaaucaaaguggagagauaaccuacagaaggggagagaauauuugcaaaccguacaucugauaagggguuaacagccaauauauauaagcacucaacucagcaagaaaacaaauaaacugauuuaaaaauugacaaaguaccugaacagacauuucccaaaaguagauacagaaaugaucaucagguacaggaaaaaaugcuuagcaucacuaauuacuugggaaaugcaaagcaaaaccacaaugagauauuaccucaccccaguuagaauggcuguugucaaaaacaugaaagauaacugguguuggagaagauacagagaaaaggaaaagaacucauauauugugagugggaauguaaauuaguauagccauuauguaaaaugguaugaagguucuuaaaaagguaaaaauagaaauacauacaaccaaguaaucccacuucugggucuuuauauccaaagaaacugcaaucaguguuaaagggauauuugcacucucacguucauuguagcauuauucacaauagccaagauauggaaacaacaacaaaacauccauuaacagaugaauggauaaagaaaaugugguauaucuccauaaugguauacuauucauccuuuacaaaugguguaaauccugucauuugugauagcauaaaugagccuggaagucauuauguaaagagauuaaaguccuuuguaaagaaugauaaauacugccugauaucacuuaucuauggaaucuaauacauuugaauuaauagaaguagacaguagaacuaugguuaucagaagcuuggugggugagggagggagagaaggaaggggaaauuguugaucaaaggcuacaaaguuucagauagauaagaggauuuauggcaaaccaaggagagacaugaaugaaaagaguggcuaccaaccaaaucaacaauaauguguuauguauuucaaaauuucuaagagaauaaauuugagaugucuuaucaagaaaugacagguaagcaaggagaugaaucgguuaauuaguuugauugaucaugccguguuguauccauguaucacauuguaucccauaaauguguaccacuaugguuuuucaauuacaaaacaaaaacaaaaacacuaaaugcauguuguaugauuucauucauaucacauuuuagaaaggcaaaauuaugguuauggaaagcaguucaauuguugacaggggcuugagaauugacuacaaagggacaugaaaggacuuucuagaguguuaaaaaugaccuauaugcugauuguggugguggucccgcuacuguauacauuugccacgacucaucagauuguguacuuaaaauuuuauuuuaaauuaauuauacuucaauaaagcugacaagaaaccccuccccaaagaaaacugaggaaggaacuuauaaaaaauagugauaugauucucuuguauuuuguaaaauuaaauauauauacacgcauuaaaauguguucuaaugcauguaugcaaacauauauauuuucaaaacacuauuuuauuuuaucuuuucccauacuaaaaguacucaucagauugucauugauuucuucuuuccuccucucaccugugacugugggaaagaaugauucucucauuaugagucagagccuuuuuuuuccuuuucugaauuuauaguaacgacucaacacuagaagucucagcagcuugguuugccugucauuaauuuuaccaaugguugcagguguagccugaaagaauagguauaaugcugguauguaaugcuuucuccugcuucuaaaaggugcuguggggagguguugaaugagauucauggugguaaacaagaauauaaauucaaauauuaucuuaaaacagaaacaguaaagcauggagaaaagauccagcugauucuagaaagagcaaaugaagaagaaacaagagugaaaagaguggcuaccaaaucauaggaaaaaauacaggagucccaggaccuucccccaaggacagauuccugggaagguuuccagugaguuuuugaaccuaaccgcuagguuaaauacaucccuuuagucucagcucaucuuccuaauuaaguacaaauucgaaaauaauuguaagguuuucucagauaugugauggauuacaugucaguugcaucacauucuucaagcaaaguaaaugaaugaaugaacaagggaaugaauaaacaaaaggagcuagauauucccugaacauugcaagcuuccuuuggccuguggugcuuccauuaccagcagcacuucaguuagaaugaucccuaugaauuaacuuguaaaugaggaggucaaaugugcuuuugcacagugguguuaaauauguggaugaauaaauucuuucuuguacuuugggcuauggagucuauguaggguuagaaauauaggcuuuuucuaaguuguucuccucuuaggaaaguuauuuacaugauaauuaaagaaguuuagaagcaauuccugaccuuaaacaaagauaacguguagcuuucaauauaugaaccuuuaagaaacccucaacauuucaaaggcacaaauuagagcauuagucuaaauaacaaaccccccucuuucccgauauucauuuauaggguauaaaauacuugacagaaaaguugagauacagaaaagaugcuaaauuucaugaaacauuguuaugaaucaauuacagacauuuuaguuuauuuaaaacaguuuguuuguaacuguucagaaauacuuacauugaaagaauguccacaaagcacuagaucuguaguuucaguggagagucaguauuauauauuauaauauuauaaaaugacacacuucucaauggcgcagcuuccuagaagucauuuccuauauuacuuggccauaaucacuauuaauucaguuucauaaaugauuggacaugaucuuuuaauucugagccuucauaaauaugauuuccucugucuguuuagacuguuuucuuuaggaguccacuugucuaacuucaguugccaucucaggcauuacuucuccugggaagccuaucucacugccuuucccuuuagacaccuggacuaggaguuucucugugcucauaugauacccuuuaggacuuuuucauucaguuaguuucugaauccuuuagcucaaaccagaacacucuaagucacgcuugauugcucauuuuuucaccuacccuauguauuccuauuuguuguaccucagcuagcacauuggucucugccuccaaaguauauucuuaaucaucugucucucuucauuuucaugguuaauccaucaaagccaugccauuuuauccagacaaauggaguagccaucuaaguguuguuuuugcuucuaguauuugaagcaaauacauaacauaaguuauggaagcaaauacauaacaugacauaaaccaagucaugucaguucucugcuugaaacaacccaaaggcucccauuacacuuauaauaaaaucuaaaccccuuacgcugcccuaccagguccuacaugaucaggcagggccauuugucucucugacauuuuaaaaauuuuuaaccaucacuccuguccccuggcccacuguauuuggcucuuuucucuuccuuguacauaccaagccuuccuaccacaggaccuuugcacuagugucucauuaucuugaaacaguuuucacugaucuccauguuguaacuccuucucggcaguagcauuggacccuaaggauguacaauguuuuauacuguguuuaauucaguuacucugaauuagauaagcagugggccuuaacagcauacaggugaaaucuugaauaauuuaacaaguauugauucugaacuauuguuaaauaauucacacaguuaauuauaauuaccauuauugcuuaagaacuacuuaauaaagcaggguuuguggcuagaauuuaaagacaauuuguuggauaccuuuaaucuauagaaauguauaauaaagaugagagaaauaacuguuagcgaauccuuuggauuaagcuacaagccauuauaauuugcaguagcaagccuuguaaugcuaaugacaaauauaagucaguuuguuuccuaugcacucauggaucagugguuacuucggaaauuuguguuuugucugauaguuuuuuuuuuuuuugaaaagcccuuuuuuaaaaaagauuuuaaaaauaaaggugaauuucacacaaucuaaaauuaaccaaagugaacaucuuugguagccuuuuacuuugauuuuuauguauauuauuauaguuauuuaauagccucuaaaaauacccagaauggcuuaccacuuccuuuucaagaaaagaauucuuuagucuccccaaaucuuaugcccacuggcucauuguacagucucucugaauucuaugccaguuccgcucuuauaaauugugagccuguguuucuugugccagguucuauuccaggcgcaggugggcaucagugcagccagcccgccauagcguucuaccaccugguguagaaaucuguuaggaauacgggaagacuauuuguggccuuuauugacuauccuuugccuuugaauccgugagcagaaaucuauuauugaauaaagucccaugaauucaauucaaacccugcauuauugauuuucaagcagaacuugugccauaauacuguuauacuguaguugguuacauucagggucaauagaaaugauuucuugagauaucaguggauaauuuucauugggauuagucaggaauguguucugucuuccaucugucugcacauugugaguucuuaaugauuugaugccucuuuuggcugaauuauauccaccauaccaucacucuggugagcaaaaagagaagcauucuguauuauacaaaugauauguuuagaaacauaacuaagaauguuuuuaaucacccacuggccuacccauccaaucccugcuaucaauuaacuauucugaaaccaucaucaugauuucacaugauauuuccucuauuuaaaguaguguaacuguaagucaccucaauuugguauccagguuugcguuuggcaauaaauuccucuuggcagcuucagcaaguuauauuucuuaauacuggaucugcugagguuauguuuauggagaccagaacuaugaguauugauuuauguuugcuuugaacaucuuccagucuaaagucauuguggcuaugcuuuguugaugaacugcaggagauugcccuugggauugcauugagugaacuuggccccuguacuucuucagaucauuucaggagaguugagguggacuucucuuuaggaagguguucuuuuuuuucagcucuucguaaauguccaucagucuugcucugcauagccaagcuguugaagcaugaucaccuugcauugaauaagcugcacagagcuacuguucuaccggggaguaugcuugcaggggagcauaaucucaaauuuacugcuacccacucgguaccaugcagagcuugcuugggaguucagggaggauuguuugaaaugggcaguucaacuauucuuccagauaaucaaaaaagccaucccucgauuuagcagaacauugagaaauccuuuccuuugacuguauuguauuguuucucuaaaagcuugcuuugauuaaauugcaccuggguguuuaaaaagagaauacaugugaguguuaaugcacuuacauuguaauucagauggaucuuuuuugcaaacuaaauuaaaagguacagagaccauucagagaagccaucugucacuauuugaaaguuauaauuagggucauaauuuuuaaugucauugucauacauuggaaaauggaagcuuugggauauccacuggagguuuuaccucuccucuacaaugccacacuaaauuuggaaauuuauucagcugaaauuuuuucaaguuuaaauauuauauuuacuuuuuauugaugauacuacuaaguacagugcuuccuugaguguauuccuuaauaaauauuucuucaauuuguuugaauauuuugccacaaaccagucuuuagcuugacauuugaauuuaaucuuccauguauuaacuaggcauguacaaaacacaugcuuauuuauuaggcaugcacuaacuguacuuugguuacaggcuaaaagacuuuagaguugguuuucaaaaucuauuugcuucaaagaaucuuaguagucaguaguuaaccaagaaacuuuaaaaaaaugagccccauuuuaauuuuauuuacccaucuagcuauucauuuauuugacagauauuuauuuuugugccuacuauguacuuggcacaaugauaaccuuuucccaguucuuuuacucuguuauuauuguuuaaaguuuggaaauuaaaauacucuauauuauaugcuauauuaguuaaagcuaagcauggugcuguaucauuaaacacaacaauaacagccaaauaaaguuagaacacaccaaauauguuuuauuuacaugcaaauauuuaaaaugauauauuuagguauaguauuuaacaacuuuuauguuccucacaucagaauuuauauucuuucaacaagagccuuuuuaaagauaaggauuaaauugaccaugcauaacuuugaugugauuaagcuauuugaucuuuuaaauagaaucauucgauuuugcugacacuuagcaauagcccauuauuuuagauauaauuucuuugugaucauaguaaguuuagagucauagaugacucccucgaggucuuaguagcauauuaugaauuugguaucuaugugauuaaauaagcacaacaaaauucauaucaaauuggucgauaaacacauuuuuaauauugugccagacuaucauuauuaauuuuuaaaucaauauguaguaguaugaccacaaugucauauucauuaguaaaguacagcuguuuuuuaugccaucaggauuauuuggcauuuaagcagugccuucuacuuuaaaugaugccauuauccuuugaggacucugccuaucaauuuggucagucuagaaaugcaacucauuauagaaugaagcugaauaguuacugaagcagaauacaacuuuacaaccucuuaaaccagaauaugggagaagcccaauuuaccuuuaaaacuuuugggugucuacacagaaaaagguguuaaugugccuugugaaauuucucaauggugaauacauuuuuuauucuaugugauuuauuucuggagauguacauuaaucuuugugaaguugcuguggaauuugguuggguuugucaaaaugugucaaaaaugugaaauaucccaguucuacuaauuuucuaacacaaaguuagauggacaaaguuagaugacaaagaagaagacaaaguuagauggacuccauaggagagaagaggacuuaaaaaugaugccuuaauaucugcccccauuuugaaagugaaauuuugcggauaauguuucuauugcaguugaguuagaaauaaggaagcauuuuaaaaccagguggaugauucaacacuagaccacccaggaagggcauuccuucuguaauaggaaaggucuuuaaaccuggaguaccacaucacauguaauguguaaguguggauauuucuggagcucucccagauauccagugugucugcaugaaugugucucucuuuaucuuuuuuguuaaggaugcaaauggagaguuauauauuggauuccucuugcaucacuuuagaugccuucuguuuauauugagccuggcuuauuuggaguuagcuuguaaauuuaaugagaucauugugauggccaugauugcagaauggaaaaugucacuacuaugugccaguuugcuuaaaucauuuuuaaguacccaccugugcugcuaaacucuccauuugcauuuuauuggcuacuauguuuuugcuccagagcggguuccuuuaacucugaugccuggguaaauuaaucggggugugcaugccauugcccuuuuagcuucugcuccuguucuaauaaaggcuccaucugcuuaauugguagacuuacaggccuuucuuauuucaaaaaaucacuuugaaaaaaagcauagcuucucaagggaaagaagaaccagaacucuugaaaaauguauuauuugggagauguuaaauuucugccaucacugugcugagauguauguagucaaugagaaacagcauccaagauaauacugguuuucuuacuacuuuuuuuccaucucuuguacaucucuaugucuguauuucaugaaaaccuaccuucucuaauaaagguguggugagcuggggacaagacaacucuggggauuuaccuguuauagacaaacucuuuacuuuuuuucuuuuugaucuggcugccuucuuggugauauuacuaugagaaugaggagggaauuaaggauuauuguaaagugaaauagcagcuuugaggucugaaacacugagggagaagaaggaaaagaagagacaugguaaggauucuaaggaggccugaagauaucugggauucccauucuuuuuguccacagcauacuuagguuggucagguguaagugaggagagcuugcauaguaagagcagcuccagugugguauuaguaggguuaaugauugagugugugauuuacaguauuggaucuaaggguaucaugaagucagacuguaaccuuggacaaacuaguuaaccucuuugggccccagucucuccaucuacaaaaugagaguaauuaauggugguauuaccucuuaggguuguugucaagauuaaaugagcuauuacagguaaagugcuuagaaaaacgccuauuuguaauauucauuuuuacuaauaacuguuauuaggagugggaauagcaauuucagugaguuauaaaacauugauuaugaaccauuuuagagaacgauaguuguuuuauugcuaaugugaacaaaccauacuguauaugaaacuuuuuaugguucuccagagaaaccauguauuuuuuucugacuuuguaccuauccuuuugcuuggaugccuuucuucuagaaaguuuuacugauccuucagggcccauaucaaauguaucuuaucagugaauugucucucaucccuuucagacagaaugaguuuacgcccuaucuugggcucccauagcacuuaucucgcuaugaugcaauucucuucucagauuuguauauucucuccuugauggcaaugcagagucuucucauaguguuaauaauaacauauguagccuguguaugugaaacagguggauguugcugauacuuaauuaggaaagguauagugauucucaucguguucacaagucagacucuccuuauaccucaaucacugccguaucuuuuaccuugcauaugagacccccaguauaagaguguaauaacuaucugauucauuugcuaguaaugcugaagggaauuguuaagcugaucuguuugguuuauggaaaagauguuuauucuuccuacgccuucucuuuuuucuccuuugccuccuccuuuuguccuuuuccaccuccucuuccuccuuguccuccuuuuucuuccuucucucucccucuucuccuuuuuuugguuauaauuaguuuauuuaaagcucuugcuuauuuuugcucauccuuaauauaaauagaucuucauuguauucgugacauguuuuaucacauucuucaugaaauuuuaauaaacaguugaauauuuucuauuauuuauacauauguguaauauuacucuucucaaauauaccauugaaugaguguuuuaucuuacaauagaugguauccauuuuuuuuuguuguuuuuuuuuuuuuuuuuuuuuggagacggagucuugcugugucguccaggcuggaguacacgaucuuggcucacugccaccuccgccucccagguucaugcaauuaauucuccugccucagccacccaaguagcugggauuacaggcauaugccaccauaccuggcuaauuuuuguauuuuuauuagagaugggguuuuaccauguuggccaggcugguaucuaacuccugaccgcaagugaucugccugccuuggccuccugaagugcugggauuacaggugugagccacugugccaggcuggaugguaucuucuaaucaagaaaagauauaaguauuuuuaugacaucaaauuuaagaauaauagccaguuauauauuugugggaucaugugauaagaaaaauauauugguuuacuauuuuagauggaauaauaaugugucuuuucugauaucuuuacaagaauguuagaaaucaucuguauuguaauguuguuuuaccuuauccaaggggaaauaaagcaugaacauuuauaggcuuuuauuuauaaauggacuuuuaaaauauguuuucucacaaagaggaaauuuagcucuagaaaacaggaaaggauuguaggaacucccaucugcauuggaaagugacugucacucucguauuggacaaugauuguugcagaugauaccuguuucauucuggaucaccuuuguuuuuaaaaugagacauaacuaauuaacagaagagcaagauuauuggcaacuccauuaauauuaguauagagacagugcuagcaacauggcauuuuaaagaauuacaguggcaguucucccaaucagccagauuucuuccagaaaauuauaaaggaaucuccuagauaaacuuauuuucccacugguguuacuuuaucagccuaaguaguagcucuguaaauagaggacugaacacuugaguuuggguccugauuuuguaauuagcugugugaauuggaucaagucguuuagauucucugggccucaauuucuucaucuguaauaugagaaaggucgaaauaauugauuuagcaauauauuuuaucaaucagaaauauuagugaugucagugaagcuuguguauauaaauucauuuuuucaaucauuuaaggaacuuagauauaaaauacaccuuuaauucaccuuuggaaauuuuuuacaaaguguuuuauuugcaaaugacagugauaguaagaguuaauguuuaaggcuauuuuguaaaugacuuuaaaugauucuaaguacuuguuacucuuaacuacgcuguuucauucauacauugaaauagauccccuuuggaacacuggggaagauugaagauugcuuuuaauuucauuauggcacacagaauuuagugaagaaaaaugguaguccucuuucagauagauuacuaagucagcuguuuggaagucuugguguaaaaaugucuuagagcuuugcaaguuacagagauagaaaauguauuuaauuuuaauauuucuaauucacuauuugcuuuguuaguauuuagauuucagugcuuaaaaaauuauucacgggauuuuuucccuucauucaacaacagguucuauagcacaucuugggaaaauuauccugcauugguaggggacugaaagacaggaagaugaaaaauacaugauaccuuuaauaauuuuugaauuuugaauuuuggaauuuuagagggcagauaaaacuauaucucuggggcaauaaaagaagacaaguagaagaaaguaaucauugagagagaggaacaaagucuuacaguaauucagauuugggagauuauuucuauuugggaaaauuggccaccagguagauguuuuaugcuggguuccuaaagguagaaauggugggaaagaaagaaaaugacauugagggcagaggggacagcuugauuaguggcuugggaaugggaugaagccaguguugccaaguagugucuguuaaaaggagcauauugggaaaaugaggacagaaagguaaaauuaggucagauaauacaggauuuugaguucuugucaaagaauaugaacuugagucuagauuugaguauauuacugaagguuuuugagcaagggagggcauuacugugcuuuagaaagauuaaucuggccacaauuuauaauguaauacagaaaaguaauagguggaaagaagagggagaccaggcacgacgacaguaagagcuuagacaagagucagccaacaaccgaagaauggaaaugucacugaaaauggaaaagcagaaguagaugugggcaguuugaauugguagaaaauagccacugauaccugguuaucaugggugugcgagaggggagggaacauuuggagauacuuccaaaauuucaguucagaagaucagaaggguggccgggggccauuaccaggaagagugaagugaggguaagguugacuggggcugggcagaaggggcaaugggaaggagaugaggaguuuucggcuucauugacauccuggcagcuaagucagcucuccagcuagaaaugugcagcaggcaguggugauacaguacuaagauaggauaggaagucaggucuuuacgagagcauuucaguaaauagccuuaggaacuuagauuaaaaaucaaugcuugaugaggcagugagucuagaucguuuuugacagugaaaucaaauaccaugaauacguugagggaguaaugagacagagauuucuuuuuagaaaagagagcggaauguguuuucucugagggcagagucagaagagaggacaagaugaccauuauaacagaggaaaauagugcuucugaaauuccauuucacuuuccacagcaguggcuaaaauugaaauuaaggcacucuaauggcuacuaacauugaauuauuggauuggcaauaaaggcccuaaugaaguacuuucauuaggaagaaaauauccacacgucuggaagaaauagugugaugcccccuguaaagaaaccagugaauguaacguuucaaauauggagcagccacagcagacuucuguaauucuaggucaacaaugaauuaauagaaucaguuucuuguuaaaauaacugucuuuugccuucaucaauauuuuagauacccuuacuggcuaccugucuuauggaaagcuauguaauuauacuauuuugaguuggauuuuuaugguuuaugcuuuccauggaaauuugaugggauaaucuguuugugagguauuuaucugcauauuugauuccuuaacuuaccugcgacuucuugacuuuguugguuuucagaauuaaaaacuugaaagaauuuuguuuauuuuggcauguaaagaauacuggucuaaaaucacaaccauuagaauucauuuagauuuuucaaaggaagugguugaaaagccggaggacugagauaaauuggugccauguucagugagaagcuggcaaauuuaugaaggaaugugcuaaugcaaauacuuaugaauugauuugcucuacauauuuucccuagggccccuuaguccucuauuacuuauuagaaucuuuaccuucuguaccacagaaguaaaccuaaagcacagccuuacuaagauuguuuuugcuuucauggggccaguugaauauauuucaucuuccuuuuaugugacaaaaauaauugagaaacaucaaaugauguuuaauuguuuugaaaacauaaacaaaacuggagauuuuauaaagccuuguucuaagcuugaaaagaaggaaaaaaaaucaguuucuggcugaaaaguuucuguugacacuggaccgaucaaacaguuuucuuucagacaauauuucuauagcuguaucacagaaauuaggggcugacagugaccaguaguuuauuuucauugccucauacuuucaaagaaagcaaauauggacuuguauaguuauuaauuaaaaauauguuaagcagugauggguguuuauuuaaagaauucaugcaaaucuugauuuacauuuuuaaacuagucuauuaucucucaccuuuucaguuuguuuaccaugguacugcaaaaauuauuucaacaaacaucugaaaaacucuccuuaucacagggucaguaauaaauaguuuguuaucccaagcauggcuuucagagacgucugcagguuuucugggcacaaaguaucacuccaaucuccuuuaaaucaguuucccucucgcaacuggucaagggccagacuagagaagaacccaaaugacauuccgaccucaaacgugaauccgcuuuccuccccgccuuucugcauuucuccaauucuacuccaccuucaugaguuagaaauaauuccucuuuuaaggcagaaaaaucgguagauuugguuacaguggguuugcacauguccacagcugccuacaggccacucaguuucccccaacacugagauugcugccucuguagcaaguuuguguuguggcuuuucuuuuuucuuuugagacggagucucgcucugucgcccaggcuagagaugcaguggcacaauuucggcucgcugcaaccucugccucccagguucaagcaauucuccugucucagccucccgaguagcugggacuacaggcaagcgccaccacgcccaccuaauuuuuguacuuuuaguagagauggcguuucaccguguuggccagaauggucucgaucucuugaccuugugauccaccugguguuguggcuuuucuuauacacaaaucacagucugcguuuguguuaccugcaugucucuuuuaggcauuucaguuugcagccucugguuuauaucuuaugucuuuguagaucauugagaaauaagauuugauauauacaaacaaaacacugaccuaguuuuaggccccauucaguaaccuuuugcccuaccugugugugugugugcacuacgcggcagaugggggguuagggggcuggggaggagcauggcacagugggaggaugaaugggauaggaggguggggugggguaggguuggggguagaguugucuccaagaggaagauguuggguacaguugugcuuugcacaagggcauuacaucuaaauggugucauucccauuguaaaggccaaagcauugucaaagggaguaauagcuguuacauucauuuaucgguuuacuuucuguuucuucaugugauucagauaagaggcguuuuuaauaauauugauaacccuuaucuuucugucuuugaauucauugcucuauuuuguaacucuguuaauaugaucuuuuuaaaaacuauggugaaauauacaaaauauggcauuuuaaccauuuuaaguguacaaaucaguggcauuagaaacauuuacaguggugcaacuaucaccauuagccaucucuggaauuuuuuuauuaucucaaacggaaacucuguucccauuaaacaguaauuccccacuuccuccuucccuccaaucccugguaauggccacucuacuuucuguaccugagaauuugacuacucuuaccuuauacaaguggaauuauacaauauuugucuuuuugugacuggcuuauuucauuagcauaauguccugaagguucauccagguuguagcacauuucugcauuuccuucuguguuuuuuuuuuuuuuuuuuuuugagguggagucucgcucugucacccaggcuagagugcaguggcaugaucucagcuuacugcaacguccgucucccggguucaagcgauucuccugccucagccuccugaguagcugggauuauggguguacaacaccacucccggcuaauuuuuuguaguuuuaguagagacgggguuucaccaugucggucaggcuggucucgaacuccugaccucgugauccacccgccucggccucccaaagugcugggauuacaggcgugagucaccuugccuggccaauuuucuucuuuuuuaaggcuaauuauuaugcauauaucacauuuugcuuaucucuuuaucaucuauggguacuuggguuuugacuucuuggcuauugugaauaaugcugcuaugaacauugguguacaaguauccguuuuagucucugcuuucauuucuuuggggucuauauaaacaugacguuuuaaucagauauuuuauucaccucucaaagcucuuguuccaguguucacuuccuuugaaaaaucuguaugaauauaguauucuuuuauuauuguacuccugagaggaggguguuagccccuuuuuuuugaaaugugugcagaacuccagugcuuaaaacuuccaccagaaaccauugguuucuaucccacaagaauuccacugaaaugcuucucuuuggaagcccuacugagcuguuuaaacuguguuucuuuagaacuuccaacauuuucagcuuuuccuugacuuuuucucuaauagacaugcuuuaguuaaagcuccuucauucugaguuguucugugaacuagauuucaugguuuacuaacucauauccuaaauagaaucauccaaaagaacgcauagaaacauucuguugauuccauuuugguugguaugugacuauuaaggguucuuacaguauggugaaucucagauuccucagggggcucccugaggcugaggaugauagaucugacgauucacaacucucaucucuuugggauacauuggucauuguuacagaguuaaacugcccgggcagauaggagguucuggaguugagggcugguuuaacugaucagggcauuuaaccuguguggcauuggaccuguaaaauaugacaaaucuuugggcuggaggaauaagguucugcaacuguuaaauuugauuaaugauuacccuguguauggaaaauugauuauuacauugguagcucucuuuaugaaauuuucuuuuauucugagcauggccaauagcaguacuuauccacauucuugaaaaucuuucccuuugacugugacauacaaaucuucauugcuuaccuugaaucuuaauaucaugcgugagcaaaguguuagcauauuugcuuauuugcucuuacuuauuuuucagaaggugcuacauaguuuaaaaaaaaaaagcaaaaaggauguguaguaaaaaaucuaguguacugcguccuaaaugacgcaucaugaccauagacugucaccgcccuugcaagaggcagccaccgaugccaguuucuugugugcucuuccagagauacuugcuguauugucuuuuauuuuaaaguguggcauacauacaggaaaguauguaaaacauacauggacagcaugaagaaucauaauuaaaacaaucacuauuccaaguuauugcugauccuuagaagcugucugugccuccuugaucagaucccccuucuucucucaaaaaguaaccucuauucugagucuugugauuccauguccagcaaggaagcagggauguugcauccuaaaugccuaaguguuuaagucuagagacuaauuccuuuaagcauuguuggauuguuccuggugcuuuugaacuccaauguagauguugucauguaaucacugugcuccucaucugagcugaaacuuugcuucugcuuuagccauggcaugauuuagauaugugaaagauaauuccaucuccuuuguaauuuaauuuauuugugucauuuuaggcauauugcauaccugcuaauguagaauggagaucuagaauauggaagacaguuuaaaacauuuuaaagcauucaaauguggcauucuggccgggcguaguggcucacgccuguaaucccagcacuuugggaggcugaagcaggcggaucaugaggucaggagauugagaccauccuggcuaacauggugaaaccccaucucuacuaaaaauacaaaaaaaaauuagccaggcgugguggugggugccuguagucccagcuacucgggaggcugaggcaggagaauggcaugaacccaggaggcggagcuugcagugagccgagaucucgccacugcacuccagccugggugacagagcgagacuccaucucaaaaaauaaauaaaaaaugaaguggcauucugauugggaguuacuaagcauauauauuauaggaaggauuaacacucaaaaggagagcuuagucuuguuaauuuucaugcuuugcugagggccuguguauuagccuguucucacccugcuaauaaagacauaccugacacugggugauuuauaaaggaaagagguuuaauuaacucacaguuccacauggcuggggaggccucacaaucgugguggaaggcaaaggaggagcaaagucacgucuugcauggcggugggccagagagugugugaggggaacuccccuucauaaaaccaucagaucucgugagacuuauucacuauuaugagagcagcaugggaaaaaccuuucccccugauucaguuaccucccacaauacguggggauuauuacaauucaaggugagauuuggauggggacacagagccaaaccauaucauccugauacaaaacaggucauuaauaaauauuuauugaauagaauugagcuggagaguuuguuauaugcauauuuaaguuacucugcauaccauuaauauguuuccucgguuuguaguccugaagauuaggcuugaguucaguauuuaucugcuuauguguccugugcugcaacugucacccuccuugucccucauucagcccugcucuuucacaauaaccaccccaagaagacuuuucagauuuuuuuuucaucugcauguaaaaaaaagaagaagaaagaagauacuuuuauuauuuugguuuugguucuucucucuucccugcuuugccuucccuucauacaugcagugguauuagcggucauguccccugaccuugguugaggcaaagcagagggugucauaucaguugcaguggaaagauccuucucuguccuugucuguagcugaaccugcuaagugauauucccuucuaguaugaggauggaguacaaguuuuugagguugcauugcugaagguaaaaccaaaagagagagagagagaaagagagagugagugugugugugugagagagagagguguguguguguguguguguguguguguguguguaacuauucuuuugaagaugacuuggaacuauuccuaaguaaccuccugucuggcauucacuaauuucaccuggccaacuccagcaaugcugaucuuaggauaucuuauuguauagcuuauauuccaaauauuggaggaaagagagggaguuuggaaagaaguuuuaguuuagagagcucuuaaaguacucuuggcucaucauucuuuaaauuccaaaaaugacuaauuuguggggauacauaauuaaggaagaaaagguuuugugagggaaaggaguagcagggagugcugagagcuuggcguauguauuggaaaauugugguaacuuaacagguaaucaaggauguugagagaggugcuugucaucauuucaaaagagcguagaauauuuuauuucauuuugucuacuguggaucgguucuccucucauuuacuucuuuucacauuucauauuugggagggcuuugggcucuaucuucuauuuccuucuauuaaaaaaaguuuuauaaguuauuccacuuggcauucggaacacaauaaugucauacuucacugaggcauacuaaugcucuggaaagaaagaaaaagaaggaaaauuaauuuagagggaauggaggcuaaauuuuccauggugaagaaauucugaccuuuucugaguuaucguaaaagacugacauugcuacccuuuggauguuaagaaaaagucuuucagauaccuuggcuuguaagggaccugggaagcgccaggguccaucaaaaauguaaagacauuuauuagaacaugcauauccgaaagcuuucugaauucuguggggaccaucuagcuuuuacaugaucuugagggaaccaaaguuguacugagaaaacccaguuuccucuuaauuccauccuaugugaaaacaacuuaagucucaacugcacuaaguuaugaaaauggauccucuuuuuuuaacauuugguuuuugguuauucauauugucuauauucuguucuauaauuguauccaaguguuaaaauauauuuuauaaauauacugacacugaaaaagaaaucaaaagcugagaaacguuugugaauauggcuggagagucucaguaagaugggggacaucuccucaaauugaagaucugggaaguaaguaauagaaacuuacagacagauugaggugcaguuuuuuuucuacuuuuuuuuccugaaaauuucagaaauaugagaagugaaauaauagcaaacaugacucagaccuuuauaaauugucuuucuugacagcagagauguacaauuuuguaaaauauuguccucagucuugaacugcagaaacuccuuucucugauaccugcggucuuauuuaauuuuuacaucuuaacagcaagagcauacccgugauuuguuuucacaaauguuagaaauacuguguaagaauagacuuauuuuuauauuguaaacuuuuacuuuuuuuuuuuuuuugagacugaguuuugcucuuguugccuaggcuggagugcaauggcaagaucuuggcucacugcaaccuccgccucccggguucaagcgauucuccugccucauucucucaaguagcugggauuauaggcaugcaccaccaugccuggcuaauuuuguauuuuuaguagagacaggguuucuccauguuggucaggcuggucuugaacucucaaccucaggugaucugcccgcuuuggccucccaaagugcugggauuacaggcaugagccaccaugccuggcccaacuuuuaccuuuuuaaaguauguuuuuaaacaaccaauaauauuuggcauaauuuaguauuuugccagugcuucauugcuuaugugcaaugaggcauuuaacaaaauaaauuggacauauauauuuauaauuauuuuaccuauuccgucagauaguacauuucuuaaggaguaaggaaacuugaaauauaacucacuacuucuccuuuuuuuuuuuuuuuuuccugagacggagucuugcucugucacccaggcugaagugcaauggcgcgaucucggcgcacugcaagcuccgccucccggguucacgccauucuccugccucagccuccugaguagcugggacuacaggcaccugcaaccacgcccggcuaauauuuuguauuuuuuuuaguaaagacggcguuucaccguuuuagccagaaugaucucgaucuccugacgucgugauccgcccgccuuggccucccaaagugcugggauuacaggcgugagccaccgcgcccggccugcuucuccauuuuguucacaaaauauuuuuuccucagaaguguggcauugaaugauguauuguuuuguagugaguacauuaucucagugaacacacaauuucuuucagauagucaccagaguagucaucaaaaggaaaagcaaucuaaguaccauuuaaugggcugcacuacacuaauauucuauuugaugaauuaacugcauguuuuuaguuaucuguuagacuaguuuucauucuuuuccuucccuucgguaugauaaauucuuuuaaaaugguuuuauucaaucccaggaaacugaaaauacuugaaaaaauaauauuuugcaauuugucagaaaauauuuccucacuacuugacugguaaucucaagcaugauuaguauaguguuuccuaugagcuagaagguuuuuggauuagaugugcaggaauaggcauucugccugcuuuuaaaugucuagcugcacagcugagcaaaaaagcccaaccuggcagucagaacaggcugcccaggggaacuccuauuguucagccccauucaggcaaacuauaagaucacgcauaguguccgagccggugcuggugccuagugagaacauggacaguccaggcaugggauguguggauaugcugccuucgcagugaucaagaauucaggauuuuagagcccaguaaauagcucaugagaacuuggguuuagaaaaucugaacugcugggccacccugaaguaucuugaauugaggagcuugggugaagaaguccugguaucaguugggggcccuucagaugagcugccaccuugugacuguccgucagggucaucuuuuggccaucccugguuagcguugccaugugggugacaacuaggagacuuuacuugaauguucccacagaugcauggcugggauggcguaaguucuuuucuguuucuggcagcaauggcucaggauuaggguuuaugagguuaagauuaacggagacaauagaagagaaucuugacuugauaauauguuuuuuauuuuguaaaagcuuuguugcaauauaauucauauuccaaguaauguacccauugaaauugugcauuucagugguauuuaguguauuuauagagcuguacaaccaucaccacccuguagcuauuaucuccgcaucccuacuucucccuagcugcuggaaaccuugggucuacuuucuguuugccauucugaguauuucauauaaauagaauccuacaguuuauagugcuuuaaugacugucuuuuuucacuuaggaucauguguuuaagguuuguucauguuguagcuuuugugguacuuuccuuucucuucauugauaaauaauauuccacuguguggauaggcuacauuuuguuuguccacucaucagucgaugggcauuuggguuguuuccauauuuuggcuauuccgaauaaugcugcuaugaacauuuaugugcaaguuuuugugugguuuuauuccucuugaguagaacugcuaggccuguuaauauguuuuuagucuuuuguguauauaugggaauauugucaccuaguaugaaaugguuuuuaaaggcaaucaacaaucuaaaaccuccaguuauuuguguguuuuuuuuuuuuuuuuuuuuuggagacaugagacaggguuuuacugugucacccaggcuagaguccaaguaguaugaucugggcucacuacagccuugaccuccugggcucaagcgauccucccaccucugccuacuaaguagcugggaccacaggcacacaccaccaccucuggcuaauuuuccuauuauuuguagauacaggguuucgccacauuaccaaggcugcucuccaacucugaggcuucagugauuugcccaccuuggccucccaaagugcuagaauuaagggcgugagccaccaugcccagccugcaauguccuuuucugaauucauagacuucucaguauuacuuagcagcuagccuuuuuuuuucuuuuuuuuuuuuuuucuuuucuuuuuuuuuuuuuuuuuuuuuugagagggagucuuacuuuguuacccaggcuggagugcagugacacgauaucagcucacugcaacuucugccucucggguucaugagauccucccaccucagccuccugaguagcugggacuauaggugcaugccaccacgccuggcuaauuucuguauuuuuaguagagaugacguuaugccauuuggccaggcuggucuugaauuccugacuucaagugaucugccugccuuggccucccaaaguucugggaguacaggugugagccaucgugcccagccuaggccccccugcugccuuuaaaaaaaauuuaauaauucacauuauugaaauauuuaaaccuagucauucuuuccuuuggcugugacuucuuagaaaauuauuauuuuuuuuaaauauaugaauguggugacuuuugacacuguauuuggguguuuauuuauaauuuauauguaugaauuuuaaguacccuagaauugaguguaauagugauaguauuuuuaaaaguggaaauuuuuaagguauaguauguugcaaauuuuuaauaaaaguuucuauuccaucgaaguguaagccgucaugauuuguuucauacuuucuuaugcuuguaauuagagaaaauguggcacauauacaccauggaguacuaugcagccauaaaaaaugaguucacgucccuugcaaggacauagaugaagcuggaaaccaucauucucagcaaacucacacaggaacagaaaaccaaacccugcauguucucacucauaagugggaguugaacaaugagaacacauggacacagggagaggaacaucacacacuggggccugucaggggguggggggcuaggggagggagagcauuaggagaaauaccuacuaauguagaugauggguugauaggcgcagcaaaccgccaugacauguguauaccuauguaacaauccugcacguucugcacauguaucccaggacuuaaaguauaauaaaaaaaaaauaguuuuaagcugguuucucuaagaaaguuuuccuuugauaaugaagauaacaaagaagauagauuuuagcagcagaaguauucuuuuccucauauuuccagacauuuuaauacauauuugcagacauuguaauagucaucuuuauagcucacuccagugcuauacauugggauuauaguugcuugcaguauagcauuuacaucuuccuuauucuuuuuucuucguucauucucucuuucuugaacucucauucucucucucacuggucuugugaaagaacaugauuggauuucugcuuugagcuaucuuuaaguuugauuacaaacuguaacagaguagccuugagguuuuuuuuauugguaacuauuuugugaugaggugguugaaaucgugcuucuuucuugauuuuuguuuguuuguuuguuuguuuuuugagacggagucuucauugacacccagccugaagugcagugaugugaucuuggcucacugcaaccucugcugccugggcucaggaaauccuccugccucauucucccaaguagcugggaccacaggugcaugccaccacacccggcuaguuuuuuguauuuuugguagagacagggucuugccauguggcccaggcugcucccaaacuccugagcucaagcaaucuaacugccucgucccuccaaagugcugggauuacaggcgugagccacugcgcccagccaagugcuucuugauuucuaucauauugugauguucagaaucuaauguaguuauguggcccuuacguuacucugcccuguacuaucuucuuuauuauuuuacauucauuuauauuauacuucuaaauuauaaaauaaaauuauaguuuaauauaaacuauauauaaaucuaauauagauuuuuacacuaugaaauaaugcacguuucuugaaagagcaacuauaguaguagauacauguuauaacgugcaacgucuccugcccugggauucuuccuaaguaccacacccagaauaaccacuguuucuuauacagcuuuccagaaaauuuuauguauuuuuauacaagcacuuguauucacauacacguuguuuaaaaaaaaaaaaagaaaugguguuuuucuguacguggcauauguuucaacaucuugccuuuuccccuccacccuaauggacauuggguaaugauguaacuaauuucugcuuuucuguuagcuuuggcagccagggagcuccaggcucauuuacacuugcugggagcccugugcucaauuauaauugccuacgauagccuccacuuucugauuuaauguucuucuuuuucugaauuuuuaaaaaaaucuuuuuaaaaaguuuuauuauggcuucuuuacgugagccuuuuaaacaacuugagugaauaggaggauucaggaauuauggcucauagaagagacauauuuaaccuuaugcaucagacauuguuagacacuacgcuguauuuguauagcuucaguguuugguagcucuagauaucaagauaguauuuaggaaauuuucuuuuccaacauguuaguuaguucugaaauaccccaaaugguuaauguaguuuauaaacuccgaaaagcuuuuuaucuaaugagagcacuguuuuaaaaaaaccacuaaugauuuucuaguugaaacauuugaaacaauuuugaaguacaggggacuuuucuuuaaaacagugcucauuauacucggaagauaagcucuugagcaucugucauccuuguugauguauucauacuguuuuuauucuuugaaauguauuuaaauagaaaaaauaguucauguuuuuugucauucuuucagacugcaguguuuuguuuugaauguggugaaauugguuuuauuccucuugggacugcuuaucucuagggccuggaugcuuccuuuaaauagggauucacagguaguaaaucauuagaauuuuuguuuaacagugaaagaagucacuuaacauaggucugucauaguucugucuuugucacuguauguagaauuucauagugauacaacauccauuuucuuagcaaaaaguuaggucuaggguauaucuguuuggaaaauuacaucagaauugauuuucaauuaaucaaaguuacuaaauagugcucugaguuaccagugguauuuaaaauuaauuuuggaaguugcacacauacuuuauguguauuuucuuuuucuuguaugagagaaugauauauauuaaauuguaguuauugcuuauaauccuuuuagaaggcaauggggcuacucaaggaggcugaggugggaggaucgcuugaggccaggaauucaagaccagcaugagcaacauaacgagaccccgaucucuaagaaauuuuuuaaaaaaaguuagucaggaauggcucaugccuguaguccuagcuaccuggguggcugaggugggaggauugcccaggacuucaaggcugcagugaacuaugaucuugccacugcacuccagccuaagggacagaaugagacuuuguuucuaaaaaauaaaauaaaauaauaaaaauaaaagaaaaggaaggcaaugauguucugcaucagugacaacagcaugggcauugccaagaucuuugaugaccuuacugcuuaccucuccccagauuuuacauaauuuuaucuuccugucccauuguacacugacaauacucuccuucaaguguccucaccucuugauuugucauauacucuuaauuuuauugcuacauuuggccauuuuuuucacuuuuuuucuuuguucacuuuccuuugcuccauacuuaacuaauuuuccagauuucuguccuuaaaucucuuucauuuucacuggauauacucuucccaggcuucccaggcuucuguaacaaucuauuugcuuugucuccaucccauaacucucccugagcucuaaauuauuauaugcaacugcucacuggacauacaaguucgugauucaacagacccuuuaaaacucaaaucuguuucccuuaguauauucccuuguuuguuaaucuugcucaguuacccaagccagaaauuuagguaucauucuugaauacauuguuucucuuccuuuccacacccgaucaaucaaauacacagucuuauugcuucuuacuuuuuuuuuuucuuaucuuauugcuuuuauuuucaguauuuuuuugaaucaugaagcuguauaaacagacaaggugaucuguguuguguuagggcugucugugccauguugcugugggaguuucuauauggaagaggggcauuaacaaagcuuugaaaugccaaagcagacuuuccagggaagagcgucugcagauaauucugaagaauguguugauaguaucuuggccacagggccaugaggcauuaucaggggcaggagagagggaggcuauucccaggaaaggcuccagcaugugccagagaugaugcagacaacauuaagauuugaaaaaauggcccagugaacaaaguguuuuugguuuugagagagagagagauugagagacagagagagagagagaaaccaagggaucaugauaguuauagucaaauagaggaaggauuaucuuuugaaaauguguugguucugugauacaagaggaagcuaagacauaucguggaaacaucuccccccuccaccuuaauaucaagaacaaauuguggaaucuaauguuaaugagaaguaguuccccacugugucagaugcgcaaagagaaauuggaauauacuuaucaaguauauuauagauggaauugaauuauuguaaagaguagauuagagaggaccgccaaaguccagucccaaacaugauacauuaaguguaucccuuaguauaauaccaaggaaccccaaaagcuuuacagugucuaaacucuauuuuacgucuuccuaaacugauaucguacauucaauuuauauauuucuguacuaagaucaugaauuuagaguuuauugagaaauugccagaaaaaaauguguuaaguuuuuaucccuuaaagaguaucucauaacuuacagauuugagcagggagguauauaaucaggaguacaguuuauguuuguuuauucaaagcucugaucucaugaaaauugcuauauaaaugcuuguuuuaacaacuguuauuauuagggguuuguaugaaagucugccaacuuggucccaauauuuauauuauaaauuaaaauguuuugaaaagaacugcuucucaacugugauccucauuguuuuugaaaccuaaaauauacuaauuuuuaauuuuuguaguugaaauaguuuuuaaugccagcagucuuuugguuaucaguuucauuugaagaccagaaguuccugaacaaagaauauuuauuucagauuaauaaguaaauaaagugaaauaaaagauuuuuuuccuuugaaauugaggaagaucaguuauuaguaguacaaacugugcacuagauuguaucuuaggguuccuaacucauucuuaccaaugauaauaacucugaacccaagaauaucugagacaguucucaauuaauuuaaaaaguuuauuuugccaggguuaaggaugcaccuaugacacagccucaggagguccugaggacauguacccaagguaguugggguacagccugcuuuuauacauuuuagggagacauaauacaucaaucaauacauuuaagauuuacauugguucgaucuggaagggugggacaacucaaaauggagggacgggugcuuccaggucauagguagauuugaaaauuuucugauugccuauugguugaaagaauuauucaauguagaaaagaaugucuggguuacaauaagggguugugaagacuaaaguuuuauccugcuggggaagccuccaaguagcaggcuucagagagaacagauuacagauguuucauaucagacuuaaagucuguguugauguuaaugcuggagggguguaaugaggcauguugacccccucuuccaucuuggccugaacuaguuuuucagguuaacucuggaacgcccuuggccaagaggauugguccauucagaugguuaggggggcauguagaguuuuauuuuggguuuacauaacccauuauggaaaugauuccuuggcccuaagguaauuauagauucuggaugccaugcuuauauuaaguagauaccaaaaugcuacuuuuagaguuugaguuucucuuacguuuuuagaaauucaauugaguagaacucguuauuaaggaaaaaauacucaagacccgaauaauauugccaugaauaaagcgguugauuagugauugguugacuuuaugcuuuucaguucacagaaauauugcugaggaaucuugacacaggcaaugcaaguguuuacaugaauaugaaauuagcaacuauauuuagcuauaauuaaaaucuaguaagguauguaaaaccuguuugucuuugacuagaacuuauuccaaguuaaugagaucucaaacaaggcauagaguguaugucccuuuuugaaaagaugaugauauuuucuuaauuacugucuguguuugggcuggccaauuuugacccaguuaaaaagcugcaaaagcguggucugaacuucucuuuuuauuauggcuaauuuuccuuuaauuuagacuacuuauacaaauacccaguauuaugagccagcaaaauuaacagguguggauuuaauauguaguguggguccacagagauuauauucguuguauaaagccuaauuuuuugucuuaguuguccuugucauguuuagaucuuauuucaagccauuucuuuuucauuuucugauaaucugauuucauugucaccuuaauaucuucuuuuuuuguguuugcaaucuuuuguuuuucuaacucuaaucccaagaggcaaaaguaauacauuuugagggauuuuugagaaguuuugugcuugccuuccccuuguucagauaaguugugcugcaaauggcuccauuccuccuguuuuguacuagugacaggaaaguucgucuagagauaaaaugucacaaaucuguccaccuccucuacucucucaggggacucuacaacgucacguuuucuuaacuauuuaauuuguaaugccuucuuuauuuuggggaaauuacaaaauagugacacagucuccccagcccaagaaggaggagauuuuuuuuccccaguagggcgguuguuuuauuuugacuauauagucuucccuagaauugggggaauaaauauugguaugguuuuuuaauauugauuucccuggguagauuauauuucugacuguaaaauauauuauuggaugugcuucucaaauagauuuuacauaaucagagaaauuuugaccaugagccuaauuuaauacuuuuuugcuccuucugaguuuacauaaacuuuuuauuuuuccauggaguuuaucagaaucccaaauccucugcuucagucuuccuuucauccugaucuucaggauauuuuuccuggaguuauuauuguuauuuuauaguaucuauauagcuacuauuuuauaguaguaucuacuauuuuauaauagauuguccuggaaaaccuaccggugcaugagagaaaaguucaaggcuaaacuuaaagguacuggguagucaacagcucaugucucuaucagaaaaugauggagacuagaaaguaacauacaugagugguuaucauuuuaaaacuagagaaagagucauggaaguugguaggggggacuuuaaaggugaaaguuuagauuauggucuaucagagaggaauggaaaauaauguauuuuaaggagacuguaaguauccaaaguauaaguuaagguuuaaaauauuacauuugaguaaaacaagaagaaaagaguuuaacguuuuccuguaagagaguagguuguauuggauagucauguuguucagauuuuuauuuauuuuguaaauaguuuuguuuuguuaaaaauuuguguuaauugggccgggcacggugguucaugccuguaaucccagcacuuugggaggcugaggcgggcagaucaccugaggucaggaguucaagaccagcccggccaacauggugaaaccccaucucuacuaaaaauacaaaaauuagccaggcaugggggcaggcaccuguaaucccagcuacuugagaggcugaggcaggagaaucgcuugaacccgggcgguggagguuacaaugagcccagaccaugccauugcacuccagccuggacaagagugaaacaccaucucaaaaaaaaaaaaaaauuuguuaauuuugcugaggugguccugagacuggaucaaaaauugcagcacuauauucuucuagaaacaugcacacguuuuuuaaaauugcuuuaccugcacaauugaguucaugauauuucugucgugucgcauuuguaauguaguuaauuauuuucaucaucuuccugaaaaaggcaaaaucgaugggaaauuuuucuucuuaauauugaaucacguaugacuaauuuauauuuacuuuugcaaagcagggaaauauaugaauaagaggcaugaauccacaauugcugaagcaaaucaauacaugugaaggaaaagcaaaacccuauguaggccuauguagaaaccuuaugcacagaacuaaaugcuuguuaaguaaaaauuccuaauccuuauccucuuaugccauuuuaaauuaacucuaaaauuaguauuggaaaaaucucccugauuuguucaaauggcugaugcuuacaugucauuuuggauccagagaugcaaaauauaagagcuucauacauagguucaauacuuuucuaaacugaauuggguuuuugaauaaaauaccaggguauuccaaaugaaugauuuuuaucugacucauuaagaagugaaaauaaauauuuuauuauacauguaauaugauuuaguuuuacaaacuguuaauaucauaauaaucucaagaaguucuaaaaauggagauaauuaugacagccauaaaauauaaaguauauggaauuauauauuuggcuauauauuagucauauauuuuuagggccuacuuuauauuuuuuucccuggcaguguuuuaguuacauuuuuccacaguguuuuucuaaaaagaaauuguaucauuuuguaauucuuaguuugucagagaaaccaacuuuaucucaacuucauuaaagaguaauaauaaauuugaauuuaguugauguaagaguugccaguaccaaaauggagugguuuaugccaagcaguaauaaaauggagccaggaggccaugaaguaagggagcacacacauguaugccuaugauggaacuuuucccaagaaauuccucagaaccauaguauuccagauaagcugcuugcacaaggaaguuugccuaacaagagcugccuucaucaaugagcuaauguggauuccuguaacaagcuccuggaaccaguggucuuuguuucaaaacaguucauguggacuuuuuuucuuucaaaagcuuccccuugcuucagccucuuugcaugcaccuguggugggccauagcaagcauaacccgaauugcaauuucuugcuauucucaauaaacucuuuguuguggagaguuggucccucuauuguuuauuuuagguugagauuagcauagaauuuuguaaaguccuggagguauauccaugccagggauuaaauuggauucuauucccaaguaauuuuuguucuuaaggacacucuaaggaauuauuugugucugcuuuaauuauuaaaaauaauuuuguuuauucaguucaauagaauuguaucuuuuaaaauacuuauaguccuuagauacuguuuuguuauaaaguauuuuguuuugaagaugucuuuaaauucacuggcuucaaagauaacuucugcauuauuccuugggcuuuccucuuaguucaauuuagaaggaacagagaaaacacaaacauuuagguaaauaauggaaauaggauucacgucauaaaacgauacuuugcaaaauugacaagguggcaaacauacaggugauguuaguuuuuugauuaauaacaagagacagaaucugaaggguuagaggaaaugcauaagaaucugaaaaaauaaaaggaucuggagaagacacccuuaaaggugaugaucaagaagucuguguuguauaacggggcuguuggggcucaaggagaacaaauuuuaaaaguggcaggagguauggagaaagcuguguuggugaugugaguauuaugggcuucucaaagcaugguucugacucuggcaaaaagugggaggucagagcagaguuggcugcuuguaaugggagugggggagaaagcaacucuuuaaaaaaauuuaugucaaaaugguauucagugguccaucacauugaaucaacacaccuuuauugaaaacauauuauuuagcacacacucuagggguucauuucucuuauucucugaacuugaaauccuuuucuuguugaucuuucauaugggucacuaaacagauucuauuuuaccugauuaaauaaaugguaacaaggccuaggucuacuccuucgauuuuacuguauacuuacuuaacaguucacuuugucagacuucuacccccucuacaagauuaagaaaauuagugguuacagugucaugcaauucuauucggcuugaaaaguuauugaggcauguuuuuccaccuuuuuaaccuucauuuauuuaguagaagcauucccuuaaguguaugaugagucaacacugguuuugccugacuccaguaaagucaaagcauuauuuaauuuaaaaugugugcauguuaaguuccuuucuuugcauuuaauuggagacuuuuuuccacaguuagcucaccaaaauguuacuagguuccucuguggcugucuacuauuugaacagacaagcaacuaauuagaauaacagaacaacaugacugucauuccuccauucuuacagguuauuuuuaaaaagagauuuuguuuaaaaagagaaaauauguauuauauuaaggaaauauaagauccauacucuccuugaggcauuuuuucacuucaccaugccaacauuccuuuauucccuaucauaauaccgaucaagaaaugggagguuuuccuaagucaagaaaaccucucacacauaaaaauucaaacugggaaagcaaauguaucagggggcggcuuuuaauuugacaaaagaucugcuacauuacaaaagaauuuuucuaaagauuacuuuauguagacaacucccucaguguaccgaaaaucaaagaauguucuacauuuuaaacacauuuuaaaaugggcacaccuguuccuaauauucuuauguaaauggaccuauuuacaugugagacccaaugugguggguaaaugaaaaccagugugugaguuacucaaguuuguuaaugauguuagaaauauagucaaaauagcucagucugcucuugcuaugcuauuuuguccagccaaucucucauccucccuucauccuaauuccagaagagaggauaggaguaaaagcaaaaucuuauuacaaaaaacacacucuggaaagaaagaaaacuguauuggauaauacucaguuugguauuuguuuucuccugucuaguucuuaguacccuuagaauugagauaauucauuauuugucacucagguagguuucgagugaacugauauauuuaauuagauccuuaaagcccauaggauuuauacuggucauuucugucaauugugaaucugcucauacuuguucuucaugaaacuauggaauaauuuuucauguauuuucaugugucaaucugaaaagaaacuuagguucuccagaacagaggaguuuauuugaaaauagcagaggauuauaacccagaaaaugugugcugagccagaucacaggcgcaucaaggagacugggaccaaagggagacuuuuaaagacaaagagaagucuucauaaacuguuuguuaaaccagaaagaucauugguuacaagagcuugcuguaagaguuggcgacaaaucauuguuaaagacgucauuacuagacagauguccuugugcaagcugcuuaucuggagcuuugcggucuaggggaauuuccuugcuaaaaguccuguuacaggcaaaugugcaguaaaugcgggaaugucuccuauaaggccuuuacaggcauuugugagugagggcucccccuucguggccuuccaacuccauuugcuaggguuugacauaauugauuccauuuugguaucaacaacuuucacacauggauaguucaaaauggaagcuccuguaaaauaauacuuucauauguauuuuuucauggugucuaguaccugugccacauagugaaugccugaauaaaggaccacauguauuacaguuguuagauuuucuuagggacccuauuguuuaaaugacuuauaauaagcacuuacugugugaugguaaacacuaugcuauuuaugucaccuauacuucuuacuuaacauuaacacaacucuacacaguuuggaauauuguugaaauaaucacuuuauagcugagaguagagcauguauggguuaaacucuugcccaaggucagacagugaguugacuugugucuucccauguugucacugaugcgucuucuccuuugcuggcucuuguucccuuuauuccuucaguaauauagagaaacuacagccuuucauucccaauagagugaaaauacaccacucauucauuauuuuucaauuauagugcaaggacgagcaguuuacccuaauauccauuucuuguuugguugggaaauucaccaacagagcagaaaagcacaguggggagagaccucaggggaaacacauacaacuuugagauaaacccuguuuuuguuuuaauguuaaaauuuaacuuuuaaucccuuuguaguauuuacacaacugucagugaaaugauaaaucuucuagcucauuucacaagagggcagcacuuucuuuuaaaauuuaaaguaugacuaaaaaaauacaaucaaauuaacguuuucuaucaugaaguuaagcuugaaugauuuacaggaagaugggagccucucuguccugggggcaauuuaugaguuaagaugagugcagaucugcaggguaacuugggauccuuagaaaauggaacgauggauuaaaaucaagcccuagaauuuuugacuugcaguuugaauuuggagacuauuuugguaacuuuguaaauguguaaaagucugucaagaucaugucuuucuuuucuauuauggcaaaacaugaagagugaaucauuuuaauauauucaaauuguuuugcucauaucaaauaaaaaguauuuauugagcaaugguuuuauguuuaggauucuauaggucauuugaggaacaaauaaauuuaacuuuuuucuucauuauuuaaagagcuuaacucccuuggggugacaaggaagggaaagcacauuggcaaaacaaccuguaaacaagccaaggcaacauguaaauaagguacaggguaacaguacagcauaauggagauggccgauuuggauagggaauuguugaauuaggguuuuaaugcagggcuuugaguagaagguggaaauugaauugguccucaguggguggauaaaauuugaauagauuuaaaaaaaacaaaacacgaggaggcuauuauuuaagaaaauagaauccugucaacagagaaaaaguacaaagugcaucagggcaugcuaggaaagccuguuguuuagaacauuguaggaaugaugccugguagguaggauaaggcuguauuguggcaccuugaaaguuaggagucagggcugcacucuccaauaccauugccgcugguuguaugugacuauuuaaauuuaaaugaauuaaaaucaaaaucaaaauguauuuccccagucacaucauuagccacauuucagauguuuaauagccauccuauuauugaacaacacaaagauggaauauuuucauuaucacagaaaguucuauuggacagcacugcaucacaguuuaguuauuuggggguuggaauauggagaaucauuaaagaaacagggaaugauacgacaguauaaagaauguuugaauuuuaaaucuguaagccgggaacuuaaagggaacuucuuuuuuuuuaauguuaaguguuuucgauggagcauaaacagaacuugcaagguauaagcauuuuguauaaguguucuaaaaacugucauauuuauuuuuuauuuuaaauuagcuacuaguauacuagcuuuaaugaggaaauagaaggugagcuaaaggaaguaacuuuuucauuaguuuucaaauucaguuagguuugucaugcagcauacagaacuggagaauacagagagacuggauucaggaaugaugacgugaagaaauccugugaggagauguauuagcucauucucaugcugcuaauaaagacagacauaccuaagacuggguaauuuauuuaaaaaaaagagguuuaauggacuuacaguuccacauggcuguggaggccucacaaucauggcagaaggcaaaggagaaacaaaggcacaucuuacaugguggcaggcaagagagcuugugcagaagaacuccccuuuauaaaaccaucagaucucaucagacuuauucacuaucaggagaacagcaugggaaagacccaccuucaugauuuaauuaccucccaccaagucccucccacaacacgugggaauuaugggagcuacaguucaaguugacauuugggugggacacagccaaaccauaucaggagguggaagagaaaagaagcaagaaauaucaaaaaauauuaagauauuuugauauuuaaguaguguguauauguggguguauuaauuggugauuccaacuuguuuuaaaguuucaaaguuguuugagaugauauguaugagauaauuuaguaauucaauaacgacuuuugguugucuacuauaugguagagacuguuguaauuucuggggauacgucaaugaauacaauagagcauugcuauuuuaggaauggcuucacugaugugaugaauauuuuauuauucaaucuggcuuuuaauaauuacuggucauaggccgggcgccguggcucacgccuguaacccuagcacuuuaggaggccaaggcgggcagaucacaaggucaggaguuugagaccagccugaccaacauggugaaacucugucucuacuaaaaauacgaaaauuagccaggugugguggcacgagccuguaaucccagcuacucaggaggcugagacaggagaaucgcuugaacccaggagacggagguugcagugggcccagacugcgcuacugcacuccagccugagcgacagagcaagacucugucucaaauaauaauaauaauaauaauaauuacuggucauugauaaaucuuuauguaaccuauuuauauuuuauuuuaaaauuuuauuguuaauaauaaccaguguuaacucauaacaaguuuucuuugugguaaaaaaugaagaaauauuuuaaaauaucauacacuuagcuucucucaaaauauuagguuugugcaaaaguaaucacgguuuuugcuguuaaaccaaccgaaauaauaauacuauaauaauauauuuuuagaguuuuuaucaauuuuuuugauauauaugaaaacuaguggaacccucaccucugaaaaagucaaugcaggcauuucugguauacauauaauaauaagaaagucuuaauuguccuguaacuaaaacuaucuaaaucucaauaaauuuguguugaaacaaaugcgcaauuauauaguacuagugaaugucuuucuugauaagaguguuugcucaaguguuagaggaauauucuacacagaaaaaucaagguucagacaagaguuccagggucaagcagcuagauaagugucauaaaggaaaucaugacacaggucguuugauuucgagaguguuauucuuucuuuuuuaucccaugaaauauauacuauagggccaggaugaaauaauacagauaaguaaucuaguuuacauguaacaucaaugaauauuuucucauacaauuaaaacauuuucuguauugcuuuucagacuaucauaguaguagaaugaucugacucaauuuuuagugaggaaguuauguucugaugacuuaaguucuuaucauccugaacuacauauagucuuuucuauaccaauguguaguguugucaguuugcguguuguaaauaucuucuuccaguuugugucuugccuuuuuauuuucuuuacaguauuuuuuuuuauuucaauagguuuuuggggggcaagugguguuugguuacaugaauaaguucuuuaguggggauuucugaaauuuuggugcacccaucaccugagcaguguacacuguauccaauguguagucuuuuaucccucaccccccucccacacuuuccccugaguccccauuguguuguacuuuuaaaggcucuuuuacuuccuaauuauuccauauucugauuuuaaaguuaaaacacucuccagauuaaauucuagauggaaauuguacuuuaaauuccuuuguuuagcaauuucaaaugcagagcuugagaugacaagacauugcaaagucccuucuacuguggcuuaacuuaucccuaaacaagaauguggcugaugucagugucagauggugcuucaccuguggacguucauuuccuuuaauauuuuguuacaguaaccuucauggcacauaaagccuccugucucugaaccugacaaacaggguccagggaauaagacuuaaucacuaucacaagaaaaucacgggaaagaccugcccucacgauuaaacuauaauuuucuuuuucacuucugcaacuuagauccauguacgaaggugcuauucacauugcagcaucucuuuagacacuaguagacucuggcgcuuucacucugccacagucuaggugggaucacuuaaaccuacuugaaagauaaagcgaugcuucaauugccuggacaaaucaggccagacauucauuuucaagcguuaucaauggauuuuuauaaacauuccaaaaaacuuuagaccguaguaucacaguauuagaugacaauagggauacucguuuccuugggaagagaauagcucgaguuauauaaugccuguuuagacacaaaguuguccuuuaaguaagcaggaguuacuaguuauaaaguaacuuaugacaacaaaaaggcuuuguucugucugucccuuagaaaagcuuaccauugaccagcccacugcugcagaaagcuuguuucuauugagggcugguuugguaguguuagaccaucuggcaccucaaaacuucugaaacuuuuaaaggcaaaaauaauugucuccaguagcauuagcuuucaaauauaaugaugccacccuuuuuggaauagguaucuacucaggaagguaaauguguuuuacuuggguauuuucuaucuaaugauuuaauuuuguaugaaaauagaaacacaggcuguggugaaauuuucacacaguauaaaagauugaacauugaaauguuucauucuagacacucagcucuccagucccucccuuccaggucgccauuauugcuguauuauagaucuuuacagaaauauuaucuguaucucauagauuguaccuguacauaacuacauaucacucccccccuuuuuggcguauacauaggauauguacgugcauacauauuagagguuaauuauuugcucuuagaaauuaucucccucuuggccaggcacgguggcucacgccuguaauccuagcacuuugggaggcugaggcaaguggaucacgaggucaggagauugagaccauccugucaaauauggugaaaucccaucucuacuaaaaaauacaaaaaauuagccagaugugguggcaggcgccuguagucccagcuacuugggaggcugaggcaggagaauggugugaacccgggaggcagagcuugcagugagcggagaucacgccacugcacuccagccugggcgacagagcgagacuccaucuuaaaaaaaaaaaaaaaagaaauuaucucucuuuuccauaguuguacagcauuucauuaugugagucugccauaacuuguuuacccaguuaccuuuucauggacauauagauuguuuucagcucaauaagucaaguaggacuuauugagcauccuuguacauaugucuguacacauguuugcaaauuccuagugauagaauuucugagucaaaaguuauaugcauuuuaacauuugaugggcauuguuaaauuaucccuuacccucaaauuuggcagauucuaauaaucucuaggaaauguaaugacuuaaaguaaaggaauucuucauuuuguaaucagccuacugauuuccaugaaaggugcauaauacauugucuguguucaccgucuauguagaacucauugcucagagcaaacaucugaaggaagagagauaacgguacagaaaguaaauaugacuggaggggagaaaaugugugauuguggugugugacuuuuugugggaaaccauaguuguaagugugagugguucaugugguuaaguauuaacugguuauuggugauauuagugaagauggaucaugauuagggaguugaaguagguuuagagugugauuuugcagagaaugcagaauggguuccuaaguaagaagaugacagggacaugguucagaguugaagcaguagcuccacaaugaauggauuagccuccaagcaugagagaaaucccacugcuuaguauuauacacaaaaguauagcugaucgcgugggguuaguuugaacuuccucuguguuuacccaauguucaguuccuuaaauauguauucagauuauaguaacaaugcccuccuggggaaaguaccagcuuuuuacuugugacugaaaacggcgcuuucaauuuugauuuguuuugacauuuuaguugcuguuauuaaaauuuguauuuuaauuuuggcuucaauuuacuaaaucuacauagcugaagaaaacuggagaaaccuuuauaaaaccuuuugaaaaccuuuaagagccuuuuucccagagcccuguggauuuaguugcauaugcuacaggcuugugcugucaguagacaucuggaauuugaggcuuggccuccugagauuguuucccucuugucugaugcugcauauuuuuuaggaagaauaugguuuggaagcauuaacuugucuuggcauuauuuuuagucaccuaauaaagugccgucugaauuguuaaauauuuagaagguugcugaaggcugacuccugcaccugguuggcuaauucagaagcaaaucagcugguauuucucuuccugaaccccuaccccacccacccauuuuccugaagaagaaaaagcucuuugagccucuuugaaugucuauuggaaucuuuugguuauguguuauagaaaauauauuaaguauugaaucuuuuucuuaugaauccuaauuuuuauuucuccaugaccaccuguaaaauuaucaaaguagauggcauuauacugaagagacaaacauuaaaaauaauucuuugcguacaaagcauagugccugaacuuccugggauaaaaggagaguuuucccuuucaucaggggacucaggccuccauccuuagauugaacuuuuugcccuuuagggcuguauauuaccuuaaauagcuaccagcugacacacuuugcugcaggcugauguuaacuugaaagucgaaauguauggacuggucucucccuaauggaacuucagugguagaagacaaugaauugaaaacucagaucacgauuagggucuugaagcuauuuuauuuuugaauucuaaaucccaaguuagaaggguuaugaaaaggagaauuguguauauuucuuucacaagaaauaaguuggaucuuucuuugagucagaaugggcuuacaacaaauaaacuuuucuccccaugccagaaacuccucauuuuaguaaugaauaagccaugauguagcgauuuauguguaaucaccuauugaccuuccauaugcuucacuuuagaggcuccuaagaagcuuuucuucuuuucuuuucuuuuuguucuuuguguuggccaauauaaagagaaaccuguuagaauuuacauagaaaacauacuugaucuuuacaguuuuaaaaauugucuuuagugggaagggugccuuaagauccacuauaggaguaagauguaaaguucuuauuugagcuguaaagaaucuuuuauugccuuaauaaaauuacuaaauaggucaucuuuuaacaaauuauaugaaauauaguuuuuaaguacaaaacauuuguaaauuguccuacccuuugaaaguuguuggcaaagccauaccuauagcucucuucauuuuggcauuggaaugugguuuuuauuaagcaguuuagauuuagauuuucuugaguccauugcugaguuuuccugugcuucucugugguucuggaacuuuuugcuuucucaugaaacucuaugucuauguuugaaacaugguuuauuuagcuagagauuccuggguuauucaguguugaucugauacagggauugguagugucaagcauauuccaccuacugaggauuagugaacaauuuauuugcacauuggcuuaaauugggaaaaugucaacuacuucaaaugucaucaucuaauuuauuaagucucucuggugauguauugcuuacacuggaggcaucuauuuuuuguuuuaauaauuacaggauuacaggugauaauguaucaaagaggugguugauaaaaaaggacuguagaaauguagguauauuaccaagaugauauuuuguguacugacuuuaaacuaagaaaguacucuuuguuuugagacaaagucucacucugguugccccagcuggagcgcaguggcacgaucucggcucacugcagcuucgaccuucugggcucaggugauucucccaccucagccucccaaguagcugggauuaucgucaugggccacuacaucuggguaauggaaaguacacuuuaucuuauagauaucaaacacaaauucaugaugaaaugugcucacuuuuauaaaagcaacucacauuuacaagucuuuuaauguaucaguuaucaaagagugcaauacuuuugaguaauauauuagauauuuagcuauuugaauuucacagaaugacuuuggauauuuacaugaauaaucuauuugacuuuaacacuuaaaaaacaacauuuuuaguugcuuucuuguguuuuagugagaguauaguuacccugugauuaaaauuaguuaagaauuuaaaaaaaaucuuucaaaugaucccauauucuuuugaugaucuguuuuugaauauggauccacugaguuuuguacucuuucuucgaaagaagcugccaucagcuggguguaguggcuuacgccuguaaucccagcacuuuggaaggccgaggcagguggaucaccugaggucaggaguucgagaccagccugacgaacauggagaaaucccgucucuacuaaaaauacaaaauuagccaggcgugguggcgcaugccucuaaucccagcuacucgggaggcugaggcaggagaaucgcuugaacuugggagguggagguugcgcugagcugagaucgcgccauugcacuccagccugggcaacaagagcgaaacuccaucucaaaaaaaaaaaaaaaaaaaaaaagaggcugacaucauagcuagauuugucaauaucuuaguuuuuguugcugcauaacuguauauaagggaguuuucgguaagugucaucguuucuaccuuagcagaggaugucaguucugagaagguagcugauacaaaggcaacaguuucuggauauucuacucucgaauuccacaggagaacauacucuuguuccuuucuccuguccaggacucagguacuuaucaggcugauaaaaguucccaugcucuuaucuuuugggaagaaggccuaauacaaaggauacccuuucuuuucccucaucuuuaugccuuguguuuaaccuuggguguggauacaagauaugugggacucuaacaauaacauaucauucuugucuuguuauaagagcccuuuaaacagaaagggucuacuuuagagaaagacuaugguauucccuguuguuccacggaguuuuuguuuaauucacccuucugaucugugcaugggggaauggaauggcguguuugcacaugucccugaucccagccauccagcacccugggugguagcuggaaguuugcccagcugagaaagauuguucuuuuucucucccuuuuuuauuuauuuauuuuuuuguguguguggugguggugauggugcuggugcuggugguuucuuuugucuuguauuuauguaaaaaguuuauuugcugcucuugaaagaucucagcauguggccccagagucuuuacagaccagguucccuguggccacuuucucuguaaguuucuucaccacaguucugaugguuggucuucaugcugaugucagugcuguuuugauccaaacuguagauuauuuuuaccugugaauuucugaauaagcauuagauuaacacauuuguuuuugaaaucaaaugugcguugaggugaaacacguucugcuagaaagcucauaaagccauuuugccccuggggacauacagguuuuuaugaaaaaauaaugaaaauauuuuaaaagcuuguuaaaauuuguauagaugggcauauguaaaacacaugcuauuuaaauacugauaugaaaauaaguuaggaaugaaauagaaagaaaaaugauuugcaaauccaaaaaauaauaccaacauuguauacuguucccugauagauuuuuaguuuuucugguuuuaaauggaaucucuuacgacccaugauuaaauaagugcuaacgguauugauauuuaagcaacucauuagcccuuuaggagaugcauauucugauuuuagggguucccccccccacuuuggucuaugcccugaugcaaaaaaaguaaacuuacuuauauuaaaauuuacauuauucuacuugugguagugucaccauuauaagcacugcaucuuuaugaugaaacucugccuacaacuagagaaacauguuucaaauggacauuucuguuauacuuuauugguauacuguauagcuauguaaugcaaaagcaaaaucacauuugccuuggaaugauauccauaauaucacuacaaagaauuuauaauuuggauuggaguuuuuuucuuuaaagcgaugacacuuaaaacuuccuggaagaugguguuucucugagugccaguaguaauuuaacaucaaaauggaagacacauucaauguaguuauuacucacauuuugaguacaguaguuucucucauuaaguuuuaugucagaaacaaguaaauucccuauaagaaaacagucugaaugacuuucagcggcaucaaagagaucgaaacacuuuaaaacuauuuucuucaucaguugccugcuaacaccuuuuugaaaaauaaaauuaaucaacgcguauuuccuuuugugauuuguauuguuuuguacauucacucccuuuucuuuucauggguuggcucccaacuggaacauggaaccugugauccauucaagauugagacaauguaaaagauagagaacugacuuuuggggcaggcaggccuccaggaagugggagugagcuuucacuucaaacugggugaggggugguggaaagggaggaugcugauuaaaauaauaaacaacugcuggaaagagaaguugauuaccacacugcugucagaucagccaggggagcugccagagcccacugaggcugcucuccccugccacaaagccggcagaagggacuagauuugcugcgagagcuuuucucuggacagacagaacaccuuuuaaaacaaguuuaguucuguugcauugacagcaucccuuaggccaggcugaccuagggaaauggacugaaacuagcuuggugguuaccauagcaacccaggcugcuggugucugggagagugagaaccgguggccucuuguccuguguuuugguguuucuucagcuaagaguacacuccuccuucgaacucuacauaagucaugcucuuugaaaacuggcucuuuacccaggauuuuuuuuuuuucguucugaaaucggucugaauggaggaaguugguaauacuuggcuuuuuuuuuuucuucucucaugcaaguuuccaggauauagcuucuuuuuuugcuguauguaauugagaccaaacucuaagcuuggggcccuggagagaacaguuguggccugcaggucauuagugaggugagcagaagggaauccuggacuucccagagaaagaggagaccaugccagccucguggaacacagcuaccaggaaauacagaagcaggucuauuccuugcgaacuccgaaguccaugaaaaaacggacccacagugggguggcuaaaaugucccagcgcaagcugccgcugcugcugauggaccauagcucaagggcaaggcuuguaaaggauuuuacaaaggauuuuaaaguauagccagaaaagauacgguguuuagaaguuaaacgcuguugucugaaggaaguuugccggaaagauguaggcuucaagggcuacuggacaaugauuggucugaacuucaacuuacgggaacugcugacaaaauuugaaaagguaugcagaaagcaaacuucaugaauguacuuuuuuccuuucuuucuugccuuuuuuuucacuauacauuuagauagaugcucuauugacucuuuggugguuuaguauaauuuauaaggaauauucaauuuugcugucuccuuuaaagauguuuuucaaguaaagggcuaauuagcaauuacuuccuuuggucaggagggcuucucaugaugccugucacuuuuagaauuccacaucagaagaaacucuuuguacucaagucagcugguaauuuaacugaaacuucuuuggagaaaaaaaaaagaaaaugaaaauaaaauaaaaauccagcaaaaaacacuggguauuggugccaaagucugacuucguaggcauggguucuguucuccauaccccucagguuuaucuguccagccacugccugccgugcacugcccuguacagcccucugccuggggacucagcuguggguggcagaagucgcuucacagugacaguggcacaucugaccucaggcuuuuuaucugagcgugucuguuuuaaacauggagugcuugcaugcacugugaagcuuuaaugcuuggauuauuaaaugugcguguagcucuuuuuuccauaggaaggcuccuggcacaaucuagauggagucuagccugccaaauacuaccuuacauuuauaguuaaaacagaaaaccuccacaugcguguaugcgcuccugcccucuuuagccuuuggaugccaaacaccaaucuucuuccaauuuccagucuuuaaagaaaaagaaaggcagaaaggggugaaguccucccucacuugguauguaagucaauuauuaauauuuaaaaagcugugcucaguggcuuucaccgugaaugccccauggaucauugcaaguacaaauacuguagaagcgggacuggauugagucauuaaaagaauaaugggcuuuuucuuacaaaccacaauugccagagggaaaagaugcaacaucaugccaucugaaaaguuuggaagcuuuuccaaaacaauugcagucacugcuugccuuuugaugauaggaacguuauggugggaugaauguggagagagaagaauuuagcucuuugcucccuccuggcugcaguugcuucucccaaucucucucugcaccucuacuguaauguaaggauuaggcuuguaacacagggcggacuucgaccucucgcuuuaauaugugguuaagcaucuaaauuccugagaguaaaagacgguucucccucagcuugcucuccacuuagaaggggcggggaaggcaaggaauaucuuccuuauggcagcugguaacagcaggugacaaacuuuaugaccauaaagaggucuguuagcuuguuuuguauagauuugucuguuucuuccuuuaaagguauagagcauauguuacaugaauaauucauuacuuagacccccugagaggcaguaauugugggcaauagcuggacuuuuguauuguaauugcugcuauuagucuuaaaagucuaggucagauaccagggguuccuaaccugccucagcuucaagccauuuuauuggcagaguuagaaguucugguuauauuagcauguuuccccuuuuaacucccaugucuuaguauuugucuuauuccuauuuuaguaguugaauugacaguagaagauaucuacuggcuuuuuccugucaaaggcuugauuugggauuuuuauuauuauuauuaucuauuuauuuauuuauuuauuuuugagacaaaaggcgaacucaaagaaacaguccugauguaauucucagucugaaguucuccauauauguguauuuuuguguuaggcaguuuuauaaaaaccuaugugaaaguugaucucuuuggccguauuuuacuucuaggaaguugucguacaugaauguauucuuuccaaaguguuaauaaaauccuuugcguauucuuacaaaaucugucucauauauugagauguugcuucauugguuuauuggcaggaaaacuggaauuacggaaaaguaucaguaccucacacgucucaaauacaacuaaccaccuucccccaacaaagcaauaaugccauuucuagggaaagaccaaggccuacugcuauaaugcagaagccacaggaucccuucagaagcugaguaacagccauucuacacgcagagguagagucccuuuacccucaauucucaguccugucucuuccucaguauuaguaaccuguuucuagagagaauacuagccuuaacgauuuaccacuuuucauaucagcaguugucauuguucagucugaaguuuaggugaccacaguagaaaggggauuuugcuguauuccugaaggaauuucaggcuuuaagaaaacgaggguccacuguuggacuaguagacucaaauccugauacgcuuaguaguugaggccaacagcugagcagcaggccuuccaaugguggcuaaucuggaaaguuauagacuggucagaucauuaaaauucccaggugaaagcagaccuucagcauaacuuuaagacagcaguuuuuuugugaagguaaauugaaagggauauuuuaguugauauuuuugaauuuuggagacauccagugguuuugugauuuuuacuggauauaagaauguuuggcauguuauacucauauaagaauguuuggcaugugguugagcaccuugucucagcaugugugaugcugggauuguaguuucccagcacaggcaggaugggcaauuucuuacauuggguacugauuucuagucuucuagaaccagaaagggcaaggcuaggagucucuugcaggcaggaaguauuauguuccuacaagaugacagcucauuacagauuaggaaggcccaauuggagggaaccaugccaacucgagugguaccuaaagaggaagaacuucuuaccaggggaggaugaccccauaccaagaugugccugccagcaagcagguccuaaucaucuaacaaagugauaagggaugagaaguuguggccaugggcucaagggugacuaugggaagaguucacauucaaaguugacuaguccaccaacacaccucucugagauccagccaauagguaguuuuauuugccacgcugauuuuaauuaauuuuuuucccugaaaguacuuccuaaaggaaguaucucaugacuuuagggacuauuaacauacugucauacuuaagccauuugcauuguguacuguauuucuuuuguuuaauagucacagaggauaguguaauggccaauuuuagcucagugacauuuugagugacugcugccuuuuauuaauuuauucagaccugcuacugaaugguuaaugauaaucguaguucucuaagggauuuuuugauguaugugucugcugugugugugagugccguucucuuaguaccauucucuuggugacuccuugggcaaagaugcuuccuaucauaacaacacagagagaaaccacucaaugcugaauuacuuuauggcauuuaccuccuuucacaugacucuaucuuuuauaauuacaauuugaagcuauauuguauugcucaguuugccauaucucauuuuaaaacaaauguguccucaauaagauauaguaaacacauuucaaagucuccucauuuauucccuacuuagcaaauauuugugaaguauguaccaggugcuagucuaaguguauagauggagaagacauugaucuuauggccgaaugggaggauacagacaaggacauuuucaaugacaacugcauaauuaagcaaaaguagaugaaauuauaagaguaaugauagcccuaaucucaguacuugugaagucucuccuggagaaauuacauuuaaacugagacuuaacagaugaguuuaaguugaaagaaggaaaugagauuauauaccaaugugugugcauguguguggcccauggguggacuugugucaggggaagaaauugggagcuuucaggguaacagggacugcuuugacaugggucagaaguugagaagcugugugccccaggcuuguaguuuuaaacauuugaaaugcgauaauuuuucucuggguuuucugaccuguucaguuuugauuacacgaucugauuuguuuguucaguuuucaucacacuaucugaguuuguuccacuuaguaauuugacuguuuucuacucuguugucuuacuuuuuuuuuuuuuuuggagacauggacuugcuguguugcucaggcugaccuugaacuccugggcucaagcuauccacccaccucgagucuuaccuauauuuaucaucacagauaauaggaaaagaacauuauuagcaucgauuucuuaauucagaaaugcugcuguagaccugaugauaccaccucuauugucagucaaaaaugugauucaauagagugauuaaaaucugugagauuagcuguuggaagaaaauuuauagaauaauaauuaaaaucaauaaauuaauugaauaauuaaugacaauuacuaucccagaaaccucacaaacuguuucaaaacauauuuacauaugacauaaccuuugaagaugauguuauuugccuauucuauuauuauuuaaguaauauauauauauauuuuuaaaaucaugauuccucauuuucaaaaccuaaagcucuggcaguaauccugcugagcuccugauaauaauucugaaaucuagucugacuuuugaaaggaaugguggauuuauuuuccucuaaugauuaacuuuguuuaguuaggcugagcuuugggacaugauagcgaaauuguucuaaccucauuucuucuucaccuucaggaaaggggucagaacuccuucagaaaaaaacaucacuguugccacauaagguuaaguaaauaguuggugcaaaaauaaaccaaaauuauuuuaacaagaccaaagaggaugaaucuagucuagcacccauuuaguuguugaagacuuccuggugguacuguucuaaaucucuguuuccugucagagauuucagacaguucuguuuauuauaaugugaggaaauauuuuugcuuacauauuuaagcaaaauauguuuuauuuucaugauguuuuauugauuuguuuuauaauguauaucacauaauuuguuuauaauguuuuauaaucaagcuacuacuuguagcuuuauaaucaaguaguagcuugacugugaaacauuauaaacaaguuauuugauauacauuauaaaguguuuacaguuauaucucuauggguuauaucauuagagaaaugcccaguuaagggcaaaacuuguagucaaauacuaauuauuaaauaaguaaaaaguaaauaaauaaauguuuucccguauuugugaaguuuaucuugaucugaauaguggguguuguuuacagaaagacuaaccacuuaucagugaaccucagugagcuuuuguagccaucuucuggagggcuguucugaggguuugcaucuuaugcuuuugaugguguuuuauuuagagaaaaguguguaguccuauuuuucuaacuccuggcuuuucuuaaccuucuacauuauacuuacauuguuuuaaaauacuuuucaagugaauccuuaggacauugcuucugcccuguuuucaaauguuaguucaacugcuugaauaucuugccauggccccucugugcacaugacuggcuuauguuaaaugcuuggaagagcauugcuuugugcuucaagauggauuacauucccauaacuaauuaucaguaaccauuuugugcuguuuaaaguucagaagggcuugcaggugacagagguaagcaucaguagggccaagucucccagcugugcagugagagccagcccucuuucauggaacuuuaauuuauuguagcauuugacgccacaucagggucaugaucugacagccucccaugcugacauccugaguuucaaaucagugcaucauugcauagugaucuacgaagaaacaugauucauuaacugcauuuauuucuaaauuuucagugcaagcuuagccaggacuuugcagugcaggcuucuaaauuauuuuaaguucccccauuaaacuuuucaagugaagaaauugcacaaaaugauuacuacauuuccuuccaauuuuucaauuguuugguuuucuccuagcacuauaguggccaauuugccagucaaucaaaauaaaccuauuaauccacucauacauugauauguguaucuaugugucaucuaucuacucuguuuacauuaggauccuucuauguaacagagacugugaggauacagaagaaauauuaagaugauuuucuguuuugaggcacucuggguauauuuggcaaaguuaauaugccaccaaaugucaaauaaaacaaaauaaugucuguggauuuccuuuucuuugaucacuugugguuugauuuucuucccaacuuuugaugaugaucauguguggaaggguuuuccacauacugaaaauuauauuccaacaugaacauaugaucacugguagcacaguuaaagaaagguuuguggaacugcuuaucauccuugguugggccagcuaugcaguccuguuucauucccauucgucgugguagcuggguuggaaaacacaucgccugaucugaugugagaaggcgaauuuucuuuauguucuuggaacccaaauguccugauguugcguaugcucuugugaaacuuagaaaacuaugcaucuuaaugcaccacuacuacuucuucuuccucuucuuccuccuccuccuccuccuccuccuucuacuucuucuucuucuucuuuuagaagaaaucccccucugucauccaggcuggagugcaguggcaccaucucagcucacugcagccuuugccuccagggcucaagugauucuccugccucagccucccgaguagcugggauuacagacaugcaccaccacacccagcuaauuuuuuucuauuuuuaugagagaugggauuuucauccuguuggcuaggcugaucuggaacuccugaccucaggugaccaaccugccucagccucccaaaguucugggauuccaggcuugagccacugugcccggccuuuuacuuuuugcuucucuucaaugugaaaggaaucaaauaggucaaaccacaucaggauguuguaguuugaaguugucuugugauuuuaggugugguucaucgauaaugauguauaggaacuuaaacaggaaauuugaagccagguucuccuuggcaauagagagcaaagaggugccuugcuugucgugucauugagcuuccugagaaagauggcuaccuuacagauauauagcguaagcauaaaaucauugcaaaacacuaucugcacaccuuuaaauaugucucuuuagaggucuuaaaaugcacuucaggacacaaaaauagaacaguuguaucaggagaugacaccaaagaacuuuucagcggaacuucccuuuuucuuuuuuucacugagaauuucuauuuggcacaucucaaacuaugauuauaaugagacugcaauuuucuacacauaauguugcacagccugagaaccuugaaucauuaucuggcucuguuucccagcugcccuauucacuucucuucugcacugcucugggauagaacugccagugaaaugcaaaagauucaacaaucucagaguuuuuauucagcgguuaggccuaauucugcaaacugcaaaccacacuuugcauuggaccagauuugguuuugucauuugggucagauaaccucagagaucaauggguuugcaaauuuggaccauaaaucuugcaggagcugucuauuaaacuuuguguucaucucacccagucucuaaaucugacccuauuagugucauguuagacaucucaaaucccaucagaaauaauacuaggucagugcugccaauucaccucauguaacugacaucuuccuaacaugcugauuggaguagugaggugcaaaaggcccuuccuuggguguuucugguuaguggaggucuaugggugauugaaaaacaagcacuuagaugcuggucccuaagccuggauucuugguagaaugcaugggugugcuuacuaggagugaauuuuaaauaaagaaaagcauucugaguauuuaaaguauuccuauguaaauuuucacccugcuuauuuauuuauaacaagagaaacuuacaaugagugaggcugucuuagucaguuugggcuguuauaacaaaaugccauagacugaguagcuuauaaaccacagaaauguauuucucucagaucuggggacugggaaguccaagaucauggcacuggcagauucgauauucuagugagggccuacuuucugguucauagguguuaccuucuaggugggucuucaccugauggcaagggcagggcagcucucuggggcuuccuuuauagggguaguaaucucguucaugagagcuccacccaugaccuuaucaccucccaaaggccccaccuccuaauaccauuauugucaggguuagggguucaaaaaaaagaauuuugggaggacacaaauauucagacuauagcagagucuuauaaagaaaagcuucagaguagaaggacaauagaacuaugguguuuaggaguuugcucuccuuuacuaauucagauucauugccugaaaugcaaguuuuuuauuucugcagugagcuguuuuacuguucauuaccaaugauagccauggagacucacaccacaucuucauacccagcucuggucccugcuuuucuguuuguaauucacacuuacuuaugauacauuacuggcugucaugccagaguuagcuacaauuagguugcuuccauuaaauucaggaggaaaagauaauugccaaacuaauauggauaguuaugcugacaauuuuauaagggaaaaguaggaaaaaaauuggauagacacucuauaucuuaaauuuguuagauuuaucuaauaaaaagaaacuuugaguuuaacuuuuugaaaacucagagaaguauagagaugaaaacuaaacuuaucuguaauccucuucuauagagguuacacuauuuuuguuuauuuuuguaguccuauuguguaugugucaaauuauacacaaaugcauaugccaauuaaaguauguacuuuuaaaaaugaaauuaucauaauauauaguuuuauauccuguuguuaaaaauauuauaucaccacuaauauauuaugauagcuuccacucuuuuacucuaaaaacaaucaguguguuaaaacauuuuuauacauaagucuucuuaaguuagauaauuuuaacauuuuuauggcuuuuuaaaauugcaguaguuuuggggggaacaggugauguuugguuacauccauaaauucuuuagugaugauuucugagauuuuggugcacccaucacccaagcaguguacacugaaccuaauguguagucuuuuaucccucaccccaccucccacccuuccccuggagcucccagaguccauuauaccauucuuaugaccuucugucaucauagcucagcucccacuuauaagugagaacauacgauguuugauuuuccauuccugacuuacuucacuuagaauaauggucuccaacucuauccagguuucugugaacgccauuauuucauuccuuuuuaugccugaguaguauuguaguauuccaugguguguguguguguguguguguguguguguguguauacauauauguuuacauuuucuuuauccacuuguugacugauugguauuuguacugguuccauauuuuugcaauugcaaauggugcugcuauaaacauuccuguguacaugucuuuuucauauaaugacuucuuuucuucugggaagauacccaaguauggaauugauggaucaaaugguaguucuauuuuuaguucuuuaaggacucuccauacuguuuuucauagugguuguacuaguuuaugcucccaugagcagcguaaaacuucccuuuuuaccacauccacaccaacaucuauuuuuuuuuauuuuuuaauuauggccauucuugcaggaguaaggggguaucacauugugguuuugauuugcauuucccugauaauuagugauguugagcauuuuuucauguguuuguuggccauuuguguaucuucuuuugggaauugucuauucauguccuuaaucaaguuuuugaugggauuauuuguuuuuauucuugcugauuuguuugaguuccuuguggauucuggauguuaguccuuugcuggaugcauaguuugugaauauuuuucccacucugugacucuaugggcuguccauuuccucuucugauuguuucuuuugcuguguagaagcuuuuucauuuaauuaagucccgucuauuuauaauuguuuuuguugcauuugcuuuuggguucuuggucaugaagucuuugccuaagccaauaucuagaagaguuuuucugauguuaucuucuagaauuuuuaugguuucagaucuuagauuuaagucuuugauccaucuugaauugauuuuuguauaaggugagagaugaggauccaauuucauucuucuacauguggcuuaccaauuaucccagcaccauuuguugaauagaguaacuuuccccacuuuaugcuuguguuugcuuugucgaaaaucaguugucuguauguauuuggcuuuauuucugggcucucuagucugauccauuagucugugugccuguuuuuauaccaguaccaugcucuuuugguaacuauagccuuguaguauaguuugaagucagcuaaugggaugccuccagauuucucccuuuuguuuagucuugcuuuggcuaugugggguccuuuuugcuuccauaugaauuuuagaguuuuuuuuuuuucuaguucuaugaagaaugaugauaguauuuugaugggaaucauguagaauuuauagauuguuuuugacaguauagucauuuucacaauauuuauucuacucauacaugagcaugggaugugcuuccauuuguuuguguugucugugauuucuuucagcagcauuuuauaguuuugcuuguagggaucuuuuaccuccuugguuagguauaauccuaaguauuuuauuuuuuuuacagcuauuuuaaaagggguugaauucuugauuuguucucggcuuggucacuguugguguauagcugugcuacugauuuguguacauucauuuuguauucugaaacuuuacugaauuuauuuaucagaucugggagcuuuuugguugagucuuuaggguuuuuuagguauacaaucaugucaucagcuaacaguuugacuuccuuuuuacagcuaacaguuugacuuccuuuuuacagauuuggauguccuuuauuucuuucucuugucugauugcacugucuaggacuuccagugcuauguugaauagaagugaugaaaguggacauccuugucuuguuccauuucucagggggaaugcuuuuaacuuuuccccauuaaguauaauguuggcugugaauucaucauagguggcuuuuauuaccuuaaggaaugucucgucuaugccaauuuugcugaggguuuuaaucauaaagggaugcuggauuuuguuaauugcuuuuucuguggcuauugagaugaccaugugauuuuuuguuuuuaauucuauuauguguuguaucacauuuauugacuugcagauguuaaaccaucccugcaucccugguaugaaacccguuugaucaugauggauaaucuuuuuuauacgcuguuugauucaguuagcuaguauguuuuugaggauuuuugcaucuguguuuaucagugauauuggucuguaguuuucuuuuuuguuauguccuuuucugguuuugguaucagggugauacuggcuucguagaaugauuuagggaggauuuccucuuucucugucuuguggaauagugucaauaggauugguaccaguucuucuuugaaugucugauagaauucggcugugaauccaucugguguggacuuuuuuuuuuugguagcuuuuuaauuaccauuucaaucuugcugcuuguuacuagucuauuccgaguuucucuuucuuccugguuuaauuuagaaggguuguauauuuccaggaauuuauccaucuccucuguguuuucuagcuuauguguguaaagguguucacauuguucaugguagccuugaaucaucuuuuguauuucuguaguaucaguuguaguaucacccauuucauuucuaauugagcucauuuauauccucucucuucuuuucuugguuaaucauguuaauggucuaucaguuuuauuuaucuuuucaaagaaccagcucuuuguuucacuuacuuuuuguguuuuuuguuuguuuguuucacuuucauuuaguccugcucugaucuuuguuauuucuuuucuucugcuggauuuggguuuggcuuguucuuguuucucuaguuccuugaggugugaccuuuccuugucuguuugugcucuuucagacuuuuugguguagacauuuaaugcuguauacuuuccucuuagcacugcuuuugcuauaucccagagguuuugauagguugugucacuauuauuguucaguucaaauaauuuuuuaauuuccaucuugauaucuuuguuaacugaaagaucauucaggagcagauuauuuaauuuccauguauuuguuuacuuuugaagguuccuuuuggaauuaauucacaauuuuauuccauuguggucuucugagagagcacuugauauaauuuugauuuucuuaaauuuauugaggauuguuuuauggccuaucauauggucuaucuugaagaauguuccaugugcugaugaaaagaauguauauucugcaguuguuggguagacuguucugcaaauaucuguuaagcccauuuguucuaggguauaguuuaaguucauuguuucuuuguugacuuucugucuugaugaccccucuagugcugucaguggaauauugaaguccccuacaauuauuguguugccaucugucccauuucuuaggucuaguaguaauuauuuuauaaauuugggagcuccuauguuagguguauggacuaauccuuuuaucauuauauaauauccuuucuugucucuuuaguuuuugcuuuaaagucuguuuugucugauauaagaauagcuacuccugcuugcuuuugguuuccauuugcauguaauaucuuuuuguaauccuuuacuuugaauuuuuaugaguccuuauguguuaggugagucucuugaagacagcagauacuugguuguuggauuuuuauucauucugccauucuguaucuuuuaaguggagcauuuaggcuauuuacauucaauguuaguauugagaugugagguacuauucuauuccuuaugcugguugcugccugaauacccuuuuuuaaaaaauuguguuguuguuuuauagguucugugagauuuaugauuuaaggagauuauauuuugguguauuucaagucguuuuucaagauuuggagcaccuuuuaugauuucucguagugcugauuugguaguggugaauucucucagcauuuauucaucugaaaaagacuuuaucucggcuuaauuuaugaagcuuaguuucacuggaugcaaaauucuuggcugauaguuauuuuguuuagggaggcuaacaauaagaccccaaucccuucuggcuugcagaguuucugcugauaaaucugcuguuaaucuuauaggauuucccuuguagguuaccugaugcuuuugccucacagcucuuaagauucuuuucuucauuuugguuuuagauaaccugaugacuguaugccuaggugaugaucuuuuugugacgaauuuccaagguguucuuucagcuucuuguauuuggaugucuagauuuuuagcaaaaccauggaaguuuucauugauuuuuuuuuuucaaauaaauuuuccaaacuuuuagauuucucuucuuccucaggaacaugaauuauucuuagauuugguuguuuaacauaauccuaaauuucuuggaggcuguuuuuuuuuuaauuauuuuuuauuugucuuugucagauuggguuaguuggaaagccuugucuuugagcucuaaaguuuuuuuuuucuacuugcucaauucucuugaaacuuuccaguguauuuugcauuucucugagugugucuuucauuuccagaaguugugauugucuuuuauuuaugauaucuauuucucuaaagacuuuuucauccguaaccuguguuguuuuuuuaauuucuuuuuuugagaugaggucucccucugucacccaggcugguguguaguggugugaccuuggcccacugcaaccucugccucccaggcucaagcagucuucccacuucagucucccaaguagcugggaccacagguguauuccaccauuuccagcuaauuuuuuuguauuuuggguagagaugggguuucaccauguugcccaggcaggucucaaacuccugaguucaagugacccuccugccuuggccucccaaaguacugggauuacuggcaugagccaccacaccuggccauguuuaaaauuucuuuaagguaguuuuuaccuuucucuggugccuccuugaguagcuuaauaaucagccuucugaauuauuuaucuggcaauucagauauuucuuguugguuuggauuggauccauugcuggaaagguaaugugaucuuuugaguguguuauagaacauuauuuuuucauauuaccagaacugcuuuuuuaguuccccuucucauuugaauaaacuguuucauuggaaagaucuggaacucacgggcuacuguucagauucuuuugccccauaagaugaucacuugauguaguggucucccccuuccccuagggauggggcuuccugagaaccagacugcagugaugguugugcucuucugcgucuagccacccagcagggcuaccgggcuccaaucugauccuagggaaugucugcaaagaguccuguaaugugaucuguccucaggucucccagccauggauaguagcaccugcuccaguggaggcugcaggggagugaaguggacucugugggaauccuugguuguaguuugguuuagugcucugguuuucucgaaugccaguuaugcuagcagugaaguugucaugugaacagacucaggacuugugguuaagcugaugugugguaagcaguggaauuagcuguuguuuucuccuucuuuggagcaggguuguucuguuaugaguugcugucauaacuugaguugguuggccucuagccaggagguggugcuuucaagagagcaccagcugcaguaguagaaggaugguauaauguugcccuauguuggccaggaugaguacucaggucaucucaggugauggguaaggcuguaaaacucccaagagcuuaugcugucuuguggcauuugcaguggcaaguugcuuccuugaaagggucugugaauucuuuugguuuuccugguauguuccugcagugguucuuggagcgaaaguucacggugugagucuccagacgcuguucugucugccuaagcaggagcugugcauuagaccugucuccuaucugccauuuuccucaaaagaauuuuaagucuauggcuuuugauauagauugccaaauguuuccccaaaaucugaaccaauuuuaaaaaaauuuauaauaauucuaauuuuacuuaaacugcccccaaauguauuuuauaaagauaaacuauuuuucuuuuuuuuuggcuuuuucauuuaauacuagauauaaauaaauuauugaaauuucccagauaaugcaugcaauuguuuuggauaaaucagugggauaauauuuucuuuuauauuuaguuaucaaaauagauuaagggcaaguaaaguuagggagacugacuuucuuuguacuuucuuuauacuuagccagaaauuuuucuguuacagaagaauuagauuguuauuuacaugccaaauauauguuuuucgugcuuauucccaagaaugaucuuucacaucaauaauaaaauaauuagguugauaaauuuaagaaccauuuuaaaucagauaacuucacuuaaauaugugcauaaaggcuagaucuugucaaaauuucccucuccccucuuucucuguuuuugugugugcauaagccugaauauaucaguuauucuaugcuuuuggaaguauuuuugcugacacguuaaaaguuuguuuuuuuuuuaauuauacuuuaaguucugggauacauaugcaaaaugugcagguuuguuacauagguauacaugugccauguugguuuguugcacccauuaacccgucaucuacauuagguauuucuccuaaugcuaucccuucccuagccccucaccccacaacaggccccggugugugaugaaaccguuguuacuaguuuuuauuucuuaaagaugaugaacuuguauauaaaaauauucuuuuaacauuuuagaaauaaauuuuauaagacugaaaggacaaacuauuaguaaauguuucaaaaugugaaaaacacuuuaguuauaguuauguaauaucuuagugaccucuguaagauguaauauuuuaagggaaguuuuaccuaugugaaaacgggagaguaagagucuguuggauauuaggcaaaguucagugauuuggcaacaacaguuguauaagauuucaaaaauugcuaauugaaucugauauaccaacaucuaacuagcugguacaugaacuauagauuacaauacauuuuuuaaaaaaauugaggagucaguguauugaacaccuuuuaaaaaauuucaauuuaaguucugggauacaugugcugaacgugcagguuuguuccauagguguacaugugacauggugguuugcugcaccuaucaacccaucaucuagguuuuaaucccugcauacauuagguauuuguccuaaugcucucccuuuccuuucgcccuaccccccgacaucccccggugugugauguccccuucccuguguccauguguucucauuuuucagcucccacuuaugagugagaacaugcgguguuugguuuucuguuccuguguuaguugcugaggaugaugguuuccagcuucauccaugucccugcaaaggacaugaacucauucuuuuuuauggcuguauaguauuccaugguguauaugugccacauuugcuuuauccagucuaucauugaugggcauuuggguugguuucaagucuuuguuacuguaaauagugcugcaguaaacauacaugugcauuugucuguaugguagaaugauuuauaauccuuuggguauauacccaguaaugggauucugggucaaaugguauuuuugguucuauauccuugaggaaucgccacacugucuuccacaaugguuguacuaauuuacacuccuaccaacaguguaaaagcauuccaauuucaccacauccucgccagcaccuguuguguacuugccauucuaacuggcaggagaugguaucucauugugguuuugauuugcauuucucuaaugaccagugcugaugagcuuuuuuucauauguuuguuggccacauaaaugucuucuuuugagaagugacucuuugaauccuuugcccacuuuuugaugggguuguuugcuuuuuuucuuguaaauauaaguuccucguagauucuggauauuagcucuuugucagauggauagauugcagaaauuuucucccauucuguagguugccuguucacucugaugguaguuucuuuugcugcccagaguaauugauagauucagugcuauucccaucaagcuaccauugacuuucuucacagaccuagagaaaaugacuuuaaauuucauauggaaccaaaaaagagccuguauagccaagacaauccuaagcaaaaagaacaaagcuggagguacugaagauuuaaagacuauaauuuucagaauaauaagaauuuuggaagcacuugaauuucuuauaauuuaaggugaaaugaacuauuuugcuugagagcaacucaucugugaauauaaagauauacugauuccuaacacuugcauuaucuauuugcuuuuuucuguuuaggacauccaggcagaaauugaugcccacaaugacauauuuaaaagcauugacggaaacaggcagaagaugguaaaagcuuugggaaauucugaagaggcuacuaugcuucaacaucgacuggaugauaugaaccaaagauggaaugacuuaaaagcaaaaucugcuagcaucaggucagaauagucaauaucaaaauaaaaauaaugggguggaagggguagauacuugugauuuuuguauaucagaaagagaaagcgcagccuuaccaccacuucuauuucaucagaaauaguuuaagauuuuaaugcaaagccuguuuccuugaguuauauaguucaagcucuauuuguguccaauacuuucugccaccuguucuagacuauucauaaauguucauauauuuuaaaucuaacaauacuaguaacaauacuguuagcaacaucugcuaauuacugaguguuuaccuugacuaaguacuuguuaggaucuuuacaaauguuacuuuauuucguaaucaaaaaauccuaguaaggugggugguaacauuauuucuucuaugaggaaacagagguuuaaugaauauaaggaacuugccaaguuuuggggcuaagaagugccaagucagaguuugaaucuagaucuuuuuuacucuuggcagugaacauguuuugcuuaaucauguuguuuuuuaugccucauucaagauguauuuauagaaauuaaauaucucuuauggacacuaaaauggaaaauugaugauucaugucugcauuuggagagaguaaaauuaaauaaggaugaaccuuaggaccagaauucugacuaggaaaagaccuugaaaauuacccagagagacaguaugauuaguguuauugggaucaagaauauuuuaagaucauauuuaauagagaguggacagcuccuaauuauauauaaauuuagugaauacuggcugaaaaauauguuauugagcaaaaaucuaaaagcagaacauuggcaggaaguccuggaucagcuuuuguuuuguuuuguuuuuugccuuguaccaaguguacauccuuuaaaccaaauggucuugaauuugacucugacuucacuauuuacucucugaucuugaacaaacuacucagccucuuugagccuuggauuauuuuauuuacaaaaucagaauagaaauauuuaacacucaugauugcuaugaagauuuaauggaaugguuugauaguucccuaaucuauguaaauccugccuaagaaagcaucuaguuaaguauuuuuauacauaaaggggcucacuggaucugccucagcugguuucaagauuuaauggagaacagaauuuucaaugauuacuuaucauaaaugaauuaaaauuuuuuuuucuaagauguauugaaagguuuuuauucuucuggagcucagagaguggaauuugcaguuccucuuacaugugaggaagggagcaaugcagcauggacauggaugcucuguguaaaguucccauugggaaauacaauaggucagcauuggccaacuacuuuuucuuaguaagagaagaaaauuagggaguucuauguagugagggauuauacuuuuuuaagauuugaauuuucaacugccuagaucccaucagguugcaacuuuccauuccucauaaauaugaacaaaaauauuuaaaauauuaauagugaaaagcauucacugagcauccagcaagucaucuaugccagcaaccuaagaauuccagagcuggcccuagugaagaugguauacauggugcugggauuuucagagguuagagaaugacuuauuuaggaagaauaauuuaaugaagaccuauaucauaaacagaucauucuaaguaaaaaguuacagacaagaaauuuuuggucuuucuugggaguuauugccuaagccuaucaugacacauuuuuuuuuaaccuggaaagaaagaacuuauaaacuacaguuggaauauuauguaauaaguaaguuaacauuauuuuuagaagaugggagaauaugcuuguggcaguggacuuuugcauuaagguagaucagacauuccaguaaaauguaauaauaaauuaaugugauaaugaauuaaaauaacuuuuacuuugauuagucaccucaagagauucaagcacuuauucaagcauguaauaaaaacuuauuucugugcuuaaggcauugcuauuaauaagauguagucccuaccccuagagguucacaaaucuguuuagauuaagguagggcccaaagcagagagugguuacucucacuucagaugaucaaagaaggcuucauaaaagaggucauuccuuagcugagccuugaaacauauauaguuauuccccagauagucuaggugaugacuggggaaggguaacuaaguuaggggcuugaaauaacacuguguugauaugaaaaucaauacauuaagucuggcugagaauacaguuugcugcuggugucauggggaaaagacuauggcuaacaaaaagacagagguguaagagacaagucaugcacaccuauguguaaccaagcucccuuccauuguggauggaauugggagccuuuugaguaacaugauuagauuugggcuuuggaagaaucccucacacagcuacggaggaugccucggaugagccuguucugaagaggggagaccugguaggagacacuuucggcaucuaggaaagggaagagagauugagcagauaauuaguucacguuguuaagacacuggugagacauccaggagaagacagccaaagccauuagauggagaucugcucuucaaaagagagcaguaggugaaauagacagacgggaggcgguguccagagacagguggcagguaaccauugugaguuaguuauuagagagguugaaacauuagaagagggcaaagaaguccaagaaacucuaauacauaaggaauggugaaggagagggaagcagcaaggaaacugagaagucccuauccugaagagggaugagauccaggaaugcugucgagagccaaggaaagagggauuucuaaaagaagugcauaaguaauggugcaagcugcuugaggaaguggaguaagaucaggccugcagaguccaggagcaauuagaagggcuuugguggccuuuugccagggccuuuuuuuuuucugguugagggagaaaucugauugcagaggacuaaagagacagaaggggaggugaguacguggaaaaagaacugagucuacucagucucguuaucucaaggaacucaucugugaagggaagaggagggaagaaugcauuugcucuauuauuauaguugauaguauugcaaguuuauaacagcuugaagcuguaucuguaucuauauuaaccuguccgugcuuuuacagagauuagauauggcuuuuaaaaauuuuuuuaauuuuauuuuuaauguuugugggcauauaguagguguauauauuuauggaguacacgagauauuuugguacaggcaugcaugcaaugcauaauaaucacaucguggaaaaugugguaucuauccccucaagcauuuaucuuuuguguuacaaacaauccaauuauacuuuuuuaguuauuuuaaaauguacaacuaaguuauuauugacuauaaucacccuuguuuugcuaucaaauacuggaucuuauucauucuuucuaacuguuuuauaccuauuaaucaucaccacuuccuccccaucaccccccugccccaccaacuacccuucccagccucugguaaccauccuucuacucuaucuccaugaguucaauuguuuugauuuuuagauccccaaaauaacugagaauagucaauguuugucuuucugcaccugguuuauuucacuuaacauaaugaucuccccuuccauccacauuguugcaaaugacagaaugguggaauaguacuccauuuuguauaaauacauuuucuuuauccauuuaucuguugaugaacacuuagguugcuuccaaaucuuggcuauugugaacaguacugccacaaacaugggagugcagauauuucugcgauauacugauuuccuuucuuuuggguauauagccagcagugggauugcuggaucauaugguagcccuauuuuuaguuuuuuguggaaccuccaaacuguucuccauaguguuuauauuaacuuacauucccaccaacaguucacaaggguuccuuuuucuccacaugcuagacagcauuuguuauugccugacuuuuggauaaaagccauuuuuaacuagauuagguaaguuuagcuaaaggcguaaaugaucucuucuuuauuuuuauauuuaaaaaaugaauaagauaaaauuaaaauagcauguuuguuauuacuuggauauuuauaaaagauaaaauaguuuguuauuuaauuuagccucugcauuugccaaaaaugguggcacgugguauguguucaguaauuguuagcuauuauuauucucauugauuaccucuuuguuuggcacuaauuuaaaauacacaggaauucucucuacccuauguuuuucucucggucgguaauguuggggauuucugagaaggucucccaaaacagcuucccccuuugcuggcuggauucugaacaaguaugaaacaaagugugcucaaggggcauucaucauguggccaauagagaacucaaaugccauguuaauuacugauagaggccagguuggaggugguaacuuagagugaaggugaguggagcugucaaccaaaccccagaaugaggcagaaucaccagcagucacugggcaagguggcuucccaagugagaaaccauacauggaagaguagaaaagaacucaguaucuucauggccugucgucaaguggaccguaugggcugagcuaagcaugcccaauuauucucccugaauuuacagaucagauucgucacucuaccuuugcagggacuguuucagggguggagaagagaccagagugugcuuagugagaaaaucccuccccaaggagugggaggaguguucucauaacaaaucuguagaggcaauccaccucccaggcuccuggcuccuucauugccuacugaaagugaucacuguggagcacacuguucagcccuacuucucuguucuuuccucucauuccuuucaugcacaaucugcuccuuauacugccuucuauugugaacacauucuccuaugucucaaauauuucucgaaacuuuuccaucacuuuucucucuaaauguuggguuuccccuuaauugccuacuucgcuugaaacucuuuucaauagagguuaauuuccucauuuuccucaccuagcagccaaugagaauauucugaaucucuaccaacugcuauggacaccaaacggccugaauaccagccauaaacaucaaauguggugccagaaaacacuggcugaaaagggagcccugucacacagggauaagagggacaauugccagccucauugugacucauuaagcauugcuucuccaucuuucaacaacaucuccuuagaagugaaugcauccauuauccuaaucuuucaucaucuuauuucugcuucuuccugaucuauauauaggacaugcuucuacauuccucauuaauucaagugucccuuuacuuuuuuuuuuuuuuuuuugagacagagucuugcucugucgcccaggcuggagugcaguggcacgaucuuggcucacugcaaccuccaccuccuggguuuaagugauucuccugccucagccucccaaguagcugggauuacagguggcugccaccacacccaacuuauuuuuguauuuuuaguagagacgagguuucaucauguuggccaggcuggucucaaauuccugaccucaggugacccacucgccuuggccucccaaacugcugggauuacagacgugagccaccacgcccagccccauuuaccuuuuauucuccauccuuuucuccacuauuauuguuggugccaauauccauauucacaacuuuuuauauuuugauuuccaaguuucuuuuuacuuuaucuguaaaugccuuuaucccuguucuaagucccguagaccuugucacacugggagucaguuaacauuuccugucaucuuggcaucccugagauaaucaauuuccaggagaucaagggcagacuguuuuccagaguacacauuuuauuuuauuacauucgaccuggccaugugcaucugaaugcaauugguuuuccccuauuaguuagugaagagcccucuguuguaucaaaucaaauaagaauuguuuucaaccucaucaguaagauggcucuccuucacauuaagguuaugaguccuauccaggggggugccuuccuucauuagcuuauuauauacuggaccugucuaucuacuguuauuuaacuuuacaguuuuauccaguucauuuuuauuuuuuacuuauuuauuuuuuaaaaguuuuacaauuucaguagcuuuaaggguacaggugauuuuaguuacaaggaugaauuguauagcggugaagucugagauuuuagugcacccaucacuugaguacuguacauuguacccauuuuguaguuuuauuuuuuuuaucccucacugccuugguaaccuccccgaccucugagucucauauguccauuauaucacuguguaugccuuugcauacccauagcuuaucucccacuuguaagugagaucauguaguguuugguuuuccauuccugaguuacuuuauuuagaauaauggccuccagcuccauucaaguugcugaaaaagacauuauuguauucuuuucuauggcugagugguauuucaugguauacacauaccacauguuccuuauccacucauggauugauggacacuuaaguugguuccaaaucuuugcaauuguggauugugcugugauaaacauacgagugccagugucuuuuugacauaaugacuucuuuuccuuuugguagauaccuagcagugguauugcuagaucacauaguggauguacuuuuaguucuuugaggaaucugcuuagagauuguacuaauuugcauucucaccaguguuuaagcauccccauuucaccacauccucauugacaucuauuguuuuuugacuuuuuaauaauggccguucuggucaggguaaggugguaucucauugugguuuuaccagcauuucccugaggauuagugauauugaguguuucuucauauguuuguugcccaguuguauaucuucuuuugagaaaugucuaaucaugucauuugcccacuuuuuaguaggauuauuuguuuuuguucuugcuaauuugaguuccuuguagauucuggauaucaauucuuuguugggagauucuggauaucaauucuuuguugggugcauuguuuacaaauauuuucucucauucuguggguuguuuuuuugcucuguugauuauuucuuuugcugugcagaagcauuuuaguuuaaguaggugccauuuauuuauuuuuguucuugcuacauuugcauuugcuuuuggggucuuagucauaaauucuuugccuaggccaauuuucagaagaguuuuuccuagaauuucuucuaaaauuguuaaugguuucaggucuuagauuuaagucuuuaauccauguugaguugauuuuuguauauagugagaaauaggaauucaguuucauucuuccacaugugacuuuccaguguucccagcaucauuuauugaauagcauguccuuuuuccaauuuauguuuuugugugcuuugucaaaaucaguugguuguaaguauuuggcuguauuucuagguucucuauucugcuucauuggucuaugaagaugcuugauauaauuuugauuuuuaaaaauuaauugagacuuguuuuguggccuuauguauuuuggagaauguuccauaugcugaugagaggauuguauauucuucaguucuugaguagaauguucuguaaaaagcaguucagugcgcuuguucuagaguguaguuuaaguccaguguuucuugguuaacuuucugccucagugaugugucuagugcugucaguauaguguugaaguccccuaauguuaaugugcugcagucuaucucuuuucuuaggccuaguaguaauugcuuucugaauuugguagcuccagagcuagacacauacauguuuaggauuguaguaucuucuuguuggauugauccuuuugucauuauauaaugaccuucuuugucuuuuuuuuuaacuguuguugcuuuuaaagucuguuuuaucugauauaagaauagcuacuacuguucacuuuugguugccauucgcaugucauauuuucuuccacuuuaccuugaaucuauaagaauccuuauguguuaggugagugucuugaagagacacuuuggguguuuuuauccauucugccacuaugucuuuuaggugggaaauuuagaccauuuauguucaauguuauuauuaagaugugaggcacuguuucaguuaucauguugauugucaccuagacacuuuguuuucuuuauuguguuauuguuuuauagacccagugaguuuuaugcuuucagaagguucuguucuggggcauaaugaccuuucauuucaagauugagaacuccuuuuagcauuucuuguguggcuggucuuguauugacuugcauauguugaaacauuccugcgucccugggaugaaaccuacuugguuuuggugaguuaucuuauugaugugcuguuggauuugguuuacuaguauuuuguugaggauuuuugcaucuauguucaucagggauauuggucuguacuuuuguuuguuagguuguuuccugguguugguaucagagugauaauggcuucauagaaugaguuagggaagacuuucucuuucucaccuaacgcauaaggauucuuauagacucaagguaaagagggugaaaauauauuauuugcaauugaaaaccaaaagugaggaguagcuauucuuacauuagauaaaacagacuuuaaaguaaaaacaaucaaaaaaagacaaagaagguuauuauauaauaaugaaauaaucaaacaagaagauauuauaauccuaaauauauaugcauaugacaaauuccuuuggcauuuggcugugugaaaaauacuuuauuucuccaucauuuaugaaacuuaguuuugcugaauacaaaauucuuggcugacgguuuuuucuguuuaaagaggcuacagguaggauccaaauuccuguuagcuuguaagguuucuacugagucugacuuagcagucugcuaagucugcuguucauucgauaaguuuuucuuuauagguuacuugaugcuuuugucucagugcuccuagaacuguuuccugcauguugacauuagauagccugaugacuauaugcuuugcugauguccuuuuuguagugagucuccuaggacugcuuugugcuucuuguauuuagaugucuaaucccuagcaaggcuagagaaguuuuccucaguuauuuccucaaauaaguuuucaaaacuauuugguuuuucuucucccucaggaacaccagugauucuuagauuuggcccuuuuacauaaucccauauuucuugaaaacuuuguucauuucuuuucauucuuuuuucuuuaauuuuguuugauuggguuaauuugaaagccuugucuuuugacaggcuuuugacagaauuuugacaaggcucugaaauucuuucuuauacuuagucuaaucuauuaaaacuuuccacugcguuuuguaauuccuuaaauauguauuccauuuccagaaguucuguuuuuuuaaaucuaucucauuagaaaauuuuucauucauaucuugaauuguuuuuauaacuucuuuauguuguuuuucacuuuucucuuguaucugguugaguaacuuaauagucauccuuuuguauucuuuaucugguauuuccaaagauuucauauugauuuggauuuauugcuggagagcuagugugaucauuuggugguguuaaagaacccuguuuggucauauugccagaauuauuuuucuggcuccuucucauugcagaaaacuauuuauucuaauuauuuuuuaauuuauuuuuuguucgacuauguguucuuuuaaauuucuuuuucucuccuugaggaugugauuuuaaugacucuaguuuauuguaacccaauucagcucugcaugguuucaggggugaagacucuguaugaguuccuugguuauagagucuguaugauggcuuucucagauacucauuguaguaguaaugugcuuggugugugaguggguucacugucuccuguggcauuggaauggcaguggucucuugaagguuaucucauuccccaguggugugcacuuauuuauuuuauccaguauuucauuuacuagguugaacaguucagguuucaggccaguaguggagguguccaugaguaaaaaccaaacagguggguaauguaauacccagugaugcacagaggucccagccuugacagaggcagcuaggggaucucucagggaaaugcacugaggucuuuucagggaaaagggaggaagcuaccucagcccuccugucaggccagcaggaaagccccacuacccagucacucuccugacccaguuuccuggcuauucagaugacacagauaccucuuuccaucuguaggaaugcugauguuacauauagagagggacugugacucuaccccucauguaagccugaaccuggaagguacuucucuuguggggaugcagucaccccacuguucuagaauggcugucuacaggugcacccacgccaagcuccugugggagcagccccaggugugucugcaauggugggugaaggagagaaguccccuccuccaagacccuucaggagcaccagggcugccugacucuuggggcagagcugcagacuuucuccacugagcccagcauuacacccaugccucugcugaaagaaacuucccacagguggaaaugucugggagucaaggccugcugucuucauucuuuugucauucuuuugucccacggguugcucccuugauguggagcacucccucuuuccccuaggaggaggaaucccugagggccagacuauugugaaugcugcugcuccacucagucuagcaacccauuuggacugccacaguccaggcuggugcagggggaaugucugcaagggauccagugaugugaccuguccugaagucucacagcagugggugccagcaccagcucugagggggguugcagaggagugauguagacucugugauauuccuugguuauaaauagccuuaguguguuggcuuucucacaugccauguguaauaguaacgaacaggucacgugggcagacucagggccuccugguuagccagggugaugcagguaauggugacggccaaggucacacaaguuuuccccuuccuggugugguguuauucuccuugcagaugcuaucauggagugagucaguuggccuccagcuagaagguggcacuuggaaaagggcacuggcuguggugguacuggugggauuuaugcuuugccuuauguuacccaggggagguacucuggugucccaagcaaugggaggggccauagagcucccaaaaguuucuguuuuuuuuuuuuuuuuuuuuuuguguguguguguguguguguguguguguguguguuaagcuaccaggaggagugaaggggcaaaaccaggagggaggugggucaggcaaguccaugcucuggcucuccacaggcagacgcaagcagcagcccuagugggauuggaggacaguuugcuggcugcugggguaguguuccaaggaggagcacagcugccucugcugcacagaagagugcaaaugagggggguguagccagcagcaguaagacccaccuagcuucccugcacuuggcaaggcaggucucacaucugcagcauuccacuaacagcaacagcuagcaaaguuccagccagucugcacugaaacucaaaacugccccagaucauaagccuucccaguggagauggaaacugcagggcuuucaggccaugcccauccucaucugcccaugaagcaggggcacccagcuccuaugcccacucaaguuuauaucaugaauuucaguugggagcaucucuuaaccugcgacccgugccugaguuaauuggcugaccuccacaaggucuccugugagacaggaucaggaaugacuucccuucaucccucuggagacugggagugcacacacagcacaucccgaugugguuccuucucaucuacuccccauugcucacuacaccagcuccggagcuggguaggguuaaggccuuuucccugaccuggauugccagguuccccgguggguguguaugugcuguaggcaguuucucccuuuuucacacucuggggacuuacaauuuuuggccuggcucaugauauacacugcagccugcugcuucuuucaaagggucuguggugucugucaguuuucuuguuaaguuccuguguugcuucuuggaaauaaguucacaguaugaaucuuuacacacuauuucgucuuuccaaguggaagaagcaugcuaacaaugcuuccaauucaacaucuagggaaaaaaaaaguuuuauucaguuuauaugcuagaucuacaauauuucaacuugauuauuuauuuauuuauggaacagagucuugcucugcugcccaggcuggagugcgauggugcaaucuuggcucacuacaaccuccaucucccagguucaagugaugcucaugccucagccucccauguagcuggaaauacaggcacgugccaccaugcccagcuaauuuuuguauuuuuaguagagacaagguuucgccauauuggcugggcugcucucgaacuccuggccucaagugauccacccuccucggccuuccaaagugcuaggguuacaggcgugagccacugcaccuggccccaacuugauuauauuuaaaugcacauccuaaaguauuuucaacugucaaauucuccagcuuuuaaacauuuauuccuuuuuuuuccugaauuuucacaucuuucuucuaaucuucaguuacuuaaacccuuccucuuuucagacuccauuaaucccuucuaccuaguuuggagcccaucauaagauacuucagcagugucaagagcuugaauuuccuuuccccuuuuaacuucuucuauuucccagucucugacauuccaauguccauacucucucuaucccuugucuuuaaucuuggauucugccuaguguugcacuagaaagugaaaaaugguaacauugauccugcuauaauuugauacuuucuacuuaaaauuggcauugugauuugcaaugauuuucuauuauauucaccaccuugucuauuuuauuuuauuuuuuaauuauuuauuauuuagauuucauguuuauuuuauuuaacuuuuacuuucaguucaggguacauguacagguuuguuauauagguaaacuagugucauggggguuuguugcacagauuauuucaucacucaggcauucagccuaguacccuauaguuauuuuuccugauccucucccuccucccaucuuccauccucugauaggccccaguguuuguuggucuccucuauguauccaaguguucucaucauuuagcucccacuuauaagugaagacaugugguauuugguuuucuguuccugcauuaguuuucucaggauaauggccuccagcuucaucccuguuccugcaaagaacauggucucguucuuuuucauggcugcauaguauuccaugguguauauguaccacaguuuuucaauccagucuuaucauugaugggcauuuaaguugauuccauguuguugcuauugugcauaguacuacaaugaacauacauaugcaugugucuuuauaauagaaugauuuauauuccuuuggguauauacccaguaaugggauugcugggucaaaugguauuuauguuuuuaggucuuugaggagucgccacacugucuucucaauagaugaacuaauuuacacuccaaccaacaguguaaaaguguuccuuuuucuccucaaccuugucagcaucuguuauauuuugacuuuuuacuaauagccauucugacuggugugagaugguaucucauugugguuuugauuugcauuucucuaaugaucagugauguugaagguuuuuuuuuaauaugcuugucagcugcauauaugucuucuuuugaaaagugucuguucauguccuuugcccacuuuuuaugguguuuguuuuuuccuuauaaauuuguuuacauuccuuauagaugcucaauauuagaccuuugucagaugcauaguuugcaacaauuuuuucccauucuguauguuuacucuguugauaguuucuuuugcugugcagaagcucuuuagcuuaauuagaucccauuuaucaaauuuuugccuuuguugcaguugcuuuuggugucuucaucaugaaauuuuugcccauuccuauguguagaaugguauugccucaguugucuuucaggguuuuuuuuuuuauaguuuuggguuuuacauuuaaguauuuaauccauuuugaguuuauuuuucuauaugauauaaggaagagguccaguuucaauguuuugcauauggcuagccaguuacccagcaacguuuauugaauagggaaucauuuccccauugcuuauuuuugucagcuuugucaaagaucauauaguuguagccauacagccuuauuucugaguucucuguucuguuccauuggucuaugugucuauuuuuauaccaguaccgugcuguuuugguuacuauagaccuguaguauagucugaagucagguaucaugaugccuccagcuuuauucuuuuugcuuaggauugccuuggcuauugugcucuuuuuugguuucauaugaauuuuaaaauaguuuucucuaguucugugaagaacauuauugguaguuuaauaggaauagcauugaauuuauaaguuacuuugggcaguauggucauuuuaaugauauugaucccuccuauccacgagcauggaauguuuuucuauugguuuguguugucucugauuuuuuugggcaguguuuuauaguucuccuuguagagaucuuucccuucccugauuagcuauacucguaaguaauuuauuuuuuuguggcaguugugaaugggauuguguuccugcuuuggcucuuggcuugacuguuguugauguguaggaaugcuagugauuuuugcacauugauuuuuuuuauccugagacgcugcugaaguuguuuauuagcuuaaggagcuuuugggcugagacuauaaaguuuucuggauauagaaucuugucaccugcaaacagauauaguuugacuucuccucuuucuauuugguagcccuuuauuucuuucucuuuccugauugcccugggcaggacuuccaauauuguguugaaggaguggugagagagggcauccuugucuugugccaguuuucaaggggaaugcuuccagcuuuugcccauucaguauguuguuggcugugggguguuguagaugguucuuaguauuuagagguauguuccuucaguaucuaguucguugagaauuuuuaaccuaagggguguugaauuuuguugaaagccuuuucugcauguauugagauaaucaugugguuuuugucuuguucuguuuaugugaagaaucacauuuauugauuuguauauguugaaccaaccuugcauccuagggauaaagccuacuugauugugguggauuagcuuuuucaugugcugcuggauucgguuugccaguguuuuguugaggauuuuugaauugauguucaucaaggauauuagccugaaguuuuuuugguggugguuguguuucuggcagguuuugguaucaggaugaugcuggccucaaauaaugaguuagggaggaguucuuccuccucaauuuuguggaacaguuucauuaggaaugguaucaacucuucuuuguacaucugguagaauucagcuaugaauccaucugguccugggcuuuuuuuugggugguaagcuauuuauuacugacucaauuucagagcucauuauugggcuguucagggauucaaucuuuucuugguucaguccugggagaauguauguguccaggaauuuauccauuucuucuagauuuucuaguuuaugugcauagagguguucauaauauucucugaugguuguauuuuuguggggucaguggugauaucccucuugucauuucugauugcauuuauuugagucuucucucuuuucuucuuuauuagucuugcuagcagucuaucuauuuuauuucauuuuuuuucaaaaacccagcuccuggauaaguugaucuuuugaaugguuuuuuugugucucagucuccuacaguucugcucugauaucaccaugccuauuuuaaaagauuuugauccuuuuuaguccccaaauucucucucugcagguggccuuuuuuuuuuuuuugagagugaggcuaucugauugauacucuuuaugcuacuuggaguauuuaauaugcauugguucuguauuucacauuaugcuuuuauugcgcuaaaguugauauuaaaguuuuauagcauaaaaugucauggcagggaacauuugcucuaauuuaucauaauuuuuuaaaaagaaaaugucugcuaagaucauaauaacagcuaauauuuauaugcuagaucuacccuaaguguuuuacagguauuaacuucuuugaccaugguguggccauuggaacaauguaauaauauguggcucaauaccauagguuaauaucuuaaacguuauuuuucauucucuuuggauagccaugauuaaacuuuuuuuuuuuuuuugagacagagucucacuguguugccagggcuggagugcaguggcaugaucucagcucauugcaaccuccgccuccuggguucaagcgauucuccugccucagccucccaaguagcugggauuacaggcacccgccauuacgcccagcuaauuuuuuguauuuuuaguagagacgggguuucaccguguuggccaggcugcucuugaacuccugaccuugugauucacccgccucagccucccaaagugcugggauuacaggcgugagccacugcgcucagccuaaacuuuuuauaugcuaaaauccaacaugcuacaucuccuuuagcaucuaaaacaauacauacaaugauaaauuucacuucaaucuguacaagagaagaaugcuaaugauuugaaacgucagcuagaagacaggcugucaggaacuuuuauuauauuuuuuacucacuggaaaaauaugaauuggaaauacacuaauaaguucucugcuguggauaacauggguuuaaauuuucauguuaaacuuauuuaauuugagauugucuuaauuaaauauccauuuaucagcauaaugauguuuaauauagaucuuuauuaacaugguuucaaaggccaguaaaauugucaaaucuaaugaaaacagaguucaaagauaaaauucuaucuucccuuucuuuuaugagucuauuaaaaauucagggcaccuuuuuaaaagcccguagagaagauuaaccuuuaacaucaucauuuaaaucuaauguuaccacauuuuacagugucauugacacuauguuuagccuuagauaguugcuuuuccuaaccauauugugaaacuacuaaauuuuuuuuuuuuccaaaucuaauagaggaacugcucucuuuuuuuucugguuucucuaguguagcacauucuaauagaacuuucuccaaugauagaaauuaucuauaucuacacugguuaauacaauugcugcuagccauauguggccuaaugagcacuugaaaugugaccagugcaacugauaaucugaauuucaaaauuuacucauuuuauuuauccuaaauuaaaauuuaaauagccacaugcugcugaugucuacuguauuggaaucacggcuuugguguucuuuucagcaccgucagacugaauucugaagacuugacucuuuucuccuaauaugucuuaauuccuuuccugggaguaggaacaaucuuuuaaaguuacuuguuguucuuggacuaauaaagguauuuucuuucauuauaacccaauuuauaguuuggagauuuuaccauaaaccaaaauauauauauauacuuuuguaguaagaauaccaaauuggacauuugauucuggguagucauuacacaacagaggaugggauaucugccagagugggugcuccguaaauguuuacuugugcugaguaaaugaaaaacuguauuuuauuuuaaccaaugcuccuucucacacuuacucacacuauuuccuuuuauaucuguacacugggagaaggaauaauaacuugcuugaagauacaguuuguuugaaaguuggaggcuuuugcugauuuaaaacagauacugguuuguaguuacuuccauaauuccuuucuacugugcuuaaaugaugaaguaccauuuuuaugggucuuuaccuucuaacauguuuuugcauuacauuuuuuaagaauaacuggucacuuaaaaauacuuauagaguuguaaaaaaugauucaauuuuaaaaggaguaacuugcguaaaagauauucuguaguagacaucauccuagguugauaauacagucaauaaaaguguuuauugcuuuguacauaucaaaguacuaaaggagugaacugaagcagcugagauguuagaauaagucaauugucuaaaaauaugaaugcccacagauauguuugauaaagaaauguuuuaugugaagauuuugaaaaucugguugaucacuaguuaucaauagucuuagagaaauuuaaguuuuaaaaugcuuauaggauaauugagaaaguaccacuaagcugaacgcaaauuuaaaguuucuucuuacaaagcauucgaccuguugcccaagaaaaggcuuucaucuuucaagaugaaagaauuaaaaugaaacuagaacacugaaggcugcuacagaagcaugcauuuauuugagcauaugguaguaauccacuaaacacauaguuauaaucuauuugagaauaaccagaacagauuugccagacaaagauucuggcagaucaacuugcuuuuuacuaugaaaaaucaaagaugcagagaagcacacauauaccaauguuuucuuuuugauuucaaagccacuucagcauuucuuuuaaaaaguauugucuucauccucauaauuaauagauaguuuuucagauucuaaauacuguaaguuucaguaaucaguuucauuauuucugugcagucaaagaagacugcauuggaaaauauguuugugugcauuucaauacaauaaguguuugcaacucaauuucaaaggaauauaaugugugauuuaguuauugauuauugaguuaaacuacagacguugaagaugcaggaucaaaucaucugaaauaaaagggcagggaacacguauaaauguuuugcacacggagacacucaagugcuucuugauugaggacaucugauuucuagcugguuuugcaauuaaaaauauuggaaagaaauugcaguagcucagucaaauuuauuugcugcaaaauggcuuagaacuacagagaauuuucaguuaauauaauugaaauuauuuaguucugcucugugacaagugaaauuauuaguuaucagggaaagguaauuacauauuuggccuaaaguuaaucaauaugaacacagaaaagcuggagcucaagcagaaucaggaccuuguuaaccacaguuuuguaaaaugaguucaauuguagcaccuguggaauaaauagaacugaucauaaauacaagaaaauaaauuuucuaaucauacuguucucagagauuuacaaaaugcuuugaacuucguucuguauuuaaacuuuuuuuauuauuucacacagcguuuuuuaaucagcauaugcugaugaaaggcagacgugugccuuguuacaccucuaaaccucaaagaucaugggcagucacaguaauuccauuuccccaaguuaaggcauaagcccgcauucacagucugcccucugggaugaugcaggauugagucaagcccaguucgauuccuugagucgcuggaguuguuucugacugauccauauuuucaaauccagcccaccagugggccugaggcuggauaagugggcuuucaccagggcccuaacaagagcaaaaaaggaacaugugcauagauuuauacuccuauucucaagggccuuugcucuuauuggaaccuuaaccauaucaaaauguauuuccuaaacauaucugugauuauggaguucauaaucuaagaaucugaaggugcauuucuguguuaaaugcagaaauuauuauugaaacaaagaccucaccuuuaaaugagaguauaaaguacugcagugacuuucgcccaacuguucucuauucacacuggucauuugucacuagacauuggucaaccuuaagccaaauaguauccugucgaagcaaugccugauuauuuuccaacuuuuugaaguaaacauugcuauuguucugcuuuuugguuacaacagaaggaguuuuugguuacaagagaaaguaacacaucaguaauuuccauuccuaaaaaaguuaaucaagaccaggcgcgguggcucacaccuguaaucccagcacuuugggagucccuggccgguggaucaugaggucaggaguuucagaccaggcugaacaacauggugaaaucccgucucuacuaaaaauacgaaaauuaaccgggcaugguggcacaugccuguaauuccagcuguauucaggaggcugaggcagcagaauaguuugaacccaggaggcagaggucgcagugagccgagauugcgccacugcacuccagccugggugacagagcaauacucugucucaaaaaaaaaaauaauaauaauaauuagucagugguuuuuuuuuuuuuuuuuuuuuuuuuuuggaaagaaaaauacuaugagucuguuguaaauccuuaaauggcguaaaaauagcuaaaauuagguauuuacugugcucuuagugguuauuuuccucucucucucuccauguauagagauaaaaugagaaaaaaauauauuuggaugugcguauauacuauacauaaacuaucaaaacuugguuuauaauuguacauucuaucacggacauccuucuugaaagccuucguuuuguauaggucuguguuuuaaauuuugauaguuauuaccaauaaauccucugaauauuauagccuauucaaaauagcuguuucuuacaggaaauggauauauguguguauacauauguauaaauauauauacuuauguaauauauguauuguauauauguauaucauacauauauauguauauauaguauauuauaaauacauauauauauguauuuacaaggagucagucucuuuuguggaaguaaacauuacuuggucagauaagauuauuaugcuaaaggaagguagauaauuuugugaauguaauuugcauuucuaaaugugguuauuauuauuauuauuaucucucaacagggcccauuuggaggccagcgcugagaaguggaacagguugcugauguccuuagaagaacugaucaaauggcugaauaugaaagaugaagagcuuaagaaacaaaugccuauuggaggagauguuccagccuuacagcuccaguaugaccauuguaagguaaguggauaaccuauagugagucgcuuaauucaaauucuagugagguagauauuugaaauacaauuauagauaaguaucagaguugaaccaauuaucacaggauucccccccccaccaccgucugcuuuuaguugccaguagacauuuaaagugcauacauuguuuccauuuguauuaucuucacauuuaacuaaauuuuuuucaaacacuaccaguaucugaaguauaauauugcuuuuagcuuauuaugaaguuuaucuaaauuucuaauagguuuuagaaucauaauauauugagguuuuggguuuuuuuuguuuuuuguuuguuuguuuguuuguuuuaccaaguuucacucuuguugcccaggcuggaguacaauggcaugaucucggcucacugcagccucugcuuccuggguucaagcgauucuccugccucagucucccaaguagcugggacuacaggugccugccaucacacccaacuaacuuuguuuuuuuuuuuuaagauggagucuugcucugucacccagguuggagugcaguggcaugaucacagcucacugcaaccucugccucccagguucaagugauucuccugccucagccucccaaguagcugggacuacaggcaccugcaaccacccccagcuaauuuuguauuuuguauuuuuuuuuuuagauggagucucgcucuguugcccaggcuggagugcaguggcaugaucucagcucacugcaaccuucaccuccuggguccaagagauucuccugccucagccucccaaguagcugggacuacaggcgcaugccaccaugcccggcuaauuuuuguauuuuuacuagagacgggauuucaccauguuggucaggcuggucucgaacuccugaccucaggugaucugucuuccucggccucccaaagugcugggauuacaggcaugagccaccuuacccgaccugagaaaauuuuuaaacuacaaauuaaucuuaaauucaaaaggcaucgagucauaaggaauuacaaacuaucuuguuuguguuuaauaaaagugaaaaauaaggacuuguaguaaaaaaaaaaaaaaguaaugcagaugaagaccauacuauuuaaaaucauuuuauguguuuuacuuuucugagccaagccuuuucuuugauuacauuuuuauacugcucaaauuucuguuccuaugcaaauguauacuuuuacucugaucagccaaaagauaugcugaaauguuaucaacugacacauuaauccuuagauccuugugugauuaaauuugugccuuguucacuuuccauugauuucuuuaauaucucuuuaugcccauuuucuuguauauacauaucaucuuauuuuauuguauuuuucacuccucccauguaaugaaaguucucauucuaaaucuggucauuuuaaggugacacuaugauucuauuuccauuuuaaaaaugacaaacacgaaugcacacaucuccuaaaggaaaaugucauuuauguaauaaguugcuuuaauacaaaaugauaagacccugaaauuuauuuauuugcuuuuugaacccuugugacuagauuaucaaaauuaccauuuggguguauuuuuuuucuuucuacucgaagcaggaauaugauagagaaauagcuccaagauaagaaaaaggaaaacacuguugauguaugauaugcaagauaauaauaauaauagaagauuuaaaaugaccgauuuaagaaaauccuauucucuccuaacuuuuucuaacuuuuacuucuauuaauuauucauacaguagucccuuuuuguggguuacaguauuagggaugaaacagaauaacacaaagcucuucuaauagaugugcucuguaaggaauacaagcugcuuauggccauaugcuaauaguguuuaccgaaauccacaucuugagguaugaaaugauuuuccucuucuggccuuagcacauaaaguauguaucagccucucagucuguccuggcuguauuuuggccucccucccagcaagguaaccuggauuuagguuguguuuugcucuaucuuagagcacugcaggcaguugcucugcuucaguccuugagaccuaagccuuuagguaaugaagauaauacugauaaugaugguaauacaauugguucauuuauucagcaaguauuuauugagugccuaauaugaaccagcauauucuggucacuggugacucaauaaugaacaaaaccagguucuuaccugauugugagagauggacacuagacaaauaggcaauaaauauauauguccuacgguaauaacaaaaauaaagcaaggucaagaagauacaggaggaugugggauuauaggccaaggugcuauuuuauauggagaaggucaggaaaguaucacaaauugggugauuuuugaacagagaccuggagugauguaguaagcacuuagcaaccccucuugaaaguagaacauuuagggaaaggaggcagagagcacaaaggccacagagccugcaauguuuggggcauauuugaggaauagcugggagaccaauauguuugaaaaaauuuagccaaauaugguagauaggagaugaagcugggguggcgggugggagaaagggauucagaucauuuagguccuugaauauucuuucuuaaggacuuuggauuuuacucaaugagagaggaagccauggaagauguagguaucuauagugcugugaucuaauauuauguaauaauauagguaaauuaugaagaguagaauauagaggaguucagcacuauuucaguaacccaagugguggugaauuggaaaaggguauagcaggagagaugaugaagaguaacugcuuucugaagacauuuggaaagaaucaacaaaauuugcugauggauuagauguguggaaugagagaagaagagccaaagaugucagaagucaaagauuuuuggacaaagcaaauagaaaauggaaguaccuuuuagagagauaagaaaacugcuggaggagcagucugggaaggaaauguaagagcucgauguuugacauguuaagcuuauagauguuuaagcuguuggauauauaaaucugaaguuagaagaaagaucaggauuagagaugaguuagaagaaagaucaggauuagagaucaaaauugucagccuguauaucagcccugggauuggaugagaucaccuauagggagagauuguaugugauuguaccaagggaaaaaaaauauucuaagaaaugagcccugaggagccacaacuucagagguugggaaaaugaggaaacugagaaggaagagccagaaggcuagaagaaccaagagagaacagaguccaggaugccaaaggaggaaaguguguuaugaaggagggcgugaucacaaggaucaaauauugcugagagguuaaauaagaugaggacagaaaauuaaucaucucgagaccaucuuguugaccuuggacaagagguguuacaguggcaugauggaguuggaagcaugauuggaguagauucaagagagaauaugaacaaaaguacagaaaaccauuuuaaggacuuuuacaacaaagguaacagaaaaaucagauaguagcugaagaaagaauguagggucaaguagugguuuuauaacucauugcugaguagugaauuaugaaauaauauauuaauauuauuuuauuauucagcauguucuaugcugguaagaaugauucugugaagugggaagaaucagugaugcaggagagaggauaccagcucaaacaguggcaggaugcaauccauugcacaaguggagcagugggucuuaggucugucugacuccaaauauauucaucauccauuuaaaaccuacuuaccgaauaacuuuuauguccuagcaccauucuaagcacuggagauauauccucacauuuuuguuuuuguuuuuacuugagucuguucccucuuuuuugcucuauuaugucaguuuccuagcuuaguuuaugaaagaauaugaagccaccuuuuucacccuaucuuuuucuuuagcugccuuccaaaaauggacaauaaagaaaugaauauuaacauauuauucucaagaacuaauauuuuaguguauaaugcuagcuuucugcuaaauuaguacucgguauagauuagcugaauaaguugauucacagaauuuauacaaaaaacccuccaguuaucugcuuccucuagaacaugacacaguacagaaaggugugcuggguuugggguaagcauucuuuguaggucauugcugaagucacagggcuggaggauuccuugauuccuuccaggguagccaucauguauuaauaaguaaguuaguugccaucauguuugacauuacccuuacagaaaagaaaaacucgagggaagaaauaaaagcuuaaaagaugaauuuucuggcugggcgugguggcucacaccuguaauccuagcacuuugggaggcuaaggcaggcggaucaugaggucaagagaucaagaccuuccuggccaacauggugaaaccccgccccuacuaaaaauacaaaaauuagcuggguguggugacgugcgccuguagucccagcuauuugggaggcugaagcaggagaauugcuggaacccaggaggcagagguugcagugagccaagaucacgccacugcacuccagccuggcgacacagugagacuccaucucaaaaacaaacaaaaaaacccaaaaacaugaauucuucauauuuucuuuauagguugugacauuugcuguugcuuugugaguaaagguuugaaaguccagugucacauuuuuuaaugugagacacaagaucuguaauguagauaaucuacugugaauuguguguggccauggguuuuagggugcacuggaggcagguaaggaggguuguuggcuccucauaggugugauaauuuggguuagaggugugagugagguacugguaguagaaaaggcacugagcuagaaugagaauacuuuuauuuaaaggcuggcucugucacugaugaccugggugacccugaaaaagucauuugacuuacccaagcuucaguguauggaaauaaguaguaucuuaguuccuuugggcugcaguaacaaaauacuauaaacuggguggcuuauaaacaauagaaauuuauuucuuacaguucugaaggcggagaaguucaagaucagugcacuaguagauuuggugucugccaagggcccacugucugguucauggaugaugucaucucacuguguccucccauaguggaagguagucuuuuauaugauacugaucccauugaugacagcuccucacucaugcccuaaucaccuuccaaagacccaccucccaauaccaucacuaugggaguuaggauuucaaccuguaaauuuuggugacacauagacauucaaacuguagcaaguaguuccauuucuacacagaauuguucugacaaucaaaugaaauaguggaaaugaaaguaauuuaggaaaaguaaagugcugaagggcaguauauaauuuuauuuaauuauguauauucugucaaaagcaaccuucuuuaccaauugccaagaguaauguuuuaaaauuacguuacuauaaauauuauauaaaauauauauaauuaacauuaauucauacuaauauaaaucuacauuauuacaguuagggcuaaugauuaugcauuuguagauuuagagcaauauuuaaagaagugugguaccuacccguaauuauuuaucuuacugaacaucaucagucauaauuaucgaauagucuaagcauaguuuaaccuuagccuugcauccaagaauucccuuccuaagaguuuauuuaauaguuuuuggccaguguucgaacauaaaccuaagucucuaacuuauccugagucuuuucuugaaaucaaaaucucuuauggguguguaagagauugcucuauauuucagggcagcuuuuuuuuuuuuuaaguccuugaaaauguccuuuuccucugcugucauauuccauugaucaggaaaagucuuuauuuaguguauauucauguauaauuuagaauugucaauuacuggacugaaagaacccuaagaaauaagaguccaguccucuuauuuacgguagaggaacaugagaggcacaguguaguuuaagcaaaccugaguuuucaucccuccuucccucucuuacuuucauuuacuuacuauaugccuggcaguuuauuuuauuuuuuaaggaaaaauaacuuuauuuugaaaaaaaaucaauucucuauuuaaagcauacaugagacagcaucuuucauuuaguccuaaacuugauuacguauucucauuauaauauuccaaugacauucugcaaauacauuucaaguaugucaucauauacuuauugguaaauaucaaacaaagcuacugacugugagggaaaauuuuccguaauuuuuuuuaccuacccagagauacucaucccacuguauaucugggauuuuuaugaacauuuacaaauuuuaacaaaauucuuuuuuuucccauugcaugcaucaauaugcuaaauucuccacuacaauccagguaaaauacugauagugugugaaaacccaguguauuuucuaauacugcccaugauagacagagugaaauuacagcauaaagaguagccaggaaccuauacuguaaacauuauuuggcuccaaguaucuugcaacaaauagcuacuaauaggacuauacauagcacauagagcacagcaauccuggauuguaguaugccuguaaaacccuuuaaagcauuuuuucucaaccuuuuuaucauuacccuccuuuucaauuacaaaaauuaaauucaaauuaaauuaaauagcuuuaacuauaaauuucuuccuaaugagagaaauuaauacaaaagauuuuguuggguaggcugauuuuggaaggucacaauccauaucuaagauuuuuuucaccccaagaaccaauuuuuguucccaguugagaauguaaggguuaaaguugaugaaauaaauuaaauagccuuuaacauuauuagagagaaaaaaaccuaauggguaacaauggagauugagauaguugacuucuagaccaucucuguuccauacuugcuguaugaucagggaagaaaucaugucucuuuauuuuguuguuugggagaacacaggaauagcauaaaaccuaauagcuuggaaaaaucacuuaaucucacuggacucagugaggcuauuaauugaaagaauugguauagaucaguuguuuucaauucuggcugcacuuuccuaggacauauaaaagauaucaaugcucaguuauauuuacccaggccaauuaagccagucucuggaggauaugggcucaaccuauaguguaaaucagaaucaccugaugggcuuguuaagccacagauugguaggccccacuuucagagcuucugauucagcagguuuuggguggggccugcaaaugugcauuaucaaguucucagguaauguuaugcuauuagucuauugaccacacuuugagaacugcuggacuaggcauuuguguaagagugaaugugugugugugguguguguccccaggugacuucuaaucucaaaacuauucguauagaaaauuucaauaagguucuuuuaaguucuaggauacucagauuuuaauauaauaagaguuguuaaacaucaagauggcuuauaaaaggagaccuauggacaaauaucaacuucuuggucaauuuucauuaaaaacucguuucuuaaagcuuuuuacaguauuuuuuugaaaauuaacuuuuuuuuuuuuuagcugcauauaugggucuucacuucacuuuucaguaaagauaacuuauuugguuaucagugucugaucauuugauaagaccaauggaagguuuggauaguagccaguuauuuuugaauugcuugaagagaaucuuguaaauuuguaguccagagguaauucugcgauugcuucaauacuuggaauugcaauagaguuguaaguacugauucuuuuacaagaccauguauaaaccaagaagucuucuguauuuuccagucccaaaacugaaucgauaaaaaagagugccauuuuuuagauaaaguguuuagaggcuuugccuuuggccucucauauuuuccuuucuucucuagaggcucugacuccucgggccucugacuccucacgccuucauccccucugaguucuucuaggaucuaagacaccagagagguccugguauagaaaaaaacacagucccuguuuacaugaaauuuacauucaagggagauccucugcuuauccuuaaacuuagaguuccuguucucuguguuuugagaaaucauuucccaaaagguuauggcugagcugugaacugcgcauuguuaucccaaaucucagguugucuuugcccagucauccacuucuguaaccccaacuuuucucccuugguguuuuagucugucuuuugcugcuguaacagaaugucagggacugagucauuuauaaggaagagagauuuauuuggcucacacuuuuggaggcugggcucacaguuccagaggcggggaaguucaaaucaagggccuguaucugaugagggucuuccugcugugucauccaaugguggaaagcacaaaggcaagagagcguucaugacagagaggagauggaagcugaacuuauccuuugagcccacuccugcuauaacuaacccacucccacugugauaaugacauuaguccauucaugaaggucaaacccucaugaccuaaucaccgcuuaaaggcugcuccucuuaauaucagcacagugucacuuaaauuucaucuugaguuuuggaggggacauucaaaccauaguacuucguugcaauucgggcaagcuuuuaguucauguacccauuuauuuccaaucucuucuuuaagggaauacagaacucuuuucaauuauaacauuaugauguagcuuuaaacagaacauaaaauaacuuuuaaaaccaauuuuuucagauauguuuuagcuuacugaaauaaaguugcuucucuuuucauuuagucuugucuauuauuauaaauucuguuaguauuuuuucugaucuccuacuuuuuaggucuuuuccuuuuuguaauaaaguuuaaaaaucuuuuuagcuacaaagaacucuugucuuacagcucaaaaguacauaauuagaaucaaucaagaucaacccucagauggcuugauacuaauauuagccaagguuuuuuauucccuaaaaguucccauagaaagaaagggaccuuguacuugauuucuaauucauucucuaaucuuaagguaauaguuugaauuacuuuauuucaagcaacacaauacugauuaauuugacguaaacucucacugcuaauuuaagaugucuaaagaauaucagauggaauuuugugaagagacaaagaacuuaacacuaauuuaauuauuccaaaagguaugaucucauaaaugcaaguuuugaauaccacuauauacaaccuuuauuuagggguugauuuauagaaacucauauauucugagucuucugauuccgaacuaucuuuauauauucuaguccuuuauauguacauaaaugauuuaaugacuccuuuucaaaguuacucuuugauaauaguggugccaaucauuucauuccccauccauccacccaccuauccacacuauucaccaaaugucuuaauguuaaaguugaugcuucuguacgaagagcaauaagguauagccucugcaccucagugauauauuuuaauaauuccuauuacuaaaagcccugugcuugugguuuguuggcuguauccagagggaauacuuuacauuuaaauguuuaggugauggcucugagauuucgccuuagaauagggauauaaagcaaugcuuuaaagcaucuccuauguucaaacaccuagcgguuauagaucaaauauaaaaaacagaaaaccaaacauggcauugugggcuccaaaacaugacaaucauucuacaggccagaaacaaagcagaaaagcaaacuagcuagugauguugaugcugcuggaaaaauguagcagacccuagugaugagcaggcaggaagccccauagcaaagacucagcucaaaacccuucucuuacacacagaaaugagugauucacagauuggcauccuuuccuuccguaguguaaaugccccaggcacugcuauuaugaaacuucaguguauuguugauccuuaauuaaaugugcguacuuucuuggguguuuuaaucagugucucagaacauugauauauuuucagcaacaucaauaauaaauacuuuguucagugcuucaacaauacauaaacauuugagaccuggggccuagcacauaguaaacacucaguaaaagguggcugauaucuuuucccauaauuguugggagucuuuucugauaguuuugaucauuuuuauuuuguuuaaaacuauauaggcuacaugagcaguuuuaacuaaauaaaacuguauuaauaccuguuauuuaccaccuaguauaacccaacagaacuagcuuucaauuacuaucuagauuaacccgucaaauuagacaagggucaccuuauagucuuugcaaguaucaguuugguaaacagcacacucauuauuuuuuucguguaaguacauguuuaauucccucaaauguuaacauaaauugcuacuuaaaaaauauguaguguuuuaaggacuguuuuaaaauaaauggauaggcuaggcacuguggcucauaccuguaaucccagcacuuugggaagccgaggcggguggaucacuugaggccaggaguucuagauuaggcuggccaacauggugaaaccucaucucugcuaaaaauauaaaaauuaggugugguggcgggugccuaucaucucagcuacuuguuggagacugaggcaguagaaucgcuugaacccagggggcggagguugcagugaaccaagaucacaccucugcacuccagccuggcaacagauugagacucccgucucaaaacaaacaaacaaacaaaaaaaaaaaagcagcuuacuaauaaauaauaaaauaaauggguaaaguugaaucuucccaucuaaugacuucaaucgaauuuuuagaaucauuuuugaaguuuugaagaagcugaggucacuuauaugcaacuucccuuucaagaaugugagcuuaucauucagucaacaauuaccuauaaugcaccuacaauguauauaguguuuguaauguuauggauuuacucuaaccaaaugcucuugaguggauaaaauugcagaugcagauuuuacuguacaauuugcacuucauuuucauaacaauguaaauauuaaguuauguaggagcaauuaucagagcucuaauacccuuucuccaauagaaugcauauuugauguuagaaaagcaaaucuagaauaauugaaagugcaugauucagguauaauuucuuguuuguguguucuuucccucagggcuacucuggccuuugcuuaacccaguuuauuuccuauauucaagcuuuauuauauaagacucagaacauaucuggccuuaagcugaauugccaagaaacauuagcaaacuugcucauuaaaauaacaaauucuaacauugucuuuaaaacaacaacacccuacuguuaaauuuaggcugugugugugugugugucugugcacacguaggugugguagaauuuuuuuucccuacuaaaguaaucggagacucugccugaaauucuguaauuuugaggucuuguuguguuagaagguugccuacagugggaaacuugucuuuuucugaaauuaaaaaaaauuauuuuccaaguuccucuccaaccuuugccagucuguguugacuuacuccuuauuaaacgcucagcucuuuaaggcccauuagucaagcuguuacuugugugcaggccugaagcagcaguucugucagugagccugcaccuaccugcaacaccccauuugguugucugcaccuggacuugucuccuaaucauaauauguaauauugcaacuuuaccccaaagggccauagaauguccauguuuagagggagaggugagacagccuaauaggugucacucucuggugguaaaauuaagaguggaucacaaauguaggcaagaaacagaggccuguaaaaccaaugaacccuuuugcaaaacaaucauuuuacugccucugcacauauuuagcccagagauaauuuauuuuaucuagcaguucauauauucacucagguugaaacuucuauauuguaccugauguuugcugcauacuuugcuaggugccaagcaugcaugaguuuguaagacuauuuuugcaaucauggagcucacuucacucucuagcagugaugcaggcuugaaaacaaguacuacaguagauauuaaaagugcuguaauacaggcauggacacacagccaaggagacaugaaucacgauuauuugugcuugggaagauugggaaaggcuccacagagcaagaugcuuuugagcugaaagaugccuuggaauaaguaagaaaucacuaaagguguuaccaaaaugcuuuagggagaaaauccuccaaauuagccauggcauguuuuggaguaugcaguagaguaaggggugcugcuuaccuccuuuugugaugauacuuagaauaagacugaaagaagaaaauacaaguucagcaccuaauccagugccacauuagaauagguacuaauugaggaucccuuagugaaauauuugggaccaaaaguauuuagauuucagauuuuuucauauuuucgaauauuugcauuacacuuaccaggugaccaucccuaaucagaaaaucugaaauucaaaaugcuccuaagagcauuuccuuugaguaacaauauugacacucagaaauguuuggauuuugguguauuuuagauuuuggauuagagauacucaaccuguauugcauauauuagcuggaugaaggaauacauuuaugugugcauguauuuuaaagaguacagggggccgggugcaguggcucaugccuguaaucuuagcacuuugggaggcugaugugaguggaucaccugaggucaggaguucaagaccagccugaccaacauggugaaaccccaucucuacuaaaaaaaaaaaaucaaaaaaaucagcuggguguggugguguauaccuguaaucccagcuacuugggaggcugaggcaggagaaucgcuugaaccugggagguggagguugcagugagccaagaucacagcauuguacuccagccugggcaacaagagcgaaacucugucucaaaaaaaaaaauaaauaaauaaaaagcagggugcaguggcucaugccuguaaucccagcacuuugggaggcugagguggguggaucaccugaggucaggaauucuagaccagccugaccaacauggagaaaccccgucucuacuaaaaauacaaaauuugucaggcauagcggcacaugccuguaaucccagcuacucgggaggcugaggcaggagaaucgcuugaacccgggaggaggagguugcggugagccgagaucgcgccauugcacuccagccugggaaacaagagugaaacucugucucaaaaaaaaaaaaaaaaaaguacagggaaggauacuauuuuauuacuaugaaaagcaaaagaauuucugucucauuuuuaacauugauauuugguauucugauucaggcauuauuuuuuaugucacugggguggaaccaaaaugaauuuuguauauuaacugcucauugagggauguuaaccaaaacuuucaaggcacuauguaggagauuuuuuuuuaaauuuugucugcauaccaacggaaaguaagccuguuuucugucuccuuuuucauguaguuuuauuagugcuaucaaauuuaaugagugcucugcccuuuuuugcugucauucuguaaugacuucagauccauauaugcugauuuagcuuugaaagcaaguugggaaaagaguaaauuacauucuagcagauuugucucauguuugcaucauuuauuuuuuucugcuuauauucuccaguaagcaguuaacugcuuuuuugaaaccaaaagcuaaagaagccugcuguaccagcaauaccucuauuuguuauaauucagcuacccugcauuuagggccagcuucucaggugucccaugcagucacacagggcucugcucuuacaagguuucugcacuuggcuuaauguucuucugcugccaucuugagauucuuaguaauauuuggacaaggggcccuguuacacugaggucugcaaucacauagccagaccugcuugcauugcgaagaacauuaacauauauauucugacacauguaacacaauauugaaugccucuuaaaacuugcuucaagcaucuuuccaucuccuuagguaaggaagccauccugagccccacucugaguuacaugccccuuguuguaauuugugaugucucuguuuguuaguguuggcugagcuuugacuagggguucauuccaagaccucaccuuuccugcugacuuauuaacuguuccucggacucuacuugacuucuagaacaccgcacucuccugauguuuuucuuacgucacugguagcucuuucucaguuucccuuccugguucuuccuucucuccccugucuucuaaaauugggaugugucacuugucaggccaugucaccuucucuguauucacuccuucuuggguuuaaaaaugccaucuauaugccaagcacucccaaagauauauccguuuacaugucaucucuacuugaguguguaauaaacaccucacaguuaauaugaccaaacuggcuuccugaauuggccccuauaacauguucuacccagcguucugcauuucaguugguaggaauauuauuucaguugcuuagguaacaaauaauaaucaccuuuaguccugccuuucucucauuuucagucuguuaggaaauccuguugguucucuguucaaaauauagaaucugaaucuaccaccugugacacuccucugucucuggaaguaucaguccagcaaccagaguguuccuauuaaaauaaaucaaacucuguaggggcuuccuaacuuauucagaggaaaagccacagcucucggaauggucugcaaggcccugccugaucugaccuacccccuacucacaccuugcucauuuccucucuugcuguuuuuucucugacacacugguuucggccacacuggucccuugcugagcuuucagucacagugccagccugucugcucugcccaaaaugccccuucuuuacucaacuucucuacuugaacugcagcucccucugagcacuccuucucucucucucauucucucucucuuccccccccacccuuuucuacuucuuucuuuuucuauagcauuuaucagaaucuaacacaaugacuuauuuucuaugucuuuuuuuuuuuuuugcuugguacucuggaugcucgauaaaaguugaauguugacugaaagagcuauacccaagggaacauguccuuuggugugaauguuccuuuugucucuuuauuucucaguaauucuuuuuuauucauuugcguucuaaagaauauuacauuuugaaaauauuccuacuuuaaauagccaaauguuuaauaaagguaauaacugaaauagaaguguaagcaauaaucuugucucgagagcuagaaaucauuucaguuacaugacauauuugaaauguaagcaaauuaaauaacacaauggcacuuuaugccuugauauuguagucaguucagagguuaucuuuucucuaucuuaauacugccuaaauuuucaacucaagaaugggaaagauuuuuauuuaagggaaaaugaauuggcauaccuuuaauuguugagauagcuuuuaaaauauagcuuuuuuuuuuuuuuagcuguaugugcuggauauugcuagauucuuccaguguuugugcuucucucuguuguaggaauuugauaccuuugaaugcuaguugaguugagauucuuaacaaaugcagggagaagcuuaaacauguggagucucucauucagugacuauguugucaugcauuauauuuuauaaauaaauauagccccaagucauugaagcaaaauauaaagggaaaguuuuauaauuguuacaaauacaaaaaaugggcuucuaaacacauuuguaauucuucauaaugcuguucuuugaaagcaguaauuuauucaaugcuaaaugagcucaauucuagugggcauuccuuucuuaaaaguauaauuuuuaauuaugaaaauaauaacauauuacagaguuuaugaaauaaagaauaaaaacauggccauaauuuuaucaccauaacaacccuuuucauuuugcauuauuuccuuuuugcauauuuaccuuuugcauaguuuuacuugggugcagaguuuuuaugucaucuuuuucacuuagauacaugucaugccuauuucuucacauugcuauguggucauuaucacaauaacuuuucaagguugcauaauggccucuauuguggccauaucauagaaccuaaauauauuccagguguuggagauuuaaguuucuuucaauuuuuuaaaaaucauaaauaauguuauaaugaacacuuuuguguucguagcuuuucuggaucauuuucuuaggauauauucccaaaagugaaauuccuguuucacacaauaugaccauaguaaugacuuuugauauauugccagccuacuuucccaaaugaucaaaccaauuuuuugccuccagcaaugugugaaagugaagcuuuaccauacccuggccugugauuucucauuuuuguucuauuauuagugauccuuguauuguuagcaguaaaauacuaguacuucauagauguauagaaauuuagaaaacaguuuuggaauaucagacaccugagucaagguucucuccacaaagaggaagaggagaacugguuugauguuuggguuagucaugccuagaaggauaggagaaaagcucuccauggcuuguuaaacacauuaguugaagaaauuuauauuugucugaaauuagugugugugaugucaucuagcugaccauuuauaccuccuuagagaauuguuuugcccuuuuauucuggaagaaaccgguucacaaaaaaaccgcugcauuuauuucuuugcuuucuaagaaucuaaacugauaugagucuugcaacacaguuuucugcuuaugaaauauuuuggcuuuaucuuggagaaucacauaauuccauuuuuuucuuuuucuuuuucuuuucuuuuuucuuuuuuuuuuuuuuuuuuugagacagagucucgcccaguugcccaggcuggacugcaauggcucgaucucggcucacugcaaccuccgccucccggguccaaaugacucuccugccucagccucccaaguagcugggauuacaggugccugccaccacacccagcuaauuuuuguauuuuuaguagagacggggauuucaccauguugaucaggcuggucucgaacuccugaccucaugauccacccgccucagccucccaaagugcugguacuacaggcaugagccacugugcccagccugagccacugcaccuggcccauuuuuuucauaauuaaauaauuuaucccuuagaagaguuaagucaucuacuuucagauguuccugcaaacggagggcuuuguucuggcauuggucaaccaaagcucuagguaaaauggcuagaaccuuccucuacaaguaagagugaauagaggcuuuggaaagaaauucagucugagacaagagcugagaaacaugguagaauuuuagauuagcaugauuuuaauaguaaugggcugggaguggugcucacaccuguaaucccaguacuuugggaggaaaagucaggaggaucacuugaggccaggaguucaagacuggccuggucaacauagcaagacucugucccuauuuaaaaaaaaauuaauuagccugguaugguggcaugcaacuguaguuuagcuacuuaagaggcugaggcagaaagaucacuugagcccggaaguucaaggcugcagugagcuuugaugguguaccagcuugggcaacagagugagacccugucucuuaaaaaaaguaauuuuuuauucuacagcacugaauaguuucaaaauaucuuuucauucacugucucaccagugaaguuaguaaaaugagagagaugauuaacacgcagagaauuuaagggacaaacccaaguaagggcccaugagcacaggaugaguaagggugugccugugugguauggacuggacuguaccuaaggcuuuggcugcaaaucuuugucugguuuuacuuuaccacagaacaguauuuuuaacaucuccuccuucauucauacaaaaauuuauuggcuuuccgcuauaccugcucuggcacaaauuucagccuuccaugagggcucagucuggcaccagagucagguuugcaaagaggccauggugagggaguguggugaaugcuggauccccgugagggaaggcugcagcucaugcugguggugcagguggcacuggagccggaucccugaagggucaaaaggggugagcccuguggauuucuuugacuuucaccagugagggucaaugagauuguuaagaaagcaaaacaacacagauguugucuugagauaauaaugucuucuaugggggcuggaaggggaagacuacuuccuucuacugcagaguugcuccaugcugcuuucuuccacagaccuacuuuguaugaaaugcucccauuucucagguguuuuccuuccuugauccccuucuaacaauggccuccugagguuccacauuuucuuuuaugccaguuuauucauuuucucauucauuaauccaaaagauauacugagugcuagaaucuaaugagaaagagcagagcuauugaaaauuugaagcaaggccaggcucaguggcucaugccugugaucauagcacuuugggaggccgaggaaggcggaucaccugaggucaggaauucgagaccagccugaccauggagaaaccccaucucuacuaaaaauauaaaaaauuaucugggcguggugacaccugccuguaaucccagcuacucaggaggcuaaggcaggagaaucgcuugaacccaggaggcggagguuguggugagccgaaauggcgccauugcacucaacgcugggcaacaagaacgaaacuccaucucaaaaacagaaagaaagaaagaaaauuugaagcaaaagccuucugaauugcaaagaccaugaggaggaaauagcuuggcauguucucggaacagaaauaaggacuuugaagcuagaaaugaggguguauuaggagaugacaucagacagcagggaggguccagaccuugguaggaaguuuagaauuuauucuaagugcaacaggaagccaugggaggaggguuuuaaacagaagacaggaucugauuuaucuaucauuuuaauuuuguaauuuagaaaauuuuaagaaaagugcauguuagcaaaguuuggugcuugauacacggacaauuuggauaauggcuuuagauugaagaaagguuaggaaagaguugcuauuuaaagaaggggggugaccccaggauuuauuucacacccacauguuugcuuuucucuguucuuagcucaguccauaugaccaacugcuaguuuaggagagaaggguuuagcagggauuccccucuucccuccaauucucuuagacccuguuuucuuauuaaaagauuugcaggaucccaucucggucagugaugucagcaacccagccauuauggugagcugaugccaugcucaugaagaaaaugaagaucagcugauugacuuccaaguauuucugcccuaagccacgccaaucacuucuuuauaccgucuuaucuuuuaaucucuugucuuucucacuaaguuguagcaggugggagaaauguuccaagaccauuaaaggaggauaauugggaaucucuguauagacauuuaaaguugaauaagcagcaguuuauucggcugccuggugcucagaggcacaccaguagcauccaaagagcacccugaguucgaaggagucggagaggugggacaggaggaagggugucuucaauaaagugaauucaggcucuuagacauucuguugagaauggaaacugugauuuuuaguagcuacauucugauauuuacaaucaggucuucauuaaucugccauuucacggcuucauuuaguuuaaguaaguauguggaagguacacaaucggacaagccaugagagacuacauuaccuucaauguguuuauucuaucuguuuucuugaguugcuuuccaccuuauuaccucuaagcuaguuacaauuuuuuuucaacacacagcucauguguguuugagaagguugaccucccucccuccucuguguauuuauucauaaugaggcuccuugguaccccguguguaccucuuucagagauuuguggcacuuaaccacguucugggcuaguauuguucucucuuccccuuuauacuauaaguuucucaaagauugaguuuauagcugauuuuugccuucucuuaugccuaacguauuuuuauauauuguauauauuuguacuuuaaaauuuuuauuuugguggaaaucuuuguugaaaaaucuauuauauacuuuaaugccaccuaaggaugggagaaaauuugaauguuuucuuuuggacacaagauaaucauugugcucuccaguuguuauuuuugacucuugagguauuugggauuauaucuccuucuacuaaacaccucagagcaugcgacuucuaaaacaugauuucaguauucccuuuguugcuguuguuguuguuuugagacagugucuugcuccgucgccuaggcuggaaugcaguggcaccaucauagcucacuguagccucaaacuccuggagccaagcaguccugccucagccuccugagcagcugagacuauaggugcaugccacaaugccuggcuaauuuuuguuguuguuauugagacggggucuagcuauguugcccaggcuggugucaaauuucuggccucaagcaauccuccugccuuggccucccaaagugcugggauuacaguuaugagccaccacagccagccucaguuuuccuuuuugaaauuauuuuguaucuuccuacuuauucuaacugaugcuggucuauugcuuggaggccaaaacuucacuuuauacaauuugucugggaggggaauugaaggucuuuucacauaucuacuacaggcugagcauccuuuguguaaaauucuugggaucagaaguguuucaaaauucaguuuuugggauuuuggaauauuuguguauccauaaugagauaucuugugaaugagaaccaaguguaaacaugaaauucauuuguuucagauauaccuuagacacauagccugaagguaauuuuauacaauacuuaaauaauuucaugcacuaaaguuuguauacauuugaaccaucagaaagcaagaguaucagguguggaaucauuucagcacucaaguuucagauuuuggagcauuucagauuugggauuuucagauuagggaugcucaaccuguagaaugcaaaauacauaagcuuugugacagguugucauguaagagcacuuuuagcucaauggccaagccuugagccagcaaguagccagauaucugcugcauagagaaguaugugguugcuaggugucucucccaucaaccacaaggacucuuucccuaacuuccuugauagaaaacauuuuaacagaagcaaucacccucauucuucacucacucagcucugagagcaccaaucucuaagcuaggcaugcacuugccucagagccuuugcacuuuccauuuucucugccuagauugcucuuuugccagauauucucaugccuugcucccucacuucccuccgguuuuuuuuuuuaaauaucgcugucuuucagaugccuucccugaccacuuacacaaaauauuaccaacccucaucuucaacccaccauccucucccacucauccugugugguagauuuuuauaguaaugaaucaugccucccuguguccacacuccuaugcagagggaaauuuuugcucuuuucaucaaaagauaaaguacauuuuuccauucucuugaaucuguucuggcuucaugacaugcuucaaacaauagacugugacaccgugaugugcaaacucuagagcuuugcuguguaacauaggaacccuuagacauauguaaccauuuguauuuaaaucacaauuagauaaaauuuaaaauuuaguuccucagcuguacuagucauauuucagauacuaaauaaacauaugugacuagcagguaccauauuggagagcaauuagagacgacauagggagaaacugagguaccccagacaauaggcagugaugauuuccagacaugugagugaggcuguuuugucccgcccuccccauccaagcugcaggaugacuauaaccucacuaguaaucccaggugguaccagccaaagaacaggucaaauugccaacccacacaaucaugaaaaauaauugucauuguuuuaagcuauaaguuuuauauagguuugauacacagucaugauaauggaaacacccuucaauucuaaugacugacaguaauuuggaaaccaugcccuaagggguuaccucaugggugagaaugucacaaaaugaggaagacagagugaauccauaccauccaugacagucagaucaguuccuuauuuaucuaaaaagagaaaaggauauuugcuauuacuaaaauaaaaaccaacugcagacugaaauacuuauuaauagcacagacuuaguuuuacaucaaaaaauuacuaccagcaauuugcaaaguagauaauuuaaaaauacagaacuaacugaaauccauuauuucaguuuaagaugaacagauugggugacuuuguuauaucuugcucugacauguuuuguaacauuaaauacauaguauuuaauucugagagcauuucucccauaauuuauuaugcucaagcauuuauugagugcuuucuauauaugucuaggcagguacaguagaggauuucagaugauuaagaccugaaccuuaccaugcaagaacucacaauuuaauggaggggacagaugcauggucaaaauauaugcacauuaacacaguacaagcucuguuagaggaauaggaagugcucuagaaacacugaggugggagcagccaucuuguuauugcacauacugaacacacagaaugagcucuuacuuugcauaugcauuggggauaaagacuagaaaagaaacaaauuaggcugggugcaguggcuuacaucuguaaucccagcacuuugggaggccaagguggguggauugcccaagcucaggaguucaaaaccacccugggcaacauggugaaacccuguuucuacaaaaacguauguaaaaaaaaaauuggccaggcaugguggugcaugccuguaaucccagcuacuugggaggcuaaggcggcagaauugcuugagcccgggaggcagagguugcagugagccaagaucaugccacugcacuccagcuugggcgacagagugagacuccaucucaaaaaaaaaaaaaaaaaaaagaaagaaaaaaaagaaacaaauuaccuagagaauuguuuuguguaaaaaacagaauuauuguuuuauuuuaauaauaaccuuguugagauaguauuccuguaucauaauauuuacccauuuaaagugugcaauucaggggcuuuuaguauuuucacagaguugugcaccauuauugcuaucuagauucauaacuuuuuuuuuuuuuuuuuuuuuuuugagauggagucucgcucugucacccagccuggagugcaguggcgcaaucucagcccacugcaaccucugccucccgaguucaagugauucuccugccucagccucccaaguagcugggacuacaggcacccgccaccacgccuggcuaauuuuuauauuuuuaguagagaugggguuucaccauauuggccaggcuggucuugaacuccugaccuugugauccucccgccucagccucccaaagugcugggauuacaggcaugagccacugcgccuggcccauaacuuuuuuauauuccaaaaagaacauccauacccauaagcagucacuccuaucccuccccucccuccccaguuccccagccuuaagcaacgaguaaucuacuuucugccucucuagacuugccuguuugggacauugcaugguaauggaaucuuacacuaugcccuuucaugucuagcuucuuucaaugagcaugauuuuaaaauucuuccauguuauagcacauaucaguauuucauucauuuuuauuacugaauaagaugucauuguauuauggauauaucacauuuuguuuauccauucagcaguugauggauauuuggguuguguccaucuuuuggcuauuaugaauaaggcuacuauaaacauucauguaugaguguuuauguggacauguuuuucuuuuucuucgguauauaccuauguguagaauugcugggucauguugacaacucuguguuuagcauuuugaggacaugccaaacugauuuccagaguggcugugauaugguuuggcucuguguccccacccaaaucucacugaauuguaauaauccccgcaugucaugggagggacccagugggagguaauuaaaucaugggggcagguuuuucccaugcuguuuuugugauagggaauaagucucacaagaucugaugguuuuauaaaggagaguuccccagcacaugcugucuugccucccgccauguaagacgucccuuugcucuuccuucgucuucugcaaugauugugaggccuccccagccauggggaacuaugaguccauugaaucucuuuccuuuguaaauuacccagucucagguauguuuuuacuagcagcgugagaauggacuaauacagguugcaauuuuaccauuccaccaacaagcaucaagguuccuguuucuucacauccucaccaaaaguuguuauuaucuggaacagaacuguuuugaaugaaaauauaaacucauuaaaacagaaaaauuccaauuauauuauguuauaugcauuuaagguggcccauauaucagucacgugauauuagaacuuaaagcugaaugccacuuuguagcucuguguacaaaacagcucauuggagucuaaugaucuuaucauuaauguucaccaggugguugggaaaugcagguuuucuuuuaugucuaauugagagaguuaaagugugaaaugauuauauguauaaaacuguugaaaguuaaaucuauuucugacauacaauuaaauauaauugaaauaggacaaauugaauaacaaaauuaaauuuacaaaacaggauaugaauggaaauuaucauauguaugcugcuuuguaggauauuuggguggugcauuggcaugagggccagagcccuguauuuguacuuacuuggcaugguucccaccugcccaggcuugccuccuguacuucccuacauuggcauaucaaaggaguucgcgagacauucuccagccagcacccugcgcagagaggauuucuuuuucuuuuuuuuuuguuuucugaagcacggaguuuaaugugguuaggaagcaaaauacaaucuaagacucagacuugcuuuuaaugaauccaggagaccugacaaugauacauuauaaaaaacaaaaauaaaaaucugacaauaccccccaacuugucaguggcuucccauagcccaugauuggguugagugagucucagugcauaggaagcagugcaguggucuuuguggccugaccuccgcccacaccuucagcuucagcugcuaccgcucucugaguacugaaguuuuuauaguucccugagggcgcacacugugacacuccugcauucucugcuaguguuuaguuuccuuugcugggaguaccuuucccucucugcaagacucaauuuacgcaccaccucccccaggaagcauuacagaucccccaaggcucuacuaggucccagacauggcauuagucugggugcuuuguuuaccaugcugaacaaaaacagaaaaagucccuggucuaguggagcuuauauuuuaucuaagagagggacuaaacaagaaauauagaaaugucaccucuuuugcauaguagaaggugccaggucuaggaaauacaaagauaguuaagcagaauaaugagaaugggaaauguaggggaugagaaagguggaaugcuacauucaauaagguaggugggugggccucaccuucuagacagccuuaaaaaggaugagggaaucugugauauggcuaaaucuagggaaagagcuuuccaggcagagcaaacagacagccaaagagauuacucuauugugagagucuccauguuaaacaaauaaaauuccauccauaaaggaaguugauagguugguuuuccaaaguauccuuucuauagaccaauauguacauauuuccauuucaauuuuugaaaucuaaaaagaaguuccaagacaaaucucuccuuugcccucuucccuccccacaccccugcacaaugcacauuuuguggacuauuaauagucuagaauuccuaaucagaaauuacuguacaccuaaguugcacagaucauauugucuucuuucuccaacaaaagaucuggauuugccuguaaaauauaugccccguaauaguuuuauauuuccagagggccaguucugccucugcucuuccuucucugagucauuugccuuuaugucccgucuucucucaguuuuuaaucuuuccacauuauugccuauugguguuuucugguugaucuuuugugcuaaauucuaaaugccauugugugaauucuuccuccuauuugauaaaccagagugaagaccuguucuaagaucuucaucuucucuucaguggcuugcauuaaaucuguacauuccuggaacuuccccuuccccaggaagaaaucuagcacaggccuugcacagcauuuuaagaaucuuuaccacuccugagccaggcgugguggcccaugccuauaaucccagcacuuugggaggccaaggcgggcggaucacaaggucaggagaucgagaccauccuggcuaacacagugaaaugccaucucuacuaaaaauacaaaaaaauuagccagacguggugauggggcccuguagucccagcuacucaggaggcugaggcgggagaauggcgugaacccaggagguagaggugaagguuacggugagcugagaucgcaccacugcacuccagccugggcaacacagcgagacucugucucaaaaaacaaaacaaacaaacaaaaaaacccaacaaacuacuccuugcugggugugguggcucacagcuguaaucccagcacuugggaggccaaggcagguggaucaccugaggucuggaguuugagaccagccuggccaaccauggccaacaugguaaaaucccaucucuauuaaaaguagaaaaauuagcugggugcaguggcaggcaccuguaaucccagcuacuugggaggcugaggcaggagaaucacuugaaccugagaggcagagguugcaagugagccaagauuaugccacuucacuccagccugggugacagaguaagacuccaucucaaaaaaaaaaaaaaaaaaggaauguuuacugcucccauauuuacugauuugauuuggauuuuggaaauaucuugaccacuaaaauuaaaaaaaauaauuuugcuauauuaccugcugguuuucacuauuuuuuaaguaacaugauuuuucaugucguuauuauauauuuuuaggugauuauggaaguaaaugcuaggaauauuuuuauuccucuagagcuucuugcucuaacaacauaauaaucuaaguuaaagaacuggcucaagacuuguaaauguguauuuuuuuggauuaaaaaucuuuuuuuuuccauuuuucuuguaucucuuuuuauuuccauauauuaaaacuuuaagugccagauguauauaaucuuuuuuuuuuuuuaauuuccugaaugucacacauccugcgauuucuucacaagcugcguuuguuaaauaggagaugauggaagguuuguuauccccgcccccacccaccaacauagucauuuaaugcucaucagugauaauugcugugugaauuuaguugauuugugcuugcuucgcugucagucuuugguuuuauggaucuaggaaggacauauaaauguaccuuugcauuuuagagaaaguuuuauuuuauccuauauccuguguuacaucacuauaucuuaauuguggauuuuuugguucacuuugcucguucauuuaaauuuuuuaucaaaguaauaauuguauaguuuaaaaaucaaaauaauauuuacaaugcuuacacacaaaaaaauagcauuuuugucacuccgucucucacuaguucuugucagcucuucucaucccuccccaccugugaggguuaagcuacacuuugguuaguccaagcacacuuuccaguaugcuuaccauguuaugacuuaucuccucuauacacgaguaggaaaauuaucaguaauagugguuucuagaguaguacuugaggaggguaacggguggcgugugcaugcuucauggccuuauucaaucaagcacucuacucuugauuuacugcuaaauccuccuugaaucuuuagauuuccuaaaggcuaucaugagauuuucuggauauagaaaauguagcccauuagucucugucagcuucauuaccaggguuuuuuuguguguauguugcuuagauccauauuuuuauauaagauaauuauucugguauuucuagauuuuuucauucuuaccuuuuauugacuauggaagaaaaggaucuagccugcaaauacuguagcaucucaacauagugaugucaaauacuacuaaaaauuuaguugucuucaaaaggaaagauuuuauucauucuaacauauaaugaaaguucaguauuuuagaaaauaaaagucugacuuuucauaauagguugccagggaacuacaccgaaggcaaaauacuagagccaguaggugguuauguguuuaauuuuaagaggauaacaacauuaacaaauuccauuuggcaacagcguuaaaauugcaccugggaaaaucuucauuacucuuaucuugcagcagucacugaaggaguuugguuguuuuuauaggugcaggggugaaaguuuagcuccacuucaaggaacaaaggugcuaaagagaaacuauucugagaaucauagauuugcaugaaaaaccucacaaaagaaaaauaguaauugccucagcaugagagauggaacauauuuuaagauaauuggagacuguuuuauaugugcccucauugguuuauuuuugauuucauguauguacuuuguuucuaucgcuucauuuuuuuuucuuaauguauucuaaauaauguaaaacccuucugaggaucuuauugcuacuugugaaauuaccuuucucuguaucauuggauguaauuuuuuugucagucagucuuacaagaaaaaaguaucuuagcaaaggcuauuauauuuuaucaaucugacaucagugaaaauccuaaaaguacauuuuguguaaauucaaauacacuguaacaauuucccuuaagugaauauuuuaaagcuguuucuuuuuuuguauacuuaacguuuacagaaauuaucuuuuuuccuuuguauuuuucuucauucauaucuauaaaauuuacauuuuggcuucuaacuuagcugaaaugcuugcuauuagucauuuucuugcuaaguguggucagaagugguauaguugaagaugucccauaauuuggugaacacgugagguuacaaacucaacuuuugcuucucuuuugaaaggcccugagacgggaguuaaaggagaaagaauauucuguccugaaugcugucgaccaggcccgaguuuucuuggcugaucagccaauugaggccccugaagagccaagaagaaaccuacaaucaaaaacaggugagacugguuucuccacuacaucauaaaaacacaugcuaggagaacaaaaaacccaaaaucaaguaggaaauuuccuuacagcauuuuaggaucuaauauuuaaaucuuuucuucuaaguguuacuuuauucaaauaugucauuaauucacagauaucuagauucuuaaauuaagaaaauaaaauuuuuguauaccucaauaucaauuuuaaaggaaauuaacugcagaaaaaauagauugucuaaaaaguguacuguaacuauaaaaguaauuucuauaagaaauaaaaauuuauauuauauuuaaacaaguuacaugauaaauaauugcaaguaguagaaaguuauuaaaauauaauaaauauacaaaauauuucaaggucuauaaguaagauuacuuuugauaaugacacaccaaaguccuuucuuuuacaagcagacaacauuucuuuaauuuaaaaauaauacccuguguguuuauuuacuuuggcuuaaaauuuaaauaauaacuaccuuacuagcaaauuuacuagcaaaaaauauauauuucuuauauuuaaacauguuaugugauaaauaauugcaaguagaagacauuuauuaaaauauaauaguaaauauauaaaauauuuaaauaucuauauguaagguuacuuuuaaaaaugagagaccaaauacuuuucuuuuacaagcagacaacauuuguuuaauuuaaaaauaaccuguaacauuuauauacuuuagcuuaaaauugaaauaguaacuacccuacuaacaaauagcaauauaucacauaguaaacuuaagagaaaauguguaaugaauucuggguccaauauauaucuguauugugauuuuucacugcugacaauaaaaucauucugaugcauuuuuaaaaauaaacaugccauucaaaaucguuuuucaucauucacuucacauaguaacagcaaaccugaaagauugccucaugcuguguccagcaguguaaaucaugaacauuuauuacuuguaagggaagcauaguuagaaaaugcuuucuuugacuauaacuggaacuggaucagacauauggacagguagccguuuuccuacugaaucuuacucaaggaaccuucuucaguccgaauaaauuucccaucaagaccauaaucuuuuugacucucugaaacuaguuguauauauguguguguguauauacacacauguacacacacacacagcacacuuaacuugucuagcauuucuuuuuguuuucugcuggugguaacacugucuuuccaguuagccuccuacaaagcuaagucauuguugagucuuccacuuuucaccaaauccaguggucuacaaaucacucauaauuauuauuucuuuucuuuuucuuuuuuuuugagacagagucucacucuaccaccuaggcuggaguguaguggugcgaucucggcucacugcaaucucugccucccagguucaagcaauucucauaccucagcuucccauauagcugggacuacagguguccaccaccacgcccagcuaguuuucauauuuuuaguagagacgagguuuugccauguuggcaaggcuggucuugaacucuuggcgucaggugaucugccugccucagccucccaaagugcugggauuacagacguaagccacuacacucagccuuauauuuguuauuucuaucuuugaagaauuauuccuuuugaguacucuguuuuauauauauauauauauauauauacauauauauauauauauauacacacauauauauauauauacacacauauauauauauacacauauauauauauaaaaaauguauacacacacacguacauacucaugugcacacacauacugccauuaauuccacauucucagccuuuuguguguagacuuagaauaguuuuaggcagaaucuguugcuacuuuugguagcauuggucccauugcauuguucugucaucugugugcaacacguaguauuugcccauauauucucucucuuccacuuuagucuacuacugauaaguaaaucuuaucauguaaucauauucguguuucuccccugauuauacaucuuucuugacuuuccauugcauacugaaaaaaaaucuuggccuccagcaugacauuuauuguuucauuuuaugucauguuauguuauguuauguuauguuauguuauguuauguuauguuauguuauguuauguuauguuauguuauuuugagacaggguuuugcucuguuguccaggcuggaguguaguggugaaaucacggcccacugcacaucaacgucccaggaucaagugaucaauccucccaccucagccuacugaguagcugagacuaccacagacuaucuuuuuuaaaaguuuuuguagagauggaaucucauuguguugccuagguuggucaugaacuccugggcucaagccaucuucccauuuuggucuccaaaagugcugagaauacagccaugagccaccgugcccagccuagcauaauauuuauuuuaaaaaucuuuggaucaucaccuugaaugcaaacaugcagcaauuaggcauauaauugagacuacugauuaaagcacacaaaugugauuucugugcacauauguugcacucugaagauaucauuugcugagcuuagggcuauuuugaauauagcacauuugaucaaauggaacacaauccuuguacauuacugccauuuggaaaacauacugcuuuuggccggacgcgguggcuuacacuuguaaucccaggacuuugggaggccgaggcaggcggaucaugaggucaggagauggagaccauccuggcuaacacggugaaaccccgucucuacuaaaauacaaaaaauuagccaggugugguggugcaugccugcagucccagcuacucaggaggcugaggcaggggaaucgcuugaacccgggaggcagagauugcaguuagcugagauagcaacccagccuggugacagagugaaacuccaucucaaaaaaaaaaaaaaaaaaaacuuuguaauugaagcccuccugauuuuucaacaaauuuuuuacuaccauuuuuauaguuccauaaccaaucuauacuaucuacuuccuugaaugauuuuggaacugucuugucauggaugugcuaccuucccuucuuccaucuuuugaaguucuuucaaaagaacauuuuaaggcuugcuuauguccuucauauacaauauuagaaugguuaagagccuuagagaugaacuaguccaaggcuauucacuuaacagaugagaaaacugagguccaucgaggaaaaaugaacugcucaggucucagcccaguccuguuggauaucuaacauaugcagcuauuguuuguauugauuuucagauguuaaaauuuucuuacuugcccuaaguugaggaauccaguuuugagcauuuuauaaccuaugcaaugccuguauauaucagguacucaauaaaaguuugaugaagaguacaugacuaccugaguaaauaagagguauaaagaaauucauuuauuuauuauucugacuucauauacaaccuauuacaagaacauuuuuaugagcuagaugcuuaacaaugauuccucucucaccccuccccuggccgccaucaccauauuuaacaacaaggaaaaugagcccagaugucucauguaccccguaaauauguauacacuuacuguguacccacaaaaauuuucaaaaaaggaaacaagccgaaacuguagagaauucuuugaaagaguugaacucaucaguacuugcuuuuccucacaaucuugagucuauaaagaauaacuguagaugggagaaacugauauuaucagcaguagaguaauuggauuauugauuuuuaagaugaaauggaaauaaaccccaacuuuucuagaaugagcacucaacauuuacgaaauuccuuuccuauaucugucaagaagccccugcccccucccgucacccugaguccauucuuccaucagucuuugcaucuuaccucaugcuccuccgucuucuggguugcucgggcuaaaauccacugggccgcucuuggcuccuuuguccuuuugucacccaaauccauucugucagcaaguccugucaucacuacauucaaaagguaccuagaauaugauccuuuaucaccacgucuacuaugcuuuccuggucuaagcccccacuaccccuuggaugauugcagguuccuucaacucaucugccugcucugccuuugcucccuuauuagagauuuccaacacaauagcuguaaggaccauuugaauauauaagucaugucaugugacucagagaagucagauucuuauaauggcucacagacuguaugccagggggugccauguuacauuucugaccuggucucuuauuauugucccuuucguuccacucccuguagauguaagcuccuugaagacagaggguuauuuuuuuuucacugcuguauuuuguaauauuuagaauacuaucuggcacauaguaagugcuuauuacauaguguuugaaagaauacgcaugagcugagcacuguccaagauggauaaagaaguauaacgcauguuccugagguuucaauuuagugggagaucaaaacuagcacagagcgugagaaagcaagcaauguaaaaguguccguagucaugcacucaguuguguccugaggauucuaagugaugcgggcauuccaggagagaaggacucugagggucagaguggagagagguugauuccugagcuagucuuagggguauggacagguaggaagugauuaaguucgggaaagaggaauggccaugcuggggacagaauccuuagcagaacagcucagccauaaggaaagagcagcuguauuuuggggagucaguagacagccuggccugguugccagagucuugugccuggacggcagauggggaugagaugguuguaugugcugaaugguucagaggaccuggaaagguccuacagaggaccuggaaagucaggcagaacauuguaacuucauacaacaagaaagaaggugcuaguacaguuuuguuuuuuuaagcuuggggaaaaaaauaagaaguucacuugucucaucuuauccaauuuaaaaucuaccuucagucagcuuuucuugucuccuuucuucccuaggacuuugcgaaguuuauaaaaagcuacuuuaaagcaguacaaaguguuacaucacuaaaacgccacauuauucuggacucuucucaguggucagucauuuaaggguuaaaacgauauuguauaauuuaaaaaaaaguuucaugaacauucuagucaugcgucauucauaguguuggugaggaagucauuugggcacacauguuucaaaucccuaauaaaaugucuagaaagauacacagaaaaaaaaaauacugguuuuugaguucuuauuuuacugugacauucaggauguuuuaagcuccauguuuuuaauacuacauuuggggggacaagaaaaaaagaagucaugucaauuuaacuuuaugguuuuuuuuguuguuguuuguuuaugauuagcaauuuucauacugccuccuuuccugauacuauuuucuauaacaauggcugguuuuacuuguuaaaaauaaaucgaagaaaacuauccauaauagcuuuuauacuuuuguuguuuaccaugacuuauguacaucugcuauuagaaguagcaagcauuugaacauuaguuauccuguuugaugccgaaguacucaauguuggagagguuagaucaggaagaaaucaagugauuuuuuucgguucuauuuaauaagcauuuugugaguaugugauguguaccaugcuauaaggacauaccaagauggagucaccucuuuucuuuuagguaaccauucuagaaaacacuuuccuccaugauuuuuaucuccaaugccuuuuuuucuuccaguuccuuuaaauuuuuuccauuacuaauuaucuuauacuguuguauguauuuuuaaguauuuaaaaaucacuauuaauugaccauuccacauuaguuuccuccauaccaaucuuaugcuaggccuauuucaauauauucuuaauuggcauuucuccauuaacauaaauccuaaaaugauaaaccuaaagcacaaaccuggcaugagguuuccuggagauaaaaacugcccguagugcaugccaugggaucugagcuccuccaccuggcacagaaggcugcacagcaauuuguccucagcuuuuccauccggccccaccuugugccucucuucacuccacucuugagguuugcugggagccaggcuccucacuacauucugcagguaguggucuuccuugccuuugccccauugcccaucccaguuuucugccuguagguccucugaccugauuuccaacgcuugccucauuugcccacgcagcugcuggucauccugccggcucugcuggggcuuugugucuuccuggacgcuuucccuucccgagcucucugccaugauucccuggcacccuguggucucucucacuguguuuuccaaugucugugucugaagcuuggcccuucccucuuuuuuuagugauuacccucauugauggagagucugaaagaguguaaaaaaaugaucugagcagccaggauagagauuguauggaaaacauagugcagauccuuuucuuagaucaugggaaagccacugaaguacuucucagagguauuaacuucugcuguagacacuggugcgacuguaugaacuugauguccggugagugauggguaaguagcaaaaugaagugacaggacagggacaaagauuaaugguaagaaaugacuccagcugucugacagcaaugaggagaaagaaaugauaaaaagauaugcaagaauccuaaaauaaaacaaaacgagguagucuuugggacuuucaacaguaaaagaaaacugaagcugugaauuaugguguguguauuucugaagacagaauauaaaucaguuaagagaaggcauaggaauuuauauuauauuuuaguaaauuuucuuccaaaaugguaaccauaaaaaaauagggcuaaauggguaaaauguagcucuuuggaaaacucaacuacucagauuucugcuuauaaauggcuauuaaguaaauaugauuuuuagcugaacuaaaauuaucugaauccuuguagaaauuuuaccaaguucacaacuuugucaguagucccugacuuuuguuugagcaauauggaaauacuuaauuucauuuaauuuguaucaugucaauguauacuuuuuccuuuuaaugcaauugaacuguuuuuuuuuuuuauuuuaaucccuaguuuguauguguuagaaaguaucacaguacaacaaucucucauccuuugcauuguucuuuguacuuuccaagcaacuuucauauucauucuccugucuaucccaaugaguugagccgaucauacaguaugauuuuuuuuaaaaauaaaaacacaaaggccaagaagauauuauggugcugaccaaagucauccagcuaacgaaagguagaugcaagaacagagcccuaugcgucuaugacaaugacuuccuuaaccucuggauuuuggcuggcuuuugacucaucccuucgauuuuaucuccucuaucuguguucacugacggccaucuggccccuaacuuccuagcuccuccuugaucucaaugucuagagccucuuaaacuugcauccauguuuucuggucucucccuugugcugccagccuccccuggcuguucucaguaccagaucagaauuccugugugaaccacacugcugcacagugaagcugugcaagacaacagccuucacccaccccuacccccaaaccuccagagggaauuagggaauauuugugccuucucuccuguucauuaccuucaguucaguuuaaaagucagaucugcacaggggaguuggagccuucugucggucuuccucucuccauaccacauacagaugcaggcaggcaggcacgcacaugcacaagcaccccccaccaaacauacuuuaugauuuaaagcuaagguaucaaucacuaaauaaaacugcuaacaauuuuauaggcuaucucaccucuaaauguguuuagaaaauuacacaauucauuguauacauauguauggagaaaacaccuguccucuucuugugauauuuuuagauuaaaaaagagauugcauuauuuauccaccaguuuccucaggaaucaucuuuaaaaauuauuccaguuaaagaauuacuguuacuacaacuacuauuuuauuuaagcugccugaauaucauuucuguuucagccuggagcagucaauuuugcuuaauuuaaauauuuuauuaauaaucauagaaaaacccagcuauuacuuaauuuagucuauuugugcauguauaguugaguauaguggguauaguuguguauguguguaugugcauauacaacuuuauauaguuguguaugaauguauaugugaugaauaguuaauaauaauuuuucagaugaaaaaguauguauggguuaauguuuuccucuuugguccuuugacagauggcuauguauauuuaguacauaauaugguauguaauauuuaacucaggguauacuguuuaauuuuuaaauauuuccugauauuuuagaaagccaaguauuaagacuauuuuucuucccuguaaaaucucauauauuuugugauacaacgaagaauuuauaagugacauauucaguccacuaugucaguccacuuuaugccaguauuagcaaacuuaugcaaauacaauuucauaguuauuaaaugagugaagauuugaaauuauuauauaguuuaguagaaguuacuuuuauauucuccauauaacuuaagguuacaacauuauuuucuuguauguaauaaaaugaggacaaauuacacauuaguuaauagaaguaacugggcuaguaaaacuaauggguguuuucucccagggcuuuuguuuuccucacuaacaacuuuauuaauuggagccucauucauuguaaaugacaggcacacagcuucccuaaguguaggcaugaaggggaaggcauuggccuccauaaccgagccacgguagagacguagcugaccacagggacuggaauaccacccagaaggcuuuucuccaugucuucuucucugcuucucuguacagguuuucauuuucuuagcuuuccuaugacuguauagcucacaaccucauaccaggaagggcucacccuucuuuagauccagaauauuccaggagagggcucugguugacuuggcccgaguaacaugggacucagggacugcuaggauuggcagaccuucuucauaauaucaugcuaaauggaggaagaauccaaucccauaaaggaaggggaaagugaaaaaugguaguaaaugcagacauucccaacaagccagaauuucacaggugcugaccaugugccacacacugugccaagaaacuuaccuaccuuguuuaauugcauucucauaauaauuccuugaagggugaauacuuaccacccauucuacagaugaggaaacugagagucugagaggcuuagaggcauacugucuucuaugugacagagccaaaauacaaacuaaggcuuaugucacaaaacuugaugcucuuaacugccauaguguacuaucuuaaacuacuuccguaauaauuaguauuuguagcuauucaauagaaacaacauuuuauuuucauuuucuucgauuuuaaaauaauucacacaguaauugaauauguuuauaacucuuugcuuuuuucuuuauuguugcucuuucuucacugaaauaccacgcugcauaauggaaucauaaacaguucacugauuuccuaacaccgagggagaaggugucuaggcaauauuagacuuugucuuuuuaauuuucauauaaaaauuugaaguauaaguaauugcuuucaggccuauagaccacgacaauaauuucauuagcuucucaaguccaaauuagauuaguaaaguuguaaugcaugaaaaagcgcagaaaaauauaauguuacuuucuuuuccgguguucuuaacuacagagcaguaaugugauuuuucacaaauuaaaguucuauaauaucuguaugaauauaaugcaucuagucuucaacuuuucuaaaauacaacgagccagcugaguaagcccaucgauuggguaaaaauuuggaaaauguuuuucaugcuaacuccuacuguaguaauaaaaucucauuuaaauaaacaauagucuucaugaagaauuauaugauaaagauuuguuugauagacauagcauuuucaauuaauuguuuaccaucuguuauguucucuaaucaguguuacagccauucauaaaucacauuugccucauaaaaagauggcaaucguuuacacguguguauuuuauuauaaucagcaucugagacauuacuuucugauuuaaacauaaaggaccggaggauacaagacucuuugagcgugguauaauguacuuauguuuugugauuguuguuguucuuaguagaaaacuggaaucuuccaagaauuagagguuuugccauuuuuuaagaaguauaauccuagcaaaggcaugaauucuccucuucaauuaaacucaucacuuauuuuggcaguacauaaacauaagccauauuuaacuuauaagaauggcagagcauggguagaaagcuccagacuucucuguagcucgaucaaucacuaggggcuguguuuagcugggaagcagccuggggagagaugggcagucauguggcaagaaauaaaagacuuugaaucuaaaacuccuguccuuugauucuugaaagagaaaggggagaauuuucuucuuuauuuucuuuuucuaguuaaagauauuguacagagauugauuuaugcauuuaacaaguacguuuugagugccuaccauuuacaagggggguguucuagauacucgggauacaguaguaggcaaaacagauguuuuuuuccuccugaaacauucucagcuuuuccucuuuccuuuuauugccaccugccugcccccagugacccaucuguugauguccagcccaaaggaauucacuugaauaaaucgcaaaacugccacuacuuggaggaaauucagggauuauuccugaaugaagaaaauggaaagaucucagguugcuuagcgaggcccugguugucuguuccagggucucuuugcucuuccugcuucuuuccuuggaguugcgucugucuagugguuggccccugcuucuuccuccacucaacucugggcuuauuuacuuuggccacuucacaagaagaguaaaccuugaauguauuuagacuccaguucugccucuauugacuucaggucaguggugccauguagcucccuccaaagcguguuuuguauucugaguuccccuucauuuguguccccucucuuaauaacuugcauuuacuauuuguggaagguagucccuaaaucuguuuacuuuugaggucuugauguucccuaaauauaucuagguucucuuuucuuaaaaaaagaaaaaaaaagaauuugagaaguccacuggcagcauggaugaaucuaugccaucuuuaucauaucuguauugaaagauuuaggcuacauauuaacaggugaaucugcucugaguagccucuuguuauugucauccuuauaauuuauuaaauggacauaauuagaagcacuaaucagccguggcacuugaugauguacuuguaaucuggcucauaaugagugguugucaucaguuauuguacagaguaggaaauggucagggcccucucaaacacugauugaacauuucagaguuauuaaauggaucuuaaucacuuuaucagaaaauuaggaaauaauguauuucccaauauuuuaaucagaaacaucuuuuggucaugaggaaagagagagagaaauaggagggggguaaagagagagagauauugagagagagcaagucaagucuuuuccuuugaguucuuauuggcuaaucaaccugguuugcuuaugugaaaaucucuacagauaucuaagccucccagagcuaguuauaaaauaguaaaaaggaaugaaagaguaaccuuccucaagaaccuacugugugccacacaugugccaguagcuuucuauguauuaacugagguugaaagagauaaggaauauaucuaggauuauguaacuaguuaguauuggaacuggcaugcaaucuccuaaucuuuucuucuaccaaauuguccaacaguaaaaaugccaguugugaauuuuuuucuuuacuugauuguuuuaauauuuccuuuucgucuuuugguagaauaaaacaauaagauuauagauacaugcaaaaaagcaaauaguauaaauaagguauuuggaauuaccauaccugaaaugacuuuguaagguugauccuucuauuucacaauaguuuuuuuguaagugcuuuacacagaugugagaaggaggaagaaaaaugaagugaaaauauguccacuuaaaaguguaaaguugaauguucucaauaaagaggagcacuaaaaauucaauuccguccaacucaauuaaguaauuauauacugaggacauaccaaucucuagacuggcuacuauaaaaucaauauggaaggaaagaaaacauucuugacauugggcuuuaaaacguaaguguagaaaagccacaauggagauuacaaauguugauaucauaauugagaaaaaaacaccauacauaugggaaauguuuauuaaacaauaacacugggcgaauucuaauaaauaucuaucauuauuucaugggagaaacauaguuucauuuuuaaaauuuaaaaaauagcuuugcauaagcacucaaaggaagaguuuuuuuuccucuacuaucaagauuucuuugagauauacagaggcucaaccuucuuacauaauugaauugagguaaaauagacucuugaaauaaaauauuuuucuagcaugagaaaauaggguuugcacuugauaaaauugggcugggcaggucaaguaacuggccuaggggcaaugggcaaaaugggagcaggacugauuccaaauccuagucucuguuccugguccagcuuugguuuuucaccugcauucuagggaaguguauuauagucuucuuccucaugguauaaaggagagcguggcauaaaugcugugccacuaauuugcauauuugaagaaguaaagguaauuggaugacagaaaacaucaggauugaucuuuccuuuuuccucucuuccuuugucuucuuccuguuucuucuuucuaaaagauaguuaucuguggucccuuaaauagcuuuguaaugcaauaaauaaauugguguuuaaaaauuaugaaauaugaauauaaaauaauauucauaauacaugauacauaaauauauaauauaaauaaauauaaaaguauaaguaagaggcuaggugcgguggcuuaugccuguaaucuuagcccuuugggagacugaggugggaggaucacaugaggccagaaguuugagaccagccuggguaacauagugagaccucaucccuaaaaaaaaaaaaaaaaaauuagcuggccacuguggcacauaacugugaucccagcuacucagaaagcugaggugggaggaucacuugagcccaggaguuugaugcugugagccaggcuuaugcuacugcacuucagcuggggcaacagagcaagacccugacuaaaaaaaaaaugguguauacauauauauauauauauguguguguguguguguguguguguguguguguauaaaauuuuuaaauauauagauauauaaaaauuauguauaauauauacauaauuuuacuuauguauaauauauacauaauuuuacuuauguauaauauauacauaauuuuacuuauguauauuauacauaaauauauauauuuucuucugaguaguugaguguauauguacguaauauaauucuacccucaaauuuuggccaguucaaugggaagacccgaagggaggagaauggagagugacagggcauacacacacacacacacacacacacauacacacacacacacacacacacuuuagagaauaggaaagugacauaggaaaaaaaagucuucugaucucagaauugcuagcaaauuuauuugguuuucuccugcuguuuccucugucucuagcauuagccucuauuacugccuuucccaaugcaaauuagauuacccucuuaucacugagcuucauuugcucucuggccuccaguauuuagugacugugcucuguguugacacaagaacccaguggaguggaaaugucccguaagcuucagcuacaugguccagagaaaucaauuuauaugccaauaggcuagccacauuccauccugacaaccuguuagaaccaccuggggagcuuuggcaucuaucuauccaugccagaccuuacgcugaccagggaaaucacuaccuuuugggggaggguuccuggauuaucagccuuaaaaacucacucagucccucacugugagggucguuucuaacaugacaccgggguucuucacuggugaagcagauucucugcuucuacuuguaggugguccuuagcauuuaccacaaauaccuauucagaaaaucucaaguaacauuuguccuuugauuuucaaaugagaguacuuuuuuuuuuaagaaugcaauaauuucccuuuuuuucauuuuuuucugccuuuuagauguuugaauuuauuuauuauuuauuuuaccccaaauagucauaccuucauauuucacaugucgcuucuucuuauguauuucacagacuucuagaaaguuuuuguuuuguuuuuuacuuugcucugugcuuggcuuaaaguaugcauucagcugagauuguugcugcacugggaaacucuuauuuugacucaaaagugauucguugauauguuuccuuucuggcagacagauggugaauugaacacagagcuuuucuuuucuucugaguagcuucuugaguggggauuauguaauaaauacugcacaaggacugcucaaucaauaaauuuuuacauuaaggaaagauaaaaacgucagaggcagcagaugauguuuugucacaagacaaagaacccaugggccucccugugccaaguuauuuaaugucugacagaaugaguuuuuacuuuaucugaggaaaauuaccauaauuaaguuguccguucugaaaugaguaguguauuucuuuuuuuacaguagucaaugcuuaagauauauuuuugaaaaagcccaagugacuuauuaacaaacacagguguuuaaucauaaaaguuaccaccucucaugagacuaagaaugauuuuuuuaucuuagacauaacauuuuauauuuauauaaaauauauacaauauaaguauuauauauucaucauuuuuuagauaucuuuuuuuuuuccugagauggaauuuugcucuuguugcccagccuggaguacaguggcacauuaucggcucacugcaaccucugccucccggggucaagcgauucuucugccuuagccugcugagcagcugggacuacaggcaugcgcuaccauacccagcuaauuuuuucguauuuuuaauagagacgggguuucaucauguuggccaggcuggucucaaacuccugaccucagguaauccaccugccuuggccucccaaagugcaggaauuacaggcgugagcuaccgcacccagccuagauaucuuaaagguauaaggauuuaaauaaaguuugucuuucuaaugauacacuggccuucagagagcugcuuucucaagaagccuuugcaauccugacauguugcauguuuuagggcuuuucucugggcuccuagacaguuacuugaaccuguuucucuaauucacuuauuuuuuuauuuuuauuuuuauuuuuuugagauggagucucaacucuggcacccaggcaauggcacugugucggcucacugcaaccuccaucuccuggguucaagcaauucuccuggcccagucuccugaguagcugggauuacaggcacccaccagcacaccuggcuaguuuuuauauuuuuaguagagaugggguuucgccauguuggccaggcuggucuccaacuccugaccucaggugauccacccaccucagccucccaaagugcugggauuacaggcaugagcugccacaccuggccucuaauucacuuauguucuuuauuuaucuuguacugguauauucagccuaucuaccaguugugauguuuucucuucuuccuucaguucagcugccaagagauuucugaaguuuccuguagacuuccaccacuuaagcagcacaacuuguaguucugcgguugcuaaauaucaaugucuagaauuuuuuugaaauuuagagagacaaacauauguguucugucaccuuugacuuggcuuuuauauaauauuuaaauaaagcaggcagaccaauuuacacugaggaugaaaguuacaguuuaggagagcuugcuucugugcauuuuauggugaaguucaucuuaugaugaucauuuuccaagugauuuggaacauuuugaggugaaguggaaauugcuaaugugauguguacugaaagaugagauguuaucacaaagaagaauguguuuucugucucaaauuaauguacaguuuaugucaauugcacugccucuuuauuugcaguggacaguuggauaccaccaucaaaccagcuagauaggaaaggagguauuuuaagguguagaagauagugaggccccaggaguguggagccaugcuggagaccuuucuaagcugucuugagaauuucuccucaguguugacugcauuccucugcccuugcuuuaccagcuccccaucucuuauauuucugacccuuggcuuugaacuugacuuugauuucugucuguauccuuugcuucuccucuggacuguuccagcccacauccuguggccuguccauguguuaugcuugcuauuuuuaucugaaacucuaaguuuauuucaggcauuguggaagcccccuugcucuauuacaaacuuaggaugguccuugaaaucuugcuaucuuccugcuaaaaugucugugggcugcagaugaugcccuuuauuaaaacuaaacugcuaaacagccuuagagagaugaucacuaucuaagguauguuauuugucuucaguauuuauuuuuaggaacacaauacauuaaucuuauuuucugagaguuuuugcuuauaauuuauagucauucuucauuaauuauacuuaccauuucucuugagaauacugaaaugaaaaagugucuuuggauuuuguguaacugaauuuaugauaaagaaaaauugguuuauuucuuguguuaucuucuuacauuucaguggcuuuagaaauauauuaaaguucaaaaaccgggucaauuuauuaaucucaguaacuguuuuauuauccuuuugagugugugauuaaauguagcagagaauucauggaugaaguauggagaaauucuuucuuacccuggacaauuuuuacccuggaguaauuuuuucuuacuuuuucuccguauuucucaguaacgaugguaacacucacacuuggcuauuaagaauauauaaucagacauccaaauuauucuuuuucuuuuuuuuaaucacagaauuaacuccugaggagagagcccaaaagauugccaaagccaugcgcaaacagucuucugaagucaaagaaaaaugggaaagucuaaaugcuguaacuagcaauuggcaaaagcaaguggacaaggcauuggagaaacucagagaccugcagggagcuauggaugaccuggacgcugacaugaaggaggcagaguccgugcggaauggcuggaagcccgugggagacuuacucauugacucgcugcaggaucacauugaaaaaaucauggucagcaucauugucuuugaaggauuuuuaagaaauguuuucuuguuaaauauaacacaaauaaagagagccacguauauaaauuguuauaagggauuguuacaaagccaacgccgcugcaaccccacccaucaggagucaggacaggugcuuuccauaugacccucauugggguucauuggaacccccugcccccaaauaacaacuaaugcaacuuuuaugauaauuuacauuuauuuuuauuuuuuauccaacugugcaucucuagacaauguagauuagguuuaccuauuuuuaaaaaauauuuuuaauccccagauuuccccucucuuccuuuuuccuuuucaguuuauuuguuaaagacacugaauuguuuguuuuguauugauucccagagccuggauuuugcagaauuguguccauaugguauagucuccagguuccucucuacucgguaucucuuguaaauugguggauggagauagagauuuaaucaaaagcacacucuuuuacugggaacucucaucuauaaauuguaucuuauuguauauuaaugaagaauuaguuuagcuauaaauucuguuuguaguaaggaauugcccaaagcuauggauguuagacuuaugguuaccuccccuuugguucccauauucuagaacaucuccugaaaaaaaaguuaauaaaauuuagacaauaagagauauaagagaugguuuaaaguauaccccaaaucucauugacaguguagucagauaaaaauaaguacugaauuuugcuaaauauuauuaaauaugucaaaacaacuggaaaacgaaauccuuggggguaaucaaauaauguuaacugccuaaaauuaucauuaaucguucuuauuuacagaauacacaccuucuggcaggagaagggcuuaggagucacaccugccaacagacuuccaguuagcaccuuugauacuagcagauguucuguuuuuauggcaaggaaggccacauagucuuuuauucuguuauaggaaagugcagucauaacaugauaaauagguucuuuaugcuagaacacacagcaguucugaaaccauuuuaaaacuugcuuuaucucgagccccuuaauuuggaagcucuucaaaaacaaaagauaaacuuucuugauagaaagacuccucauugccauauaacaccugaccauaaaaagaaaaacaaaaaccaaagaccuuguuugucaaagcuuuuuaaauguuuuaaccuguggcuuauauagggaaacauuauuuuuggagaggaaaaauuugaauuucuuuuuuguuccaaaagauuuuuaaagccugucuugaaguuauauucuauuuguuuaaaguuuacuaucuuuugaaauaaaauaggcuauuauuugaaauuauaugcaucucaaaacauuuucuggcauuucauuuuuaaucuuuaauagauaaaaauaaaaagauguugauuuuaaaagcuaauuacaguucuugaguccuccaagguaccuacccauggagagaauauuaaugcauauagcuaaaauccugacuaaagaaaccuugaaggauuugaauucuguaauuguucucaaacugaaucugagagacccagaccuuuucaaaguucagacugaaaaaucccuuugcccacccuaacccaccccuccuccuucccugugcuucuauauuaauugugaauuuuuuacacuuauaaugccucuauuaccauacaacugcucuucuuauuuaauuguauuuguguguuuuucugugugugcacauucugucauccauuaaaaugccgaaucugcagcaauggaaaaaaaacuaucucaacucuucuucuccuuccauacugaagcaauucccaugaauuuguaugcaucccuuccucuacccugucuuugaaauguugguagcugcaggguucgguaauauuucuuacuuuacacauguugacuucaaacuuccaacauucauaguucucacccugacucuagucucuuaaagagacuuaaagagccuccccacuuaaagaguggacaauguagaaaugaggaaaccugagggcaaagcuaaugggauguuuacaacaccuacuacuucuaaauuuaguuugguacauuauuaacuauaauuuuguggccaauuuaaauuuaaacuguuuucuuuuaauaucccaguuccauuauccauucuguguuagcuuaauauugcucaaauaucauuuuugugggccuuugucaauagaaauuaauucugucucucuuggauugcaaguucugugcugaauagugagggucuauucccaagcagcuuccauucuuuacugggaacgucaagaauguggaugcucauaauuacaauuucuaagugcucuuaguaaguuguuuuaaugauucuagaccuugcucagagguggcauuugucaauucuaagacucauuuaccuuuuuucuguagacuccacucuuccugcccaagcccuaaccacagacagugauuauaaaugauuuugacagggauagaucuuaccucuugagucuguaauaggcauugguuucaugguuaggaauguuguuucuacuggccacuuucuaauuuaauuuuaaguggaaacauguuaaaaucaaguuguugcauuuggugaaaaaauauuaagguagcuauguuaaaacagaauaaaaagaaaacacgaauacaaacuaaagauagaaucaacauuagauaucaguaaaguggaaaauaauggcauacauuuuccagaguaaacugcauauaauagaaagcaugaaaggaaauacauaaucauuuuaaaaguuugaauuauaauuuuucucuucacacauuuauuuauauuuuuggguaauaaacaaugacuuuuugguucuucauccaaguuacugaagaccugaauuaagucagcuguuguugagugggcaacuguaguugauuuccucugagcuggccuugccauuuauuuggaaguacaauuccaggaccccgcauguaccaaaacucauguauacucaagucccacauuuccccauggaaccugcauguaggaaaagucagcucuccauauauauauggguuucgcauccugcaaauacuguauuuuccauauguuugguugaaaaaaaucugugcauaaauggacccaggaaguuugguugagaaaaaucugugcauaugugaacccaugcaguucagaccuaaguuauuuaaggaucaacuguauuagcuuuuguuauauucguuuccaauaauauauuuuuuguucuuuucuucuaggcauuuagagaagaaauugcaccaaucaacuuuaaaguuaaaacggugaaugauuuauccagucagcugucuccacuugaccugcaucccucucuaaagaugucucgccagcuagaugaccuuaauaugcgauggaaacuuuuacagguaucagcuuauuccccuucauaaugcaggcuuacaccuuggguggucuuuaaacccuaccucacuauauuaccacucaccguuuucucuuucuuugcugaugguauuugauaaugaauuuagcaugugaugacaucagguauuugucuuucaguaucuugaaccuaaaggccucauuuauuuauagaguuuaauuuaauuuuuugauguacuauucauaugauauuuguagaaaauugcaaaagguuaaauaaaucacaguaauugaaaccugugguaggucacagaaacauuuuucacauaauggcuaauaaaggagucauuuuucuuacuuucaucauguauuuuuuuuuucauuuugaaaaaucaggaaagucucuauuguuuuucuucuaacugguugcuauuuaaauaucuuccuuauuuuuuccagauagcacauuuauaccagugguguuuaccuuuaguucuuagauuuuagcuaaugcaguugguuuaaugacucuagaccuuauuuaaauaugcaauuuugauguagcacauaaaaacauuugagagauauauuuuaucuauaauagguuugcugaauuaauucaaauaucaaagcacucaaugguucauauuuucuuaaugaaauugaagaaguaagaaauuaguguacaauauuuuacaaucuuagucuuugcaaagaguguuaauaaccuaggauuaguaaagcaaaaucuguuaaauuuauguguuuuucuaguggauggaacauagaaauauuuguucuuuauucuuuuuuuuucuucugcucuguuucucuaauucauuaucuucaugugaugauucuuaugguccaucuugauuuacuucccauucuauuucuguuaucaccauuuccgaagauuagaagucggggaauauguuauacuugaaagaagauauguauucugucauccuuaucuaugauccugguaaccucuagagcucagauguuaguugcugguuggaaaagaagagaaaaaucuaugcuggugggcaacacuguugaauugcaggaguaauauuuucuuuacucauaaaguguggcauuugaaggcuuuuaggccuuaaugaacaaagugcauacuaaugcaauuuaaauagcuagccaggaggaacuagugcuguccagggaaucagacauacacaguuucauuuaaggacagcugcaaaugagauugucccucuaaguggaacaguaacuagcauuacaugaccaaggcuagaaaaaggaaauggaaaugucaguaggcugugugcaguuguuauugauuugcauuuaguuucucaguuuaguaacccuuuacauuuucauaaugcagagaacuaacuauagaauguguauuuuuaaaaggcuaggcaugggggcucuugccuguaaucccaacauuuugugaggcugaggugagaggguugcuugaggucagaaguuugagaccagccugggcaacauaggaagagccugucucuacaaaauaaaaauuaaaaaauuacauaugugguguggugugcgucuguagucuuagcuacuugagagacugaggugggaggaucacuugaggcuaggaguucaagguuacagugagcuauguuugugccaccgcacuccagccugggcaacagagugagacccugucuuuaaaaauaaaacaaaaacaaagauguggauaaaagauguagaguguccaaccugggcagcauagugagaccuugucucuaccaaaaaaaaaaaaaaaaauuaacccggcaugauugcacaugcguguagucccagcuaccugggaggcuaaggugggaggauugcaugagcccaggaggucgaggcugcaguaagccauaaucgugccacugaacuccagccugggcaacagagugagacucugucuuuacaaacaaaacaaaaccaaaaccaaaaauguauauuaaaaaaaauacgaagaguacauuaauaugccuguacaaacugaaauauauaucucaacccgaaguagagaugaucagauacaaauuuggaggaaaauaagauguugcauacucacaugucuuuucauucucuguuuaucuucuaccaccucacucacucuauccuucuaacuauccacuaucuauguacugucuauuucucucucucacuccccauauauauauauaaucuauuaucuaucuaacuaucuaguuuccuaggcuucuuuuucauuugcuccccauaacacuuuuuaccaucuuccuuacaaaagagagaugaguggucacugaucccaugaccacauuuugacuuuagaggcuuuacaaacaauguacugccuuagaggcaaugcagaguaacaguuagggcacagauucuggcacuguaugaccagaauacgaacaggaguguugccacucacuagcuuuauauccuuggguaccucuuuguguuuuaguuucuuaaucuguaagaugaugauaaaaauaaccuuuacaguuauugugaagacuaaagcguuaauuucuauaaauugcuuagaagaguaccuggcacuguuuacuauuauuugaggucagaaggagucuuuuuuuuuuuuuuuuuuuuuaccauuacucugauaccagagacagagaagggguccaaggggucuauauaaacaaucauauccugggcaauagcaucauuuauuauagucuuuaaagcaaaaauauuauuaaaguuauuguuucggaaucaaauuauuuccucugacuugcauguguaugugugcagguuucuguggaugaucgccuuaaacagcuucaggaagcccacagagauuuuggaccauccucucagcauuuucucucuaguaaguacuaauaaacuggacugaucgcauuaauugaaugaauuagcauuuucuuucacuuuaauugaagaagccguauuccuugcuauaaauauguuuauuuagauagauccuuguaaggagguacuaacaucaaagaaaauauugcuuaaugguuauuauuuguaauaacguaaugacaacugagaagucuucaagguggaacagaaaugaacucaucuuuagcuaugguuucucauuggaaugucugauaacuaacauaguaucauaucaucauugcuuugucauaggcaaagauuaugaacuuuuucauaauaaagaaaucaguuuuaucuuuuaagguuuuaaauuaauuuuucugcuuaaaaugugcuuauuuaaaacacaccuucaacuuucaaaguaaaaaaaaucacuccccauaaaucuuuaagugggaagauuuugauuuauuaggcucgcugcgauuauauuuaguuuuucugcuauucgaguauugcguauguagccaaaccaccuaugcagaauuuuauguaauauuuuucaacuggaauugauaaauuuauggacuauucuugagaucuucaauaaacaauuugagcuucuacuuuaucauucacuagugaagauacuaaagaaugucggauuuauagucaaccagauugaguuuaaacauucauucugucgcuuaccagaccugugaauuucugaagguugauuucuuugucuuaaaauaccguauuaccuauuuccucugauuguuuugagaacucaaugacaaggcauaucgaauuacacaaagcaccuagcacaguucuugacacaaaugcuuucaauaaauauuaauuccuuuccuuucauuuccuuuagcaaauauauguaagaaagcaauuuguuucauuuaauucaauuuaaguaaacuuuaaaacuuagggcaaagcuuauuucucaauuaugacaguuuuuuugcaacuauaaccauagaaacagcuaaaaaguacuauaucuucuaacuaaauugauuacauuuauauuuccucuuaauguuuuugucacucuugauaaacugccuuaccucaguuaaagguugggcuuuucuuuuacaauuucaagaaucuuaaucagucauuuucugccccuuccugcccuacaccucucuaccucucacccuccucacugcccccaccccuaccucaacuccauacaguuuuucuguuucacaaaccuuagaccuuagguaguuaaucuuugguauacgccuuccuggaauauacuguguaccuagaugccaggacacauuuuuaaaguccagauaccaucaauguugaugaaguaaauagguuugcuguauacuuauuagauuauuaaguauuccagauuucuaaagcucaguuuuucaaaauguaaagcuauguaccaagaccaaaugaaagaggaauuuacaaaauaauugagacugucuuuacaguucuaacuaucaguuaucuuuaauauugaugaaaugcuauacuuucaccuagcaaucacucucauaguggaaaucaagcacauauucuuuuggaagugaaauauugugaaauuuauacacauuuuuguaaaagucaaauacauggccuuguauuaucuaacacugagaauccaaggagguagaaguuauucaaaucaaaacaauuauuaaaaugaguggggaaguguaaacaaagucccaauuaauacauuuaauaauuguuauccuuugcugcuuggaaucuuuggcuuuauuauauuucuuggacuucagccaugguuauaaaagaagccuguuuaguuaggcacaaaauaaaaacugaccuauuagccuggugccaacacugaaaugagguuggcucuaaugagaaauguaacauaccuacuuccucauuuucaucccuguuuauacuuuggugggcauagauugagaacagagugcuugccuuuuauaaagagaggaggaauuguugaguagaagaauugcucagcuaguguucagaaauugagaucacaucugagcucgaccguuuauuuacuggcugucacucuuugggcaaguuauuuuaucucuacacauuuaguuccucaucuaucaaauggaacuuuaacguguaucuugcuggcuuccuuaccgaaaacauauauuugaaaaugcuuggcaaaguuuagaaugcugaauaguuguaagauauuaaugugacaugaaauugagaaaaaaaguauuggugacaacuggcuacgugaggaucugaugauauuugcaaaguaugaaaauuccaaguauuauuugaauuuuuauauuuguucauuuagcaaaauucuuuuauggcacuaaauucacauguacuauucuucuuaaauaagucuuaaaauaauugguuaauguaggaauaauauauuuuuuauaaguaagaaguaacuagaauuguaaaaaaaaaaaaaaaaaaaguaccucaauuuaaaaaccccauaaaaucucagucauaguaaggucuagugcaaaaguaggagacugggcucucuguauguuucagaugaaaguaagaaauugggauuuuucugccuagacgauugccuugguucuucacaacuuuuugccuauuuuuaaauuccuucuuuuuaaauguuauagaauugaauuuacuuaaaugccaucuguacucaauagcuacuccugugacuacgaugcaaaguaaacaauguuauuagucaucuggaaaauucggucuugaaaaaucuaauuuuuaaucuggauauaccagguaaaauuaauuuugguuuuagcuuuaucaaaaauauauauggaguacaguuuccagauggcacuaagguuuaaacuguaguauuuauaagcaacaccauuugaaaguuuaaaaguauuuuuaucaacagguuagauuaguuggcauuagaccuugaaccuguauuguuucuuguuuuacuucaaaugaauccuuaaagccauuuuuuguuuggcccaguggaucucauaauuauaggaauccagcucagaaaccagagcaguucauugaauuugcuauaaaauguucaguuguuuugcauuaagguguaaggcuuuuugguuuccaacguuuccaauaaucucccuuuguuuccucagcgucaguccagcugccguggcaaagauccauuucacauaauaaagugcccuauuacaucaaguaaguugauuuuaauucuccuuuaugauaccaagaaaaucauguuuuauugauaacuuaagaggcuucucuccccauaacuuuuaaaaauagaauucaguccuauuaucugaaagaaacugugauauaguuaauauuaaaaagaaacuacuuuuaacaugagaauuauauuuuucauguaucagauuagggauauagguguguuuagcugauauauuuuaaaguagagauuuaaauauuuggagacagacaauaagcuaugauggccauacuguauuccagccuggacaacaaagcaagauccagucucuaaaaaguaaaaaaaaaaaaaauuggagaaaaaugacagaauuucaaaauacucuugacauaaugauauuugucaaauuguacaaauucuaaaccauuuuucuuccucuaagaaaauccauauaaaaaugucuuauacucuugucauuuuauuccaccaauaagaaauaaugauuuaucaugaaaaagugaaauauugucaaguuuuucuuugucuuauagaaguuaucugcauuauuagcauaggcucaucauucuuugauucuguuguccaguuaguuucuccuucuugcauacuguuucuucuucuuauaugacauuuuauaaguuuuguauaauuuacacaggcucuuaguaggcguugauccuuggcuuagggcuauauauugucauggaacagaaugauaaaauucuacuucuauagucccuuggaguguaacuuaguaaagauauuaauuuacaacgugcucuagugaugagucauaguugacccuauuuuaugugucagacgaacagcaucauaaucaugacaacacuuacuuauugucaggagacagcucugucucagguuagcugugugaccucagguaagucagaugaagaucucugggccaaguuuccuuuuuaucauuucuaacauggggugugguaucuccaaaaucuauacaaaugcuaauaaucugcucuuccaguauacuuccugaaaacguugugugaaguccauguuggugaaauagucuuuucuuauaauuuuuuauuacagucugagauguaagcucaggguaaaaaacagguuugcauaauauauaauaaauauaauaagcaauauacguuacauuagcuuaugggaguuuaauauuuuuaucaguguauaaccuacaaugcacugaguugugaacugaguugagaacaagguauuaaagcaauugauuggugucaaauuugcccaaguaagaauggaaagaggucagacgcugguuaaguuggcaugucucuagugaaagaagaugugauuaucuaacugaaaauguuuaaaacuguuuacauuuuuauuguacacuauaacaauaauaauaguaauaguauuagagaacuuuaauuugcuugguugaauauugacuugaauuuaaucuuacaaauuuagauauaaaucugauguacugugguaggcaaaauaauaacugcucccaaccccugaaagaugcucacaucauaaucccuggaaccugugaaaauguuagguuacaaagcaagggagaauuaaggucguaaauggaauuaagguugcaaaucaacugaccuuuaauuagggagauuauucuggauuauccugaugggcuuaauguaaucccaggggccuuuaaaaguggcaggggaggcagagauuugagaaugcuagcuacuagcuuggaagguaaaggaagcagacaugauccuuaaaugcaggcagcuucuagaagcuggaaaaggcaaagaaaugggauucucucuuagaaccuccagagaaggaauucagcccugccaacuuugauuuuaucccagggagacauuuuuguaacagcaauagaaaauuaaugcauguacuauaaaaaaaucaagaaguucacgcaaauuaauugaaauuaauuaauuuauugaauugacuuagagucuuuuaucaucugauuuuuuuaaaaaugcaaacuggaucuaguuuuuggguuuuacuaaauaaaaaaaauuaaauaucuugcuuuauguuuauaucaugauuaucugugugguuugggacuuuuaaaguccauccuuaauuuuagcucuuuuuuaaaaaugaauuucuauauguuuagguuaauuauauaugacugagaauugucuaaaucagaauuucucuaauucaaaauguuuauaauuuuggaaggaucugguaggauuguauucuuguucuuguggggcagaguucuuauggggcagauugguagaauaaaaguuaguuuuaccuggcuucccauuggcuagagcacuauuaccagcacuggaaaauagauauaauauaaugauggccacuauuuuaaauaauaacguuuaggacuguagcauuuaaaaaaaucuucuccaucaccaguaaaagaucagauuguuuaaaauauauguaguuuuaguguuaaaugucuuuuaagucuuccaaauuuuuagaaaugugcucauuuguauauagcaaauucccauuuucacaaaacuuguuuaaccaggaucuuucauuguguaauuuaacaguuuauuuccucaugaagaaggaacaucaaauucugaagguagaguuauaaaagccaguauuuaugugugaagaauuguuaugaaaacaaaauuuaauucccaaauuaauaaccaagcaaauggagaaugaaaaagcuuuuaauauacacuucccuuugcguggcuucaaaaguagaagaaaaauguuuaaaacaaauuuugcaugauugccaugcaaugagaauuuccuggagcaaauuagaauguauauggcuaacaaaaaauaauauucagguagaaauauucaacguuuuugguguuuaaguauaucaucuuuguauucacuguuagaauauggccagaaaguugaaaggagacuaggaagggcaaauuauuuuuaugucauauuuuaauuuuauagaucacuuaaagcccacuuugauggcuucccacugcauuucugucucucuagguaauuccuuauuaauauuuugaagugcacugcgguggcuccauggcucauguguuuguagaaaaugaaagaauauaaaucugaacugaaagagucuauauaguauaaaccccucuauuuguugauaucuuaaguuaaaacuagucuauauaguauaaaucccucuauuuguuaauaucuuaaguuaaaacuagucuauauagcauaaaccucucuauuuguuaauaucuuaaguuaaaauuaacauuugaaaauuuuauuugcuuccucuaagguagacuuucugaaacugaucuaguuauuucuuuuuuccuaguauagugcaaugagagcucauuguauucaggguuuaagaacauuuaaaauggggccgggugcaguggcucaugcuuauaauccuaaugcuugggaggcugaggcggguggauugcuugcccccaggaguucaagaccagccugagcaacaugacaaaaccccaucucuacaaaaaauuagcugggcaugguaacaugcgccuauagucccagcagucaggaggcugaggugggaggaucacuugagcccgggaggucaagacugcagugagccaugaucacaccacugcacuacagucugggcaacagagugaaacucugucuccuuaaaaaauaauaauaauaauaauaaauaaagagagagagaaaaagaaaauuuaaaaugguucuugcugccuucacaauauacaaaaaucugccauaaaagccagauaucucucauuguaaauuuuugguuauguauuuugcacaaguuguucauuuccucagauaaaagucaacuuccagggaauaugaggaauaagaggaaugaaagcuuuggguucgguugaacuuucuuaaugcaucacauuaaccauguaaaauucaccauuucucaguuugccacagaaauaauaauaacauauaauaaugauaaauaguugcugugggaaguaauaaugaucauuguaauaaauuacauuuuugaacagucauuuauuugccagguguugugcugaaucuugugcauagaugaucucuuuuaauucucucauuagccaagugaaguauagguacuauaauuacccccauuuacacauaagucuuaaugaauuaucaauaacugcauuaaaaguaauuaauaagcacgcuuacagcuugcuugagauuacacagcugguaaauagaagagcuaguguucaaacccagggauugucuacagcuccugaacuccugaucacuaugcggugcuguguccuggccccaauauuaguugagucagaggacggaaguuuuuagucccauggaaacuuugaauaggaugaaggauuauauuuaggaaggaggauaguaguggagaaaguaugagcaaacauccuuucuuucauaccauagacgguuaccauuuacuaugcaccuccugugugccagcaacugaguccagcuguccaaggacaaagcccaugcuuuuuccaguacuccacacugccguuguauaggcuuuuccauaggcuaauuucuacaggaggaucuauuuucuagauguuuaaagcaguuucacacuguggucugguaauggacaaaggugcuuuuucauagauaggaagaugucauucccacagugcuugccaguuggaccuugagaggaacucugagguggggaaacacacucuuuggccuuccucuaucuuuccccauucacaugaucugaagauuucugucaacugguagauuuaaguaucugcgaguaagauggccaacaaagcuggcuuauaaguccuaagggacuugaaacacagaugguucucuauacauccggccuguugguaagucacaguauuuaauagaauuuaauaagauguaguuaggaaauaagauuuuccuuuuuccuuauaacaccuucucuaaagccugaguuguugacuuuucaguaagccuuuagucuugcuacagaugacuauucuguucuugugacaaggugucaccaucacaauuuaacaauucuauagcucaguuuuucccacuggagucugcagugcagauguuaauucuucauagaacccuaaauacaauguacaauaucacacaacacacagcuuucauuauguacauauuaguaaucucugguuauauauaccaugcaugucacauuuucuaaaacugacauuccucaauauugcaagaaauuaaccagcauaaacuugucuauaucuauaaaauuugcugucuuacauuucuuucccuuguucuaacucccccucugaguggauccaaaugaagauuauccucaauuuguuacaucucucuuuauacuuuuauuuuccauucuugugcccauuauugauaauccugcaaagcucuuuuagaccuacucucauuucccaaggccacccucuaccugcccuaauccuucaguaacugaaaggaauugaaauuuguaauaguuguaaaaucuuggggagcgaguaguugaucuuuaucgcagucauacaguucauuugcauagauuguauauacuugucuuggcagaacuacauauaccgucuagaggagagaauucaugcauacuucuuuagaagaauugugcgccagcuuaggcaauacagaagaaauaguccuucccuaaauauggucagagaggaguaucagcaaggcaaucuccaaauacucagccuaacaggaaaaugaaagcuaacaaaguguguguaacagcaacaacgaagaauuaacauaaagcauuuuaucauuaacgguuauagaaaacuuaucccagaacagaauaaacccguaacaaagguauaauuaacaaugaaaaauaaacauagcucucuccaaaagggucccuacagcagucuuuauuucucccuucccucuuucgugaagaugagggaugguaucuuuuugguuccaguuuuuuaaguaaagaacucuugggccgcacuuugaaucucuuucaagaacuggagcuugugguuuugguuuuaaugauaaagaaguaaaugaaauagaagcauaagcaaaauguacuggagagucugucuuucuaguagucugugacucuguuuuuacugaaaauaaauauuuaaaacucacugggccaagucugcugauggggagguaagaacaaaauugcuuuaugaaagaauguaaguaccuuaggaucacuaaaccccugggcuuggaggggcuucagauaaaugagcauaagcauaccuuggcuaacuaaaaaucuaaacaguagaaagccugcccugcagcagccagcaaaccgucacugggaagaaaucuuauguauuacugguguccuaguuaauugagguaauuuagguggaauugauauugucuuugagagacauuagguaguuaaggacuuaaaauaucaccuucacugccauuagucuacauauuguugggccaugaaguaguauuuuggcuuggaaucuucuagauuacccaacucuauugcauuauagugacaccaucagccuuacugggcaauuugauuuuuaggguaagggaugcaguuaguaaaguucuaccauacaauguaggaaggaucacuguggggccauuuagagaggaaaaaagauaucuauacuuuauaaagauuaaauuuuuaaaacugccauugcaauuagcaaaaguacagaaguaauaauguuuaaaauuguaaaauaaauagaaauaugcugauuauaaaguaaaauaauacaguaaaagauuucauauaaccauauagaaaaaaauagaaguaauuaaucccuucuuuuaaaaauacauaaaagaaagagauaaaguaguaauuuuuuuuaauaaaaagcuaaaagcuacaaauccagcuuuuaaaagcaaacuuaaaggauacaaugauccccucaacuguugugggaacauaguccugguguuaacaccuucagaugggggcauacaaggcuccccagggccaaugcaacaacaaaugaccuacaggaauuuggcugauggucugaaucuccccaguuugagagucacggagaugaggguaggguugggugggaggugggguucccuaugaauucugggcucauguagaaauauuaucaagcuagcagauccccuggguuuacugaguauuugcauguuuauauuuccaagcaauuuaguacccucaagacaauuaucaccugucccuccccucgcacguagacacaucaguuuugaucauuaauucuacuacuuuauuuaaaaacaaacacaaauaaacuuugucuuauuguuuuguaacaaauguucuaguagucauacaugcaauauugacaucuuauauuuugggguguaugguaugguagccuauuucuauauaguccuuuccauguuuguaucuuuaaaucuacucuugagugugaaauuacuuuaaguguauuuuguuucagagacagggucucacucuguugcccaggccagagugcaguggugcaaccauggcucauugcagucuuauacuccuggccucaagugaaccuccugccucagccuccugaguagcugggacuacagguacaugccaccaugcccagcuaauuggacuuuuuuuagagauggagucuugcuauguugcccaggcuggucucaaacuccugaccugaagcaguccuccugcuuuggccuccccaaaugcugggauuacagacaugagccacugugcccagcuuaaaugcauuuuauagucaaauccuacggaauuauucauuauuuacaauguugucuuccugccuccugucuucauuaucaugagauacuaauggcauuuuuuaaggaagacucuaaacuuuugcaguaccuauuaucaaauaggaucauauaucuuauuugaauuuuggacagaauuuuuuuuuucuugaaauucugaccuccacgcuucuuuucucuuaaguuaauuuuuguuucuaaaaguauaucuuuggauuuccugccuuuaaaagcuuagaggacaguagacaguguuugcgaguggaugaggaaguugaauauaaccugaggaauauauaaguuauuccugcagcuuucucacccacuaccuccauccucuccccaggggcuuuuccacacagacacacacacacccacacccacacccacacacacacaagcacgugcacagagugagaaucaauguuacugauggggguacuccacauucuuccuauauucuagucuugggugaaacaaggacugaaaagauuauaaauuccaaaguaaguacaccaccucucagaucuuuaagaagguguuacucaaauaaauguugucauaucagauugccaacauuuguuuucacucuucauacuuuaggcaguugaaugcaaaaucgauuaguugggagcucgugcuugauugcuauauauauguaacuucuauaaguguacauaaaguaaauguuaacagaaccuguauuuugccugugucaacuuccuuuucuggagacuucugguuuucucauaguaccucccaccuucuaauacacuguauaacuuacuuacaguguuugucgucucuuauuuuuccccauccugaggcauggccacuccacuuggcaccauggaguucauugcuaauaauuauaggaccaguuugagugcaggagaaaaguuggaagccaaacagaaguggcuggaguggugaaugggacacgaggaaguagauaugguacaguacucauuggugaauuuugccugugaaggagagaaaaaaggugauaacuagcagaaaauguagauuugagguagggguguguguguguguguguuuaaggauggcacgucuguaaacauuuauauucuacaaaggauagucuucuugagagagggguugacagugcagcacaggaaauuuuuaagaaaucauugggaagaauuggccuuuaauaagaagggggacaauuucucaguuaaaggggagauaggauaacagacuggcaguuggagggaaguuuccugaguuggugguggagagagaaaggaguccucaucuaguaguauuuagguuuucaaugaagcgugagauaaaguaaaaugauauuaaggcagagaaauaaaccaguuuggggagagagauagcaguagugaauuucuguuuuggaguuugggaaagcaaguuuauuagggaauauagugcaguugccaggaguuggacauuugagguuugaaaucacauauuuuaaaguaaauugagucugucuguugagugauuuucuccaguuguuuuuauccacagcugcucagguccagaguaggcaaguaauugagcugauccaggccugggauuugcaaggggugagagagaagcaagggagaugagguuauuuguaaugauucuaaugauagaccauggacucaaauuuggacagauucaucaagaaauauuuuaaaaccuuaauuaugcaaauauacuuccauaucaagagcuuagcuuaaaaugagacuaucucuguuuaaaucccauuucuauuacuuacuauaggaccucagacaagcuaucuaagcacucucugcccuaguuuuuuccaucuguaagauggagacaauauugucacccaagucauagaauuguaauccaaauagaauuuacacauagaaaaaguuuauccaaaaaaguuuacuugguacaaaucgagcacucaaauagcauguuauuacugugauuaauauacauccugaccuaguauauuuuacuuugcacagcaaagaagaaauauuuuuuucuuugauugucuuaucucagagcaauauacauaguucuuguccccacauuuguauuuuuacuuaucuuuaguuuuguucuguuauaugccuuuauaauuauaauuggaauggaaugauauauaacaaaccucacaaaauccaguuauaagcauaaaauuggauagcuaguaacaaauaaguauauuuggguaaguguuaguuuuuggagaaacaaguugccuucugaucauccuuuaagguuucauggaaaaauaugagaccacucuaaugaggacaaauggguuuaagaaguaucuuccacagagcagucauuugcccagaaaucaagauuuuaccagccuaucaaaagugcauguccuuugcuguugguucauuguguuacauguuaggcaguauugcagcacaacuuuuuuuguuuuauuuguuggugcuacagucuuauauuauuuguguuuuacuuucuguggcuuaucaguguuauauuguuaugaauaauaauagauagguggaaggauauacuacuucuuaaccuuauuggcuuaauauuuuaauaauguccauaaaaugcagagauuauauguuaucccagcuggggcucuucagaguaagggggcacuuuuaauaauuauaccaggaugcugauauguaauuccuguauacagucuaguauaaagcaggauuuauacugcuugaaggauaguuuucaaaauaggcaaaaaucuuaacucuuauacaaauacaaaaagagcauguuucauuuaacucauaguaagggaaccaguaagaaguuauaauagguuccaaagagaauacaaaaugucacauauuuauagugagauuagggaugcuaaaaugaauuuaccucuggaugcaaagcugacaaacuggucaauauccacaggacaauaaucaauugcauuccacugggcacaauuugcauuuauauggacagaaaucauuugcauuacuaucuguuuucuucaguuugcagaguuuaaaauagcucagagauaauuuaagcuuugcaggauacccacucauuuuuugcccacaacaaagaccuucacaauuuuucccugcacaggcaaaacuggauggcuggccagccuaguuacaugucacauguucucacuauuguuugcuucauaugauuuuguacuuaacuguuaauugcuacuuuguuuuuuguuuuguuuuguuuuuuuuuuuuuaauuuuauucuuggauagauucccauggcuguugccuuuuaaagagaggauuuuuaguaauaaaaucauaauuuuauuuuagagcuuaucaagcugcacaauaugaagucccacucccuguucauauuugagauuaauuagaacccaagcuguuguuauuuugggggaaaaugcuacuuuuauucuguuuugguugccuacucugggagaacuucaggcauuuuggcaagaggagcugagcuaucugcagcuguucaaauacuuuaagccuuuggguucauuguggauuuugcuuuaacccucucccccgacuuaaaaaaaaaacagcagccaacugcauugccuguuuuuuuuauuucuguuguuugguaagcagcaguuauacuuuuguaaccagaggcuguauuuauuuucuguguuggcaguucugccuaaugaaucaacugguauugaauucacaaagggagaugcccguucccucccuccaucuguuugccaaauguguguguuccgucagcucucaguagugguuucacuaaaaagagccauuagcaagagguguucaccuugaauucuuaguccuccgccugacugagaaauagugguauuuuccucuugugauuccguagggguugugugaggugaagacccacaccuguaauuccagagaaagcauauuuguuguuuaaguauaacgucuggcucuacauuaccgauggcuuuaguuugguucuugagccuugguuugcuccaucaugaugggaugucugucucuggacaguacuguugucguggggauugaaauucccugaaagagaagacaagagaucaaugaacccuaguagguucucucagacugggagcccaugaugccuuacuggaauugcauuaccuccucagcaaauccuuccauauuuguugguaauagggaggaaauucuuuuugagacucugcauuucuguaaagcucugagccuaaugaugaauaguaagaauuuaggucaaacaacuucaguacccggcuccauggucuuuugagcaauuuguaguaucacuaccaucaaaccgaaaggguggaaugguuuuguugguguucaguaguggaccaugaaguagaaguauuugucucugcauuggagucaagaaucuggguagaggagcccgacaacuuuccaucucuuuccaagacagaucuucacauuguaguuacauuauuuuguuugagaucuuggaauuuccaggauacauacccaauugcuaauauuuccgggauacguacccaacugcaaauacacacuuuaaauauuuuucaaagguaaguaugaguuauuugggguuuuuguuaccuguguauauauaacagugaugauauucuuuucccagugacaugccccaguuuuugauauauuacauaggcuugaaaaauaauuucucuugaauuugauuuuaugaauguuguaauaucacucucuuagguacuaugcugguucauuuaguuuacuaaauaguuuuauaagaacuaggugucauuuaagaagucuuuggagcacuauuaaauguuaugaaucuacccugaccuagauaaggggcaguuaacucuuuuuaaauguaaggccacugacccaccaaagucaugaacuguuuaccuaagaaacuuaauugaagcauuccauuuauguuuuaaccucaauuuauuaccccaaaacuuccaucuaacauaugaauuaguuuugaaauuuacagaaaaagagaaaguauaaaacuugcuuuuaaagugaagaacaugaggaaaacaauuuaauacauauagaaaauaauaauacugguuaaugagaggaagcugagaagaggaacacagagucuaaguggcaagagacacuugccugaggggaguggggaauccagauacacaugaagagaagaaaggguagauuugcacugaggaaaguucgacucaagguagaagaggagggaggcucuguagauugugggaugauguuauucagaguuaaacuuguuucugcaaucuuuggaaauaugacgagacuuuuaagguguagugacucccacagcacuacuucugcuguuggaggauucguucugaaugauaaucuacaucuguuuaacagauauggguuuauucuggagccugcauugaucuggccacaucaagccaggaccgaaggguucaugacagucacauuuuauaucuagguuuuaauuuguaguuucaguucuguuugaaauaggcaaagcaaagauuucauuuguguuuuuacaauguaguugcucaaaugaaauuuauuauuaaaaaauuuuuauaaaaaacuuuuguauagagaugaggucucgcuauguugccaagcuggucucaaacuccugggcucccaccucaggcucccaaaguguugggauuauagaugugaggcaccacaccuggcuaaaauuuauuauuaauauuuuuuauuuuuuugagacagugucucacucugucacccaggcuacagugcagugaaacgaucucggcucacugcaaccuccaccucccagcuucaagcaauucucaugccucacccuccugaguagcuaggacuacaggcacccaccaccauaccuggcuaauuuuuguauuuuuaguagcgaugggauuucaucauauuggccaggcuugucucaaucuccugaccucaagugauccaccugccucggccucccaaagugcugggauuacaggaagagccacugccccuggccaauguuucaaauguuaaguaacaauugggcauuggguuucugaaugguugauaaugaggauaauuuugcauguauuuuuaaaaauuugaaaaaaaucauuucuacuuggguauuucguuuuuggccuauaugaaguuuuuugauuuuuuguuuauuuuuaaaauuuuaccuuuuuuuuccagccaucaaacacagaccaccuguugggaccauccuaaaaugaccgaacucuuucaaucccuugguaaguguuauuaauaguaauaaauuaaccuaaacaacugagaaccgguuuuuuuuuuuuuuuuuuuuuuuuuuuuuuuuuuuuuaagguggauucucgcuguugcccaggcuggagugcaguggcaugaucucggcucacugcaaccucugccucccggauucaagcaauucuccugccuuaggcuccugaguagcugggacuacaggcgcccgccgccacucccagcuaauuuuucguauuuuaauagagacaggguuuuacuguguugcccaggcuggucucgaacuccugagcucaggcaauccacccgccucggccucccaaagugcucccgugagccacugugcccggccgagaacuguauauuguuaaauaggagcuaaucaccagccuuucuuacauggcauauuaauguuaaaagaaucaugucauugacauuuaaaaguaguuaaauuucuaagggcaaugcaguaaacagguauugccuuucuuaggagaauugugugguuugaaaucaugugagccaaaaagaguugauuuacagggaggaauguaauuguaguuuuuaccuccuucguauugagucaucuuaaccuucagcuuugcacgcaaaaaauauauauagauauacaauuacaauauagccaacuuuaauccacugccuuaaauuugcuuuuggcucacuuuuuauuuaguacgugccaucaaauuagcucaccuaguuuaaauuugucuaaauuguuaaaagcuaaauucauuuuuauauaaaaaugcaagaaaacacagacgagaauuccgguuuuguuuuaauuucuagugcaauguggcuuucaacuuauuguuuaaccuacuuccucugguugguccagcgguuuuuuuaaguuuucucuuuggguagcuaaggagaugcuggagggaaaaacagcacccgaagccucccucucccauuucaauaaaaaggaugcccccuuuuuuaaucucuuuaaauguugggcuucugugugaguguuuuuuuuuuuggugggugaaggggccugcaaaaguuggacaaacaaaagacauagaacugguuugcuuaguuuguaaaaugagggggcaaauuuugaugauaucugaguuuucuuuuaacucuacuaaucucugauacucugucuuuaggggacaaagaaagaaauuacaauaucuauuguuuccaaagaguugaguauugguuguaggaucauuugaaccagaucugcaaaagggcaggaaaaccaaaucaaucaggaugggaggagcauagaaauaagaugagcuccaugaauagugaacuggacagugugguuggaagaaaaugaaguguccuuggggaagaugccccuggaggaaaaucuccuuuauugggaaaaaaaggaagggcccucugccuacugugcagugcauuuaauaagccaugugacagcugugcuuucucuucaucaccuuccucuuuuuccuaccaaagggcugaaaggggugguaccuuuucucacccaucauaagggucauggugacccuccuauaacaaaagacaggucaaccagaaaagcacaagaaauuuacuuaaucaaaguuuuaccugacaugagaaccuucagaagacucaaagaaaacagggaaaagugucuguuuuuacacuuagauugagugaggaauggaugacugcauugaauugugauuggaugaaaggguauaauuuaaugauaauagacugagaagggaauuccagcaaggccuaucuauucagauucuucuuggcuucucccugcagcauauuccuuuccucuagggacaggauaccugucacaggagaaucuucaggagagaagggagaaggugacagugaacuugcuagauuuuauggcuugcuuuggggaagagaaguucuaguuuucaugacccaccuuggggaaggggaauucugguuucuauuuaucacuuuggaaggagaaagagggucaggagacaagagacccagaggucagagagaccuuacuacugaggccuuccagucuccuucauuucaaaguacucaacccaccauguucugagcccugacaccuguugaaaauacuuucuuagaauuuucucuguagcacugcuuugagauguaucucaacauggugcuaaugaucauuuaacuuuuuucuuaaauacguguuggggaauuugggagaagacuuuuuauuucaggcaaacauaauauuuuuucaucauccaaaguaaccaaauacauucugggcauucaauauauauucaauaauaagccuaucuucaaauuguuucuuuuucuauuucagcugaccugaauaauguacguuuuucugccuaccguacagcaaucaaaauccgaagacuacaaaaagcacuauguugugaguuauucuaccaaaguuaaucaaucuguuacuugaauugcguuuuuuuuuuuuccaagaggaagauaaaugaagaggauggaguguuugccaaguuaaucuggucuucaguguaccucacucaaggaguugguuuuguuucuauaaauguuuuauuacuugccccaucagugugcaguacugaacacaugccauucuuacuuggagaacaaaauuaaccaaaacacaggaguaauguaaaaagcuuuuucaaaaauugugcugccacccaauuuaaaaggauuaaaucaaagaaaguauuaagucauguguuuucaguaccuuuugcccauuuggcaauguagaguuccaguuugucucaauaccacuauauauaaagaaacacuaaaaaaucacauuccugaucuaaauuugaacuggcaccuuaacaagugagauaaaaggcucuauuuucuuuuaaauauaucuugagacauuuaguauuaucaaugcauuuuuccuguggaggauguguucagaguggaauucuguggcaguccuuucaucaaaaggauauuuccucccgcaaaauaaccuaaaauuaaguagcagugugaauacuuagcauauagauuuaugcuaucuggauucuauuugugguuguaguucuaaugauugagucuacccuaggccuugucagauaguugauguggaaagugauauuuaccuguucuuuuaagauaggguaaauugaaaaguuucaaguauucuucuuugcuaccuuuuguuaacuguuaauauacgucuaggcaguucagugaugcuuugaaaauuaugcuuugaaaaaugauauguuaagguugaaaaaucugcuccuugaaagucaauagaaguuagcaauaaauuuuaagcuggcugcacgaagaauugaggaaagagagguauaaugucauugagaaaaaauagcaaugcaaagcuugaaaauaggaaaagcuuaagcuauguauggaagagaagucuacagggcugaaagacaccuccagaugaggcaaugcaaggaagaaugagaugaccuugacuuuugcauaauccacagagccucaaagauaauuagcaggugguaguaguugcagcaaguguugcagaauuacccggacaaagaaaagaaagccaccacgcucuggcuacugaucaguauguugagcgaaaagagaauaggaaguaaauuacgaacacacaaaagggauguuuggucugcgcaggaguccauggugacagcaguuuugaaagaggcucagcugcacauccaggauccaguugaugggucuggaaguucuucucaggccugaugagcuauaaaaugaggacaaaugacucagccacaaaauuuccauugacagaagacugcuuuuugucauuaugaacauggucccaguuuucgacaacacuuauggguggauaagcauauuaacacauuugguguuuucuucucuugguucuuuggauuccugaagaaaaaaacccccuccucagcucuuccccucaaaccugagaggaacagaagggacgcuucuccaacuucuaaacuaaacgagauugguaaugacaauuaaacaacuaaaugacaguuagaaaagggcuagauuguauuggauuucaaguauaugaggugcuuuuuucagagccaacugaccuucacuuuuccuacagccuucucccacugcccuccagccaaggccucugggccacuccuggagcucaucaguuuauuauuaaucugcuucuuccucucccuuccuuucaguuuacuagaaauacccugacccuuucucugcacuggcuuguaacccuuuuuuccucccaaauacuguuaaagauuuaccucuuuuggaaacauuuacaagcuaauccuacccgucuccacauuuuuucccaguaguuuaugauugccuguaauagcagguucucucaccuuagugacaagugcuugccuuugugugcucgaauaauguuugguggauugccccaucuccacugugaacuacuuuaggucauggcugucucucauuaugugcaaaucuccacccagcauaaggcagagggcagugucauuguucauucauuuguugggcuccaagauugugcaggagauaaaacacuauaaagagacuugauucucacacugaaggaacucauauuucgagaacguugcacauggacccaaugcccugcuuacaaaagauuccugcugcccucagaauggaauggucuuugccuggcucaccucucuguccaccuccuucccucugcuccaccggggcaucaccauuucaucauccacuuagugauagaaauggcaaacucuguauuccauuccuccugccuaaaaagcacuugucuuagcucuuuguauagguugaugcaaaaauaauugcaguuuuugccguuaaaaguaaguuaggguauuucauuaaaaguaauggcaaaaaccucaauuacuuuugcaccaacuuaauccuucuguucuucccuuggcugggacacucauuccuguaggucucaauguugucgaucaccucucuuuuaaugagguuuucuauggcuccucauagaacuguucuuuuccuuacaugacacuucuggugcuugguuuaggcacuaaggcagagugucaaugguaauuuuuaauauucuguuuauuaguuauuguuugcuucuccaucaugggauggaugagucuguguucgucucuacuuaggaccucauacaauuucuggcacagagcagggguugcuuaggacacacugagugaaugauuugaguuugaagguuauauagcaguacuccagaagauguguccaaggagauuuauagcaguacuuuucauaguaaaacucauucaguuuuggcauauuuauaaauauaauacagcaacaaaaaucaaugagcuaguaaucagcaucaacaugauuuaaucuuagaacuauaaaauuaaaugaaaaaauuaaauggcagaaaaaaaauguguaccacucuguuccauuuauauguaguucaaacccaugcaaaacuaaugcuauauacacuuuuaaaaacugaaagugaaauacaaagguuaaugguuaccccauaauuguaagaggauguaauuaggcaggauucaaggagcuuccaagauagugguaacauucuguuuuuuucagcugugugauggacuaauggguauuuguucuauuauuuucuuuuagaccacacauauguauuuucuguuuuccuuuguauuuugauuuugaaacuuuaugugauagguaauagcagaaaagcaaaagggaaguauguuccgaggagggggagaguccucucauuaugaagaagaaggcaggcuuccuugauuagugggcauaugagccaggcuauaaaaggcaccugggauuuaggcauggggcaguuaauuggggauaagaagggaaggaguuaucugugugagaauuaagguguagaugguguucaaggaacauuaaguuauagagucugaauggaauagcuuagcuauuuuguccaauauccagaaauuuccuuaaaguuaauuuaggucaauuugaacgucauauuuuuccugaaauuccuuucgguuuuuuuccucaaguucuuauuguguuguauuucauguuuggauauuuuucguuauagaauggggagccaugaggcauuuucuguauugugggaguuuagagauagggccagaaguggaaguaugcuuuagggaauaucuaagaaagaccaaagggcagagaacagagaauggguaaauaguucaggugaaggaugaucaaagcugagcuggcugggaguuguaggaggggagaucagggucuggauuuuuaaggcugccugaggaagaacugaugacucgggguauuggguaguugguaaauuguggcagguagaagaaggaaggauguuaggauauuucacgguuugcagacuggauuucaucaugacaagaaggccaggccuuuauggggagagguuccugaaagagaauuauauagcucuuguagggaucagagcaaugggacaugggucaaguguugaggcaggagaucagcaggagaaaagagaaucuggagccauccaaagagaagcaauaauagaaguaagaggagugagugagggccucaggcucacagaaugaaaugccagaugugaaaccuugagcucugccuauauuucuggggaagagaagauaggggaaaugcuaauaauaauaauaauaauaauaauaaaauaaaaaaauaaagaauggccacauagcuugacaccuggagaagugucacugaagcccaagauuggaugcuuaacaguguucauuguuuugcagaacaggagaaugaugaugcauuucuauuccauccccugugccuuguaugugggauuaaagaaaaagucagaaaguuggauagaaaaugauuaugcuguuuguuucauuuaccacaugacugagcugucauuugucucccuuugaaaugagaaaaucuuaaucauaauuuucugugauuuaaauguagucaguucuuuaaagguaccuaaaugugacacacuucaggaagauuuacgcuugacuuaggcacuaagacaaagugucagaguaaaucacuaaaaauugaagacaugauagucugugggauguggcaaauuagugucacagcuacagaguguauaaccagggagacuucagaaagaaaugcaaggacagccugaugcaggaaaugggcuuuuuggaauuuggucuguugucaccugaugccauguggggauccaauagcagugcuguguuacuggcauaauuaauguuggaauucagaaaacuuacagccuuuuggccauauuugaauauguuccuuggugucuguggggagcuguaguucccuagcuacugcccuuuauuaaacacuuuccuuugucaggcacuuugcuucugcccucuagagguuuacaauugaaaacuguguacaguugacccuugacacccaaaacuuaacauguuaacagucaauuaacacauauuugauaugcuauguaauauauacucuuauucuacaacaaaguaagcuagagaaaagaaaauuuuaagaaaauaguaaaagacaaaauauauuuaauauucacuaauuggaagugaucaucauaaagggucuucauccuuguugacuucauguugauuaaucugagggggaggaagaagaggagcaguugguguugcugucucagggguaacagaggcagaaaggguagaggagaaaagagaggcaggcacguucagugcuuaacuuuaauugaaaaaacuccacguguagguggacccucacaguucaaacuggcgcuguucaagcgucaacuguacagggcaaagaaaugagguaagaauuacagugaaaauuccagaugguucuuaguuuuuuucugacaccuucucuaacucauaugaagcuuauuugacuuauuuuuguuauuagcuuaaguuuaccaaugauacauuuggcaucugaaggaaauggauugguucguuauccagacuuguauguuuuauguuuaucucuuuaaaaaaaaaaaaagucuucccuguugaguuguuuuugaaaucauuuuacucuguauggguuuaaagcaguucuuuuaauuuguagauaacuuaaaaaauaaauaauucuguguuacucagacagcuagcauggacacauuucauacaugucuuuaaaaauucaaaauuauuaguuauucagugguuacaaauggauaaauacaaaggaagcuauuuguucauuuuaguuaacugucaaaauaugucauauuuuuugagagaacaguuuuugcaucaggcgaagagaaagaaguugguuuuauauguauauaaccuuauuuuuucucuuugccucuuauuuuucaugcuaaaaguuaaauauauaacauauguguauauauaaccaacuauuuucucuuugccucuuauuuuuuuaaugccaaaaaguuaaaaaauaagaaaaaauaagauuagaguucuucuagucuaauuuuuuuaugcuaaaagguuaaauacagagacagagaaagaauuuuauaaaaacugaugucuaugagcagaccuuaaauuaauguggacucuaauuuuccuuacucagauguuuagauuuagaagagucaucuccacacucaauaaauguauagauagauacaugguaguuugauaaucugcuuugucucuuuguuuucaguuagugaaugaaagacuuaaaauugauuaaauuaaaaaaaaauuugucguuuucaucuaaacuccuccuucgggccuuugcgggccuccccuugggcagugugugccuggaccaugcauuucuccugucuguuucacugccggcaaacaccacucguguguaagucacgcaucacccacacugcaguccaccauuccuuagagccucugggcuugagugaauucuugccuuuucucaaguacuucucuaaaccuggaauucuuuccucacuucauguggaucucuuguauuuuauccauuuuucaaagcccauuucaaaucgcaccucuccagggagccuuuuccaguugucuuuccucuccuagaaguaguagcucuagcagaaauuugcguauuccucucauagggcauguuuacuccuccuuuuaguaaagccaucaguaugucuuugagagcaggggcucugccuucaccuccugugcacacccuccuggcucuagccccagccaugccuaccauagauguuguacacaugaagaguaaggaugggaacaaauuugugaagaccaauggaugugggggcugucuaguacuucuucuuagcuacaggucaccucugugucuagaguacugacugcucuaguacuucuucuuagcuacaggucaccucugugucagagcaucaucggaaguaaaccagguuagggccaguuugugacaaucuuauagaucgggcuugauucagcaggcaguggagagcuguuauuuuucuauaaaaccuguuuuuuaauauggagcaucuucaguaaauuuuguauguaaugauguacaugauaaaagacuguuuaagaacaauuaguuuggcugugauacaaagaaugaagagagcagugcacaggcugcuugcaggaguuaagaugaggagagcaguguaauauuugagaugcgcugccauuuggaguagauugagagauuuaugccuugcuacauuuaaaagcaaaaagagccuggcaaagggaaagccagaaaaagaaaguaggaauaauuaauauuccaaagagcaaaaaaugagauaagauugggaagcaacagaguucagauucaaaaguaugaaagugugguaaaauguaagaauagaaauguguuuguuucuuuaaaagcugaaauuuagcuaaaaaggauagauucuuaaauugaagaaucaagcuaaauacuugagacuagaaaugccuuuguugugauguuguuauguaauguaauguaauguaaugacuguaaacauuccuucuucucuccugguuaguggaucucuuagaguugaguacaacaaaugaaauuuucaaacagcacaaguugaaccaaaaugaccagcuccucaguguuccagaugucaucaacugucugacaacaacuuaugauggacuugagcaaaugcauaaggaccuggucaacguuccacucuguguugauaugugucucaauugguugcucaaugucuaugacacguaaguuuauauuuuuucucauuaaaauacgaucacugaaugaaauauguuaauagaaaaugucugauuuuuaagugaauuuuuuaauaagugcuuucaaauuacuuucccaguggaaauauuuauguuuguuguugaaacugaaugauuuuacaaaucauugagcuucuuaacaaacaauagaacagaaaagaauguacaucuuucauuuuaaaauguugcuucaauuuacaaagacugucaaauuuauaguauucuuugccaaaaugcuaggggaaacaauauagcuaaguccuacuuucuucuuguuucauaaugucucacaguauuucuuuuuucaaaauaaaaaaucuucuguuuauuguuaugaauuacaguaauuuauuagcucauaauaaucugcucuacaaucuuuguaauccaacugaagagugauuugaauggccaugaacgagguagucuuuuaauauuugcuuuauuugcauagugguuauguguguguguauauauauauaauauauauauauaugguguuuuaaauaauuuaugcuacaggacacuuuaauaucugucauuuaauuagguacucacuguucauaaagcacacucucaacucccagcauaacucauuugccauuaauuuggcccuuuugaauacgacaguacauuugugaaauagucaguucuagaaagaccugcugugggcugacauuucugaaacauuaggaauuacucauuguucuggugggagguuaaaguaugcaaagaugaaauaagaaaacuagaacugggcugggcacgguggcucccgccuguaaucccagcacuuuggguggccgagguggguggaucaccugagguuaggaguucgagaccagccugaccaacguggugaaacccugucucuacuaaaaauacaaaaauuagccaggcaucguggcaggugccuguaaucucagcuacuugggaggcugaggcaggagaaucucuugaacucaggaggcaaagguugcagugagcugagaucgugccacuccacuccagucugggugacagugcaagacucugucucaaaaaaaaaaaaagaaaagaaaacuagaacuguuguuuugccucucaugcccaaaaaguuauuaucuauuaauuagcuacaugaaaacuucuauuuaccaaccuuugauuuagagauaaauaagauagaugaucauucauaaaugcacacauucaggagcugauugguucuguauaggaaguaaauaaugaugacaguagcuuuagcaaugagcugacuaaaaaucuggauuuuuuuucuauuccuuuuaguuuacauguaauaacuguacauauuuaugagguacacagugauauuucaauacauguauacaguuuguaaagaucaaaucagggaaguuaaaauauccaucaccugaaauauuuauuacuucuuuauguuggaaacauucagaauccucuguucuaucuuuugaaccugugaaauaaauuauuguuuacuauauucacccuacagugcuauagaacacuagaacuuauucccccuaccuauauguacuuuuguaccaauuaaugaaacuuucccuguccuccucucucgauuuuuuuuaauuagagaaguauuuuaucuuuuaguguucauaaauaucauaacaaagucuuucuaaauaaucagccacugugugcuugagggcucuuaagaaaccugcugaagcaugagucucaguuaccauaaugaauacgggauuugcgauaucucugucugauauuuuuuaauacauuucauuuuaaugcacauuuuaaguucuccuaggguaaaauauuaccauuagccuuaauccaccauuaaguugcucuucaauaauuugaauccucagaagaugcuuuuucauaguaaauucaccaaaauaguuggucaaagguguuuuaacuacaaaaccuguaacuuaacuuuuacaucccaggaaaauugcuaaauucauagaauacuuaggaacuccauucaguccuauagaauaugguagagguauacaucuugaacuacauuuuaaggaagaacuggagaagagguucaguugccuuauauuguccauggcucugacacacuguuuugguuuucuggggcugccauaacaaagaaugauagacugaauggcuucaacaagagaaauuuauuuccuaacaguucuagacacugagagugugagaugaaggugucggcuggguugagucuuuauggaagccacucuuucuggucugcagaugaucgucuucucccugugucuucacaugguuuuuccuugucugaugugugcucaucuccucuuccucuaaggacaccagucauaucagauuaugacccacucuaaugaccucauuuuaacuuaauuacaucuuuaaagacccuaucuccaaauacagucccauucugagguacuaggaguuaggaccuuaaccuguaaauuuuaggggacacaguucagugcauaaugcacacauaugcucuuuucacuggacagcccaaagggaauagugccacuugguugggaggaagcagugugugaaaugccgugauucauauucuagggaguuaaauguuggcacaguuccacuugccuccaucaaaugggaauaugugggaaaugcuacaauuugccacuguuucucauuuagaaagacaguaucuugaaauuucucauuuuucauuuuaaaggaaaaaaaucuuucaggacuaaccucccuucuaugaaaaagaaagauggcaaagaccaugcuggaucagaauggugcccaugcaguguagcuuucuaucuuggagagaguauuggggauuaaucuauggaaaaaacaguuauucuuaugacaguaaugucagacggccagagcugguugcccagguuucucuaacaaccaugauuuauuuauuaaucuaaauaauaguuauuaacucuuuucaaccaauaauuuucuuugagaaucagauagaaauuacuaucuacccuccaauuaggacauuacagacucauacaucugugaaucugaggaaugguaccuuguucuaacacuucuauucauucagccguccugacauucacucacuaaucauauacccgugacugccuucuuuccuggcaugugauacagccagaacugguguuuucagcuucagccagcucuugauaaugagugaugcacacacagaucacagaauucucaaaguagaaggauuuggggaucuuuaauucugcccuuuucucuuuacuaauugaaaaccuugcccguugagacaggagaauuuaucuaccuauugcauauuagucauaauuaaagaacuaguguucagucuuuugauaaucauuugauuauucuuacuauauuucuauaucuaggaaacauaguacuuuauuuuaagugaacaguuuuuuuccaauuuuaacauguacccaccuccugauauucugaacuuuguaaaaaaaauuuauuuucaucugucauggaugacaagaauucaaauuuuugguucugguugcugugugaguuggcagcuacuuaacauuggcaucuuaauuuuucaucugaaaaauugaaauaaaaauauccacucugcuuaccacacaaaaggugauuaugaagggcaaaugaacuaauauauguaaaaaguacuuuauaaagauaaaauugauuucauuuaugaauuugcagccucagucaucuuaccagauuaaaaggucuuaauuucacaaucuuccuucuggauuuaauggaaaucaaaaguguuuaaaucaugauauaaagcaauagucuguaguacuugguuuaaauguguuuuuuucuaccaaaaauauuaaccucauuugcaguagugucauuuguuccacuauuccaaagaugguauaauuuuauaaaguaaaugucuuuauaguuaaaccaguuuaaagaguugccuaugaaaacuaucaggagacuaaauaugucaacacugggcuaugucacucacuaauauauuuuacugucucccucuugucucucacauccauguagcuuauuuacaucaguguccuuuauugucuggucccacguaaccuguacaguucagucaaccaguuaaccuugaugcaagucucugacccaccugaaugcaucuuauuuguuuguuuuuguuuuuguuugagacagagucucacucugucgccaggcuggagugcaguggcaugaugucagcucacugcaaccucugacucccugguucaagcgauuuuccugccucagucucccgaguagcugggauuacaggcacgcgccaccacgcccagcuaauuuuuguauguuuaguagagacaggguuucaccauguuggccaggauggucucaauuuccugaccucgugauccaccugccucagccucccaaagugcugagauuacaggcgugagccaccgcgccgggccugaaugugucuuaucuccgaugcucacaccccugccucugugccuuugcucaggcuuucucugugauacucuauguucuccuacuugggacugucauggcaugacauaccuucuaugucugauuuuggguuuaucuucucugucacauguugugaaacuaaugacuaccuagacuaaaucacuaaugauaggcagccacaaugaucuuguacuugauguuugauuuccauacauaaaggauugucucauauguuuucuaguuguauuccuaucuuaccuuccucagcuagugugugaguucaucgggguaggaaucaugucuucugcuuuucucuuggucccaacaguacacagagcaaugucaggaucacaguaagccuuuguaacuggugauggugugaugaaugggugauugacagcaucaguugucuuccugaugauauuccuuucuuguguugugacaguaaagugggagucaugcuuuaaugcauauuauuuugaccauuuuucccuguagggaucacuuuauccuuagccacauucauguacuugucucagcccguucacaaagccuucuguuauccucugcaagucuauugucugacuggguccagagaguaaaaauuuccugcuuuugaaaggaagcaaacauugucuguuucaugugauaauuaggaaacuucuaaaaaauauaaaguagaaacacaguuuguagcauggcugucuguaggguuaaugugaaacugguguuucuguaauugugagaaaugauuauauuaauuuagaaauucugcuuagaagggcuauguuuauuuuaauauuaaguauuagucacuucauagguuaauucugaaugucauauaccuacauacuaaggguucaguaaguuuauuagauaugauuuaauauaaauuauaaacucuauccuauugagggaguacuuugaaaauacauugcaccaaucccuaagcacgauuuccuuucuuauuuauugcauacuuuauaugucauaauaugcguacagaaacuuccuucaguacauauaguugagaauggaagaauaucaauuaguguaaguaguaaaaauaucaauaaaaucaaugauuaaauauaguuuggcaagaagacugcuuaaaauuaaaguuacgugauacaaauauuuauguuuuuaaaauagcacaaauuguuaacuuuuauacauucauauauuuauguaaacuuuuaguuauagguuuuaagugugcuguacuuguguauuaaaaacauauaagaaaauggacaauaaaaaccuaaaaugaaaauggauccuaaauguguaauaauaaagauagcaauaaaggcuuuuuuucugggcuauguguuauuccauagcaaggauaauaucuuauuaauuuuuguaauuaucuuccaaucccuaggacugggacuacugugacuaacauuugguagauuacucaguaauucuuugauaagcaaugaaauuaagaaaacucuuugguuuuaaagauaaaaaaacauguuucaucuggucgacuuauaagugaaauagaaaugaucuauccuuagcauuguguaaaacuauguucuaauguugauuaauuaauacauucugguuuuaauuauaauuugauauuuccccaaauagggauuucacaucugucuaagaucacugacuauuaaaauugcaauaguaauuuauaaaaacugcauugacagaaaauuaacuauauacugagggcuuauaauuugcugaauacuuaaauaccaauauuuauacuuaauuaauacuuaauuaccaauuaguauucagcaaguuguaagcucuuaguauauaguuaauuuucuagucuguguucuuguuuuuagauauaucacuagacuuuucuuccuguaugaagucauauauauauauagugugcguagcucuagcuguuuugaaucuugcaucuacaauuauuaacguauagguuuaauucauaguauuuuuuuuuuuuuuuuugagauggagucucgcucugucacccaggcuggagugcaauggcacgaucucggcucacugcaaucuccgccucgcaaguucaagugauucuccugccucagccucccgaguagcuaggauuauaggcaugcgccacccgccuggcuaauuuuguauuuuuaguagagaugugguuucuccauguucgucaggcuggucucgaacuccugaccucaggugauccgccugccuuggccucccaaagugcugggauuacaggcaugagccacugugcccagccaauucauaauauuuuuaaaggugaaaucuuuucagcuuuauaaucaucauuuucauuuugcuuuaguucguucuucuuaguuuauguguugugugcaaaguggcuucaagcuguguguucuucuagccuuggccaaacacccuguuaauauaugucaugaaauuacaguauugguuuaauauuaauuguuaaaaguuaauagaaaaguugcaucuuuaagauacaauuauuuuugaugguuuacccccaagaaaauagauauucagaaacaaugaacaugcuguauaugguuuuaaaugcaucuaacacauuaacauucuuauaauuuuaggggucgaacuggaaaaauuagagugcagagucugaagauuggauuaaugucucucuccaaaggucucuuggaagaaaaauacagauguauguaagaccuuucuuauaccaacaguguuuuuaguaauaauaaugauuauaacaauuuauuggaaacuuaaauuauauaauuuguuaguaguaauaguucucucucuuuuuuuaacccuuacugugccuauaccaaguuagacagaggguggcagugcaaagacuuggggcuuugugugaaauggaaagcugauuauaacuaagaggugaggugccaggauggagugagacccaacuacaaauuauacuucauuuaauucuuagaauaaucccuccauaauguaggcauuugagauuuucauuuucuagcugagaaaauuaaugcugagauagguuaagaaucuagucuaagacugcagagcugauaagggauggggcuagaauuagauacuagguuuuucugacuccaaagccuaaacuuuuuuuuauuucuuuauacuuccaaugcuuaaaagaaaaagaugaacuagaaccuuuacagucauagacgauaauccuaaauaaauauauuuuacagcugugacaaaauaaaacaugauuuuuaaauuuuuauuauauuuggauuuaucaaauaaaucaacaguguuccuuuaccugucaguuaaugaaagguauauuggcuuuggaaaagacuuguguucaggagccaaggagaccugucuucaaaucucuaccacuuaguagcugagugucuuugggcagguuaugugauuucauugaauauugccaacuaagagguaauaguauuccaauuuuacaguucaagaagcugaaauuuagcaaauuuucuucaacugaaaaaaugaagcuaauaauuccugcuuggagaauaauuaggaguaauguuuaagguaccuagaaauagcaguuguugaauaaaugguagcaguugcugcugaguccccaaacccuuaacuacuaucacauaucuuuugauuuauuuuuguccauaaaaugugaauuugaucccaccaugcauauucccagaugauucuuuacagauaaauccauacauuugugggagagguuuagggauauuccaugaauggagagauacuaaaaaacaauaggauguuugauuauaggcccuguaaacugaguuaaguuuugugucuuaugucaacaugcauacauuuuaaaagcuuuuauuuucugggauuucugugagguuauuggauuuugaauuucaggucuagaccaugauggcuuguuuuuucuacauaguuugacaagaaugucagugaaaagaaauguggauuuauauaaaaugaaaagcugauuguaggauuaggagauaaggugcuaugacggagugagagccuaguuagccaugcagaagaaagcuuugcccaagacuuuugcuuuguggcacuuuauccagaauugaaguaguuuuuggaaucauaaucaugaaaagauauaauuucaacagcugaaaacguuaucuuuuuauaaugaucaggaaaggaaaauguuaaugaaaacaccaauguuacaaaauuagaaauggauuuuuuaucaucucugauuugggguuucuugugcuucugaaacaauuaggguucucugaaaguaacaguuauaguguggagcuuacucugaaauauuugcaaauucaaccucaaagcuuacauuguggauaauucaacauuaacuuucagauuuuggcaggggaagcagaaggcucugccgugaaauuucugauauuuaauugaauccaggaaguaugccauuuuagaacuaauuaaauaugaaaucucuuggguuuuaaucuuuaaucuaaaucuuuacugggauaucuagacuuuggaauguccugggguuuuauuuugcuuuuuacuuugaggaccuucaccacucugauuccaguuucugugauaucauuauuguuuccuuuauuagaauuaauauucaagacaguuugcucuucaaaugcaauggcagggccgccauucaagaucauugguaucugucugaacauugauuuuauuaauacaaugcccaaugucagugucuucaccccauaacaccuucuucucuugguccuuuccuaagaauauuccuuguuuaguuucuaacagugcccuggccuuuaugcuuauagcuggcuagcuuccuugccucaucaaaaacacauuuacagaccaggcacagugguucaugccuguaguccuagcuacuugggagacuaaggugggaggaucacuugagccccaggaaucggaggcugcaaugagccauggucggaccaccacacuuccagccuggaugacaaagcgagaccuuaaaaaaaaaaaaaaaguacacauuuucaaaccauccuuuuaaauuaucauuaguaucucuucugugcuuauuuauuagaauuugaguuuuuagauuaugacuuucuuauuaccugccccuuuacccugacacugcuuuuuguaucuuacuauaauguugagaaugugaacuuuuguaggaacuuuuauaaggauuuauagaaauaugucaaaaugucuaaggacacuuuuguccuuauguuuugugaguaguuuuacuuuaauaguggcauagugguauagccauaugccucaaaagaggaaaguugggcauaguugaucuugcugaaaaugugcacuuuucugcaaagauuauuauacauaugcaucaacuuuuauuuacuuaacagaccucuucccagggacugguuuaaaauaaacaucaugcuaagacuacuggauaaauauuuuugucuaugauagucuuauuguuuuuaauggaaagaaauaaguagagcucuaaccaaaucuaagugaaaaaauuauaauaaaaaucaaauuuaucuucauugaauuugcuuucccuauguaugcuuauaauuaaagccauacuucauuauaauuacugugucaauaucacugagcuugguucaguuugaaauuucaccacugacaguguuagaucuagcauuauauuccuuauaaaaagagagaauggaccaggcacgguggcucacaccuguaauccccagcacuuugggaggccgauguagggcagaucaacugugaucgggaguucgagacuagccugaccaacauggagaaacccugucucuacuaaaaauacaaaauuagcugggugugguggugcaugccuguaaucccagcuacucaggaggcugaggcaggagaauugcuugaacccgguagguggagguugcagcgagccaagaucgugccauugcacuccagccugggcaacaagagcaacacuccaucucaaaaaaaaaaagagagagagaaaaugaugcauuuugaucugauaucagguacuguuugaaaauaguuuuagaauccaauaaauauuuacuccacuuucuucuauucuuggaaaaugucacaugaagagcauuuagauuuuaaguacuuuugaauuuuuagaacuugaaaauuuauuuccaaaaaguauuaauuucuauaaugaaguagauuguuuguauuugaaauuucuuccucuuccaaaaguaacuuaucuuaggauauuagcuuuauuguugaaaauaauauauaauuuugaucuucaaaguauuguauauggugaauaaaagguaaaccaagaguggacaaaauagaagaguuuuaauuuuacugaauuaagaaaauuauaaaacaaaucaguuuuuuaaugaauggaaaaaccuaaaaacuguaugaaaauaugcacaaauuuuuaaauuugauuaaauguauuucauuacaugaaguaaaacaaaaauagugguuauagcuaauaaggaaugggagacuggcccaaaggagaaaaaacacaccuucuuguacuuuuuaguguuucuuauauaaaauagaugugaguauaaaagucuuuaaaauaaguuauaauauauauacauuuaguagaauauugaauuuaggagugaacacacaaaguuuguaaacaaaucuguuaaaauuuaaagguuuguuauuuaagguacguuuauuccuuuguguuuuuuuauuuuuuuuugaguuggggucuugcuauguugcccaaacuggucucaaacuccuggcucaagugauccuccugccuuagucucuccaguagaugagauuacaggcaugcaccacagcacccaacuacaucuauuccuuugacaagucaugaaggaagcuuuguuuuggcucauucuuucucaauaagaaggggaguucuuaugaagaucauaaaauuaauucauaugcauuuauuguaucauuuuaaaaaggaaauuugcauuuauugauuuauauuauauaugcaugauuuauguuuauauguauacauaacccauucuugcaggaacggguuaacuacaugcuucuuaaaauaaucuaauaucauauguaaugcagaauauuaagaucagaauauuaaggucauuggaauucaggagacaacgaaucagauucauguccuucugaaauuuuuuuaaucugcaugguucaguccacauuaccaaagauauauuuuaaguaaaagaacaugguagacagaugaaaguuaaccucuugccucucuuugcagaucucuuuaaggaaguugcagggccaacagaaaugugugaccagaggcagcugggccuguuacuucaugaugccauccagaucccccggcagcuaggugaaguagcagcuuuuggaggcaguaauauugagccuaguguucgcagcugcuuccaacagguaagcaugaaggaucacugguguguaggauguguuggcgaaggguuuugaggauguucugagacauggaauagggaacucgggcuggagccaaauacuggaagacuuuggguaccauccaacaagugguguauuuuauuuccuaaggcucauuugcuucaaaaaauagcaacccuugcaaagagacuugcuguuuuucuuugauaaaaucuacaaucuuuaaccugugccauuagauugcuguuuguccugcccuuuuccuggccucaucuccuaccauuccucuccuugcucuccgcuuuccagcugcacuguuuuauuuccuugauuccugccucagcagugccuuuggaccugugucugcuguuuagacguucuuccuuccccauugcccacuaccucccuucucauaccuaaucuuuauuugaucuuuagauuuuagcuuuagcuauuacauccucugaaaaucuuucucugaccucuucagauaaugcuguauuuuccuauuauauucaccuaauaucguccaccucuuccuucucauacucagugcaauuauaauuacacacugaauuauauaauucauggcuuaguguuuguuucuucucuaggaaccuaagcuccaugaagacaaggacuacggcuaucauuuuacuguuguauccugucuuaguucauucaggcugcuguaacaaaauaccauaaacuggauggcuuuuaaacaacagaaauuuauuuucuacaguucuggaggcuguccaugaucaaggugcuagcagauucaguaucugcugagggcccaccuucugguucauugcaaccuuucuugcuguuuccucauaugacagaagaagugaaugaucucucuugggccucuuuuuuuguuuguuuguuuuguacuuuaaguucugggguacaugugcagaacgugcagguuuguuacauagguauacaugugccauggugguuugcugcacccaucaacccaucaucuacauuagguguuuccccuaaugcuaucccuccccuagucccccacccacugacaggccccagugugugauguuccccucccuguguccauguguucucauuguucaacucucacuuaugagugagaacaugugguguuugguuuucuauucuuguguuaguuugcugagaaugaugguuuccagcuucauccauuucccugcaagggacauggacucauccuuuuuuauggcuacauaguauuccaugguguauuugugccacauuuuguuuauccaguguaucauugaugggcauuuggguugguuccaacucuuugcuauugugaauagugccucaguaaacauacgugcgcaugugucuuuauaguagaaugauuuauaauccuuuggguauauaccuaguaaugggauuucugggucaaaugguauuucugguucuauauccuugaggaauugccacgcugucuuccacaauggcugaacuaauuuacacucccaccaacaguguaaaagcauuccuauuucuccacauccucuccagcaucugguguuuccugacuuuuuaaugaucaccauucuaacuggugugagaugguaucucauugugguuuugauuugcauuucucuaaugaccagugaugaugagcuuuuuuucuauguuuguuggcugcauaaaugucuucuuuugugaagugucuguucauauccuuugcccacuuuuugaugggguuguuuauuuuuuucuuguaaauuuguuuaaguucucuguagauucuggauauuagcccuuugucagauggauagauugcaaaaauuuucucccauuuuguagguugccuguucacucugaugauagguguuuuuuguuguuguuuuguuuuuguuuguuuuuuguuuguuuguuugcugugcagaagcucuuuaguuuaauuagaucccauuugucaauuuugccuuuuguugccauugcuuuugguguuuuagucaugaagucuuugcccaugacuauguccugaaugguauugccuagguuuucaucuaggauuuuuaugguuuuaggucuuacauuuaagucuuuaauccaucuugaguuaauuuuugugugagguguaaggaagggguuaaguuucaguuuucugcauauggcuagccaguuuucccaacaccauuuauuaaauagggaauucuuuacccauugcguguuuuugucagguuugucaaagaucagaugguuguagauguguggcauuauuucugagaucuugggccucuuuuauaagggcacuaaccucauucaagagggcuccacccucaugaccuaaucauuuccuaaaggcucuaccuccucguaccaucuccuaagugguuagguuuuuaacauaugaguuuugggggacaaaaauauucagauuauuacauuuccugugccuugaacaucauaacuacuuuaauaaauaucugcuaaagaacugaauuaaaauguccugaguucuuuuuaagacaagauuuuuaaaauauauauacauuaaagauguuauuaaaguaucaguuuuuuuucuuugagacuaugcauacaaaagaaagauguacgaaguuuuauacugaucuaaguuacuaauuugaaacugagaaagcacuuucauuucuuuuuaauguuuacugcauauaaagacauuuuagaaauguuacuacugauguuauacauaugcauaaaguacaagucuacagauauuuuggcaaagcauauccagugauuuaucauugcuagggaaaaaaaaggcucacaccgugucuuugaggagaauugaugucauggguuauuacauuuuauaauggcccuuuuucuuauuuuagaaauacaaaaaauaucaaaugcaaauucuaaauaugauuuauagucauacauguagguucacagaaugaccucaacagcaacaggaggauaaaauugguagauauuuagcuuugcacauaggaaaauuacuuaguauugggaauugaagagggauuggggaguuuuauguaauuuauccugauaaauucugcaaaguacauccauagcaauaugcuuucugugugaugauauaaugggacuagagcaggacacacaaaaaugacagcuuuuauuuagcauuuauaauggccuucaaguuuguaaaauuaucggugagucuuucacaaguuuuuacugucuuagaugaaauuuuuuuuuuuuuuuuugagauauauucuugcucuguugcccaggcuggagugcaguggcgugaucucggcucacugcaaccuccgccucccagguucaagcgauucuccugccucagccucccgaguagcugggacuacaggugcacgccacaaggcccagcuaauuuuguguguguguguuuuaguagagacgggguuucaccguguugccuaggcuggucucaaacuccugagcucaggcaauccgcuugccucggccucccaaagugcuaggauuacaggcuugagccaccacacccggccaaaugaguuuuacagaauuauuuauguaaaaagaugacuuuaaauugagugguuuggguuuuugcuuuuguuucuuucaaaaucugaguauauugaagucuugguauuuuuuugcuucuuccuaugugacaauuucugcuuuuucuacucauaaguucuagaauuuucuugacuugaagaaccuuaaagcauugugacuuaacugacauggaaagaguuauauaguuuccucuucugcacaaauuuucagaagauuaugaagcaacaacacuagcuacaguuuaaaugaaggcauuucuucacuuuuaauauauuucuuuuuucaccagaauaacaauaaaccagaaauaagugugaaagaguuuauagauuggaugcauuuggaaccacaguccaugguuuggcucccaguuuuacaucgaguggcagcagcggagacugcaaaacaucaggccaaaugcaacaucuguaaagaauguccaauugucggguucagguaaggcgugccagugcuggaggaggcuauuuucuguuuccuuuguguaaucucagugguacguccauccuccauucccauucauucccauuuggagguuugcuuucuaaauaaaugguauguucaguaugucucaucuaucuaaaaguagcauuucuuuuuauaacuacuacaugaagcauauuuuauuauuguugcuauuauuauugucauuuacacuacuuggaucagaaccagagauuuuuaugaaugucuguuuacuuaggucacagaaaugauucauccaugaaaacuguauggcugauuauaaauauauaacccugauggaauuugguaaauauucugaggucuuggggucaaacuuaguaagcaggaagcaauguuuaauuaccagcugagaaguaaucaaauuacuuuguguuauuucugccaaguuugaugugaaguacauuaacccgacuucuucccaugaggagcacugcuaaaugccauacuuuaauguaaucagugugucagacucuucaguuugugaccccaaagccgacagugcagagucugugguuuguccuaagguggacauuuuuggacauccugauccacuccucuuaacauagguaugcauuugaccucuugaauauauuauauuucucuacuggggggaaucuggaaaauagccccaguuuaauuuggaaaucuauuaugaaacaacauaagccuacucaguagggaaauucaagauuuugugugugucuuuuuuuauuuauuuuuugagaccaagucccacucugucacccaagcuggugugcaguggcacgaucuugguucacuucaaccucugccucccaaguucacgcgauuccccugccucggccucccgaguagcugggacuacaggugcaugccaccacacccagcuaauuuuuguauuuuuaguagagacuggguuccacuauguuggccaggcuggucucaaacucccgaccaugugaucuguccuccuuggccucccaaagugcugggauuacaggcgugagccgccauaccuggcccuauguguaucuuuuauucguaccagaagaucaaguaccaauacggugauucucugagggagagucaaaucaggagggcugggauugguuguuguuguauauuguaucaguauuaguaucuugaauuaaacagaauuguuuucauuugacugacuuuaucagcauaauaguuuguacgaagcauaucauugcauucucuguggauggcuaacauaagaaaugaaaauucaaaaguucucuucucucaugcauuaugguguaguugggaagacuaaaguauugugaggucagagggccuugcugcuaugcauucuaagaggaggaaaagacagguagguagugugaaguagagugagcauuagccuggcagacagcuaggguaauagaugacuuccaguggaagucaaagcacaaauguuggaagaagaagaaugguaaagucacaguuuaaaugcagcaggguucuuggaauggcuacauuuggaguaucugguagacauagauguaugggagagggaauagcuggaauguggcaaggucagucuacuacugggaagauaauucaaaugagagauguagucaucaaagcuaauaaucacugcuauuuauuguuuacuuuaugccagacaaugugcuaagagguguuauauuuguuauuuuagucacuuuucuuaauaacucuguaagauugggaguauuaccucuacuuuacacauaaaggaacuaagacuccaagauuagucaacuugcccaaggccaggcagccgauugugcagagacaaaguuaggauucaaauccagaacccuuugguuuuccaguuuguguucuuaaucaagaugguuuuaaaaagcagauuagauuuuuaggagagagagauuuaauauuaagaaguaauuaaaugguauugaaaagagcaauugauuuaaagcacuaauuauuagaccaaaaauauuacucuggauauaaacgguaaugugaagccaugggaaagauccagauuaauugacuugggaagagacugccauauauagauauauauaaaaucugccauauauggccauugguauaaccuagagaugccaugagggaccauguuucucagcaucugauggauguagagagugaaggagaggauaaaauacucuaaaaacauuaaauauuugaaugaccuuuaaaguuucauuucuuaaauuaaaaaugaccugaagcaacuauguagaauauuaagauuuaacugaguugugggacauggauguuuauuauauucucccuacuuuugaauuaacuugaaauauuuaauaagaaaaauaugaaagagcaauuauaaagggugaacaaccugaaguguuaaauuucaaggguuuaaguuucugcuaguacuaucaaauugaccuguaaaugucucuaugauagagaugugaaguugaccagcaggucagagauuaagguuaugggaggauauucaggagauaguguauugagaaguagcucuggagucaggcuacuuggauuucaauccuggaucuauuguuuggugcugagacuuugaauaagauacuuggccugcuugaaccugaguuucuucaacuucaaauucuaugaguguuuccucauaggaauaguuaauacaugaaaguaucuagggcaguuccuaucacagaguaggcauucaguaaauguuggcucuuuuuguuacuaccaauaacaucauuagugugauaguagcuaaaccuaugaguguguuguugaacauuuccauuaaguggaaaugccagaaaaaccuggacaaugauguugcucaguaaaaggcaagauuagagagagguauaauaagggacagaacaggauucuucagagaaauaaagacgcauagugugcuuuagcaagaugguagagguguuaagugcaucagaaagauucuuugaaucagaagucauugggaaucuuagagaggauucuauccgugucguuauaaagauggcucaggaaaauacauaggcgaauaugugcaaacaacuuguuuaagaaaucuagcuauaacuuaaaauaugucaggauauugaaaauuggaagaugguaagugauauauugucuuacuuuuacuugcauuuauauuuuuccuguuuucuacauugagaauauaguacaucuaaaauuuguauuucgaaugagagagaaauauguccagacuugauaccugguuuaggcacaagagugagcaagcaaagguuucuucaagcuaauggugacuuaauuauugcacaaagauuacacaugaagggaaugaauauaagaacaauuccaauaguaaaaugggguccaguuggaauaggucugauuaguuuaguuguaaagagaugcaucuuucucuguggcuucagagaaugaauggaaagacaaguacagaaauaaagauagaggaauaugucuauuauagaauaaucuuaacuucauucagacugucuuucuaucaagcuucuacccaagauauauauauauauauuucauuuuccccgaacuuuuauaaauacugcuagaguuuuucacuaauuacuuccaaauaaaauguuaaugaaaucuuagauuuacauaauguuuuguaagcugggaauuguuucaguuagaaucauacacaauuccuuaauaguaguugcauaaauaaauuagaacuuuaguuuucuuucuuguaaacagagugaagguagguaauccaagacuguucucugugaccaccugggcccuuagcucuguuuucaugcacugucaucccuaacauguggcuuccaucuucaaagucacuucaugcuaacaaagugacucuucuggaugucagauccauuuuccaguggggaggaagaggcagcaugccucuucccagcuaacucagucccuugaaauuccaauuagaacccccacccaauaacuuugguuuuuauugcacuggucaccaacaucagcaagagaggcuaagaaacaguaauuuucucaaggcucauugcuaaaaugugcuaacaguacaaggguauguuaccaaugaaaaagagagaauggcuaucugccaagggaguauucagcagaaaacaaaauuucauuuagaaagaagaugucagucauaccugucaagccaugcugauaagccaagagaugucguuaguguaugugauuguuucaaaccaauagccuccuuggcaaaaguaagcuggcuguaguauaugcagaaugauuuccuuaagauugauuugcaagugauuuuucaggucauuuuagaagcuacucaguacuuaguaguuuacagccacacaacuuuuaaauuuugcuuccauuuucauucuguugguucuaucauuuaauuuuuuuucuguagauguggguauaauuuauguucuuaguucuaccagcaauucugacagaacagauuucggagaagauguuuuccacucagacccauagaaacuuaucgucuaagguuuugcuuuuguaaauaagauucugcaaguacaagucaaugugcagugucauucuuacgccagagauuuuaaaacaccauuuccauucaaggaugcauugugaucaaggcuuuauuuaguuuuuccuuuguuacacaguauuucuugauuucuuuuuuuucuagugacuaauuuaaaccaaauauaaaagugcucauuguugaaaacuguaucuuugugagggaauuuuaaaauucauuucuuauuggugguauaauugauauuuuaaaauuugauguuucaacuuaauagauauaauucuuuucuugccuaucauuuuccauucguauucaaacauuaaaagaaaucuucugacaugcauauuugucucccucucauguauaaacagauagaagcauguuucagagacuugaacuccaaaauuuuauauuuuauuuuuugguaauucggaugaaugaaauuucuuaccacaaauuuagacuaaaugauaguaaugcaagccaauaaauuuucuuuuguuuucucuagguauagaagccuuaagcauuuuaacuaugaugucugccagaguuguuucuuuucgggucgaacagcaaaaggucacaaauuacauuacccaaugguggaauauuguauaccugugaguacuaacccacuguuuuguuuuuaauacauugccauugaauuaacuaguaucuaaaauuuuauuauuuauuuagacuuaaucuuuuuugaaaaaauaucacuuugaagauuuuuuuuuucuuuuaaguaaacucauuuauguugaauuaauuagugcagaaaaaaauauuaacuuuuuuaaauaucuguguuuugauuuuaaacuuuuuugguagcaaauucuuuuaagagcugauacugaccuacacugaaaaugauacuauguaacgaaaaaucauguuucuuuuagacauauuuaugcuuucauaguuaaauaccauauucauauuagcaaaauacagaaaauggagauauuaaaaauauaguuccuaacucuagcuccugaauaaacuaccuucuaauuuuuccauaucucugguuuuaagauucuauuuauauuuauauuuauguaucuuuuucccugauauuuuucacucgacauuccauuucgucacacaguguaauuuuuuuuagucacaaaauuuuuaauugagugaauuacuacaguuuaccuaaccauucccugaaauuuggacauauaguuuauuuucaauuuucugauguuauaaauaacacucuuacaaguaucuuugugaggguagcucauuccagauauuauguaaacuacauugcaauagaauaaagcacuauaaguagguuauuucagucaaugaauauggguauuuuuuauggucaaaauacuugaugucaacguuuuuuucaaaauagguuuaucccaauuuacauuauuaucacacuuuguuaaaguuucaauuuuacuaagccccaccaguauuggacauaaguucuuguuuuuccuuugauuuacagcuauuuuuuccugaaguuauccucauguucuauuaauagcuauucuuuuacuuccuuccaaauaaugcccaaauguauucaucaagcugucuauuuucuuugguuuagggaauugaguuacuuuuuuggaucauaaauugacagaaaggcuguaauacuuauaaaauauacacauauaaaucucacacucauagguaucuuaucucaaauaaauaagugcccuguguauggagaggaaaucuguagaaaauauugcugaauuauaauggaggaagugcccacaucacauuauagcuuuaaccaggaaaaagaaaucuccccaagaaaauuugugagacaucauuuauuacuauuaucaacuuauucacucaacaaauuaauauugaacauuuugcaggugucaggcccucuugucaaagauaagcaaaaccagacacuaguuaaagugguaaggacagauuuuaaucaauaauauacugauuaugcacauguauuucuguuuguacagaggugacuggguguuuucagaagggaauagacuggggaaacaaaagagggacuugagcagaggcaaggaagugaaaaaugacaaagcauuggucagcaucaguuccaucagaccagcugugucugugagcuggcaauugucagaguuaggauucuaccauuccagagagagacugggagacagggguccuauccuuccugaugauuacauuucaaagaaaugguuuucagauccuugagaaagacacuccugaguuguuggagauacauccacaucucaaagggacagaggaaggauuccccauuguaaacccuuuccaguaaaugcccuaagaaagagugagcagggaccugucuucagguguuggcuagagugaacaguaaauucuuuuggcagucuggaguuuguuuuucaggcagacgcuuuaaggggucagacgccuuaauaaucccuuuuuuaagggucauccuagggauguggucuugaacuguuauaaauuauguucauguuuguuuaagucuuuuaauggagaaguggguggacagggauggacaaaaugauuugugcugaaaauuugcagcuuuuauaggccaaggcuucaguagacaacagagcuuacaggaggccaacucaaauuuggucaaggagagaauccuugucaguaauuucagcucugauaguguaucagaguauacccagaaagauaagauuguggacuuccugcuacucucccuuuaggaggaagaaugugugagaaugaacaaggaaacgaauaaaugggguuguuauacauugcaguaagugccuuuaaggaaaugaauggauaaugagauagaaugauuagaagagacauuuuagauaaagaaaucaguaagguuugucugaguugacauuugaguugagaccaaaguuugagaaagauucagcccuguaaagaacuaguagaagcauguuucagaaagaagaaacagaacauauaguggucugaguugggaaaaagguuagcgugauugggcugcagaaagugaagccuguuccccaaggggcgcauggaaaggagcacugguuacacaacuggaagugcccagugcaaaaugaaacuggggggccccuuguuuaacaauuauuaagacuuccgaguuggcaacaucagaggaguaaaugaaguucaaagcccuucugauuguagggcccuguacaacugcauaagugcaauaguucaaagcccuucugauuguagggcccuguacaacugcauaagugcaauaucuuugaagcucacccugaggcugggaaagagguggguguaaccagggaacagaaagaaaccaggacaaauuugacaaaagagagacaauaguaggagauggaauuaaaaagaaaggcaacuaucagauuguauagaacccuggggaucauuguaaggaauuuggauugggggaaaauaucauaguaauauuuacaugaauagcuauuauagaaguuuagaaaacugauuauaaaaugcuaguaucaaaauaucauaaaguaaauauauguuguuauaguaaagauauauaaaauuacuauuuuucuuggucuugaacauauaauaauucuuaauggcuuuacaaaauaccuaaacaauuugaaacccacauaucuucaacaguugucaugcaguaggugcauacuuaagaaucacugauacacauaugaauuccacucuccaacuaccaauuuuaaaugaaaucuguaaguuacccaaaacuguucuuguugcauagucuuucaaaagucacuguuuaucauuuccaagauugcagcuuauccugcauuauacaaggauagcuucauuuuucaagacauccuuugcccauuucugaggcuuuguagugaucuuaucaacagccuacuuauaaaucaucuguaugacaggucacuuucugcauuugacccuacaacuuuuuguaaaauaacuagaaauauauguaaauugaaucuuuaaaaagauacuugcauuuaauagcaaugaaugaucugauugcuauuauuguagcauuaaugucuuuccauucauucucugaagccacagagaaagaugcaucucuuuacaacuaaacuaaucagaccuauuccaacuggaccccauuuuacuauuggaauuguucuuauauucauucccuucauguguaaucuuugugcaauaauuaagucaccauuagcuugaagaaaccuuugcuugcucacucuugugccuaaaccagguaucaagucuggacauauuucucucucauucgaaauacaaauuuuagauguacuauauucucaauguagaaaacaggaaaaauauaaaugcaaguauucagaaaucauugcuuucugaaauuucuuucuguucacccacauucuuuacauuugcucuacucuuuuaaguuuuauuuaugguucauccaucuuuuacucaacauuuccuaaagucguuucaugucugccuuagaaaaugaacucaagugugaauuuguuugguacagugauaauaagcaacacuugaguguuaaauggaucagaccuucccauauggaccuugauguuugcauuccucagacugcaucucccuuuuuaguuaagaagaugcuccagucaccuuacugacuucaucucuuuccuuuucaaaguccuuuacagcugacucugaauguuucuauuuuuaagagcuuucugcaauuuagaaaccuuauuuuaaauccacaaagcacccuaaauauuuugccaauauaucugcuuaugauuuaugguaauguuuuccuuuagcuguaagaagacuaaugguauaugaaugaacuaucaugacucaugaaaguauuuuaugauauugauaauuuauauauguauauauaaauuaucugaagaaauguagcagaauuuuuauuucucuaggaaaugauuuuuugucuuauuucccccuacuauucuauaauccaaauuuguacauuuaagaauucuuucauuaggcuuaauaagaguugaucuucaagagacagcaugacacagaugauauuuaaugccugucaucauucugucuccauauguccaaaucccaccuucucacaaaaacagcucaacucccacuuugugugugaaaucucucccagcuccuccaguuuuacccucaucaaagcacuuaguucaggggccucugccaauagccucuacuuuaccaauuaggauuugauucuauguucccuuguaucauuuucuaacugugguguuuuugucuucucaauuaucuuuuuaccuccuugaggacugggaugacuuuuauacuuuucucccuguguuaguuaaauuugccucauaaaagccagaugagcucguaucugacuuuauaaauacuaguuauagaauauuaaagcuggaauuaaagcucuaagagaucaucuaacuuaucuuuauuuugaagaaaaaacuaagucuuagagaagguaagugauuugugcaaaguuaaugguauggauuuagugacuuaacuccauuagggaaauacacacacacacacgcaguuagcacauuggaaaauagggguuuguguauauccuugcuggaauauuauguuuguugaauacccuuuuacauaccaggcauuuugcuaggaguuggaaauagagagaaaauuucaugaaggagaaaaaauaccucuauguggagaaauucaacaagacuguaauauuuuuuagaaugauuaagcuuaugaaucaagagaguagucaauuuuuuuuuguauuauccaugcauuaaaccuuugaauucagggauuaucauuuuuuaaauaaauaguuauaucuuauauuaaagauguucagauuuaaauuucuuuuuuauuuaugaugauuuaauuucaucgugaaaauuacccuacucagaucuucuuuaaaaucaucuuuguuguaaguaaccaaaauuuaauucaaauuagaaacauuuucauauguuguuagagcauauaaaagauagugugugguuuuguuuuuugagaugagaucuagucuguuagugaauuucaaguguauuaucuguagccacaagcuguacauuaggucuccagaauuuauucaucauauaacugaaaguuuauacccuuugaccagucucuucucuuuuccuccaccccccagccccugguaacuaccauucuacucugugcuacuaugagcuugacuuuuuuuuuuaaaggucccacauauaagugagaucaugcaguauuugucuuucuguaucuggguuauuucacuuaguauaauguccuccaggcucaucuaaguuauugcaaaugacagaauucccuucuuuuuuuaugacuggauauauuucacuguguuuucuuuauccauuuuucuguuguaggauacuuaguuugauuccauaucuuggcuauugugaauaaugcuacagugcacauaggaguauaaauaccuuuuggagauaaugauuuuauuuucuuuggauauguacccagaagugggauuacuggaugauaugauaguucuauuuuuaauuuuuuaaagaaccuuuagauuguuuuucauaaugacugaaccaaagauaguucuuuaaguuggagaguucuucuuuaaauuucacaugauuuauaaaaguucauacaauugcugacagugagagagaaguggauaggguuaaauacuaaggauaauggaaaauguuuagaauagcuacuagggucaaucuugagucacacagagaugaguaaacugauugcuaccuugccacuagagugcagcugagguuaauugacaaggauuuguaguuugugacuccaucauugcucagcagcuuuggaauuaaaagaugaaaaguauauuugaaggccaagggagugaaaaauuccaagguguuaaugauacugugguugauuugagguauccucaugcugaagaaaucccaaggugggauaaagggcuagacgucaagaugauggggaaagaagagguuuauuuauaauauaagaagugagaagaagagucagaagauuccagucagugaaagauuuuuucaaguuagagauuuuggacuaaaagugguuuuaaguuaugaugaggccugggguauggccauaccccaaugugugacugaagugggacauagaagguucuagaaaugagauggcuuuuagaaggucaucacugcauuucuagaagugaagugacagaugauagcccugucuggcguugugccaucaaaggagaggggaagggcacauuggcuuuaguagaugaagcuaaggggaaaaggguguguaggagaggaaaaaaauaucuucuucccaucuuaguuucauaguugaggcuccuguaacaaaagacagauuaacaagagaaaagcauacgaauugauuuaauauaaauuuuacauuauauggaagccuucaucaggaagagaagacccaaagaaacggaagccuguguauuuuuaugcuuagguuugaugaagaguggacaguugcguagaaguaugauugaauaagaagauacgaccuaaugcuaaugaacuaggcgaacuuagcaaggccuguuuguucagauucuuuucuguguccuucuguuuucagugauaaggauguuucuucccuccaggaauaaggagggcaccucucaaauaagggucuuaugacccuuuagggaagaaggaugggagaaggucagagagaucuugcuacgucugcuguuuucucaacugccaaugugccauauuuggagguaguguguccugaacccuugccaaguguaaacauccuuuucucuugguuguuaugaaaaagagauuauacagccacaaaugaaaaagauguuauaggaaauggcauuaucaugggagcuucgggauugauucaaggagauagguugaaauacuaauuaugaacaaaauguaagguaauguguaaaagaacacagaauccacuguaauggagaaagaaagguagauagauaggcuguaugcauauagugagguacaguaaccccauccauggagagaaaaugugaaauagagcaagguaauggaggaaauaguaaaaggaaagaaggaggaaauaagcaaggaaagguuagccaggauagaaagguaguuugagagacauguuagcugagggagaagagacaggauauuugcaaaauuuuguagcuugaaaggucaacagcaucagcuacuuccagcauuucaauugcaaggguagauucauugucaaugucauaguuuaguugcugagcuuuacauaggacuaguuuguacugguaacuuugaugaguuuagugagaagaggcaacaacaggaaaaaaauaccucaaugagaaacagcuuauuaaauuaauaccacucaaaacagauuuauauugcagguuuuaagcaaauacaguuguuuuaaaagcaagagguucaacuguauucuuguugauauugauuaauauguagggaaauaaaccaaaauuacauguuuuccaugagaagaaucauauuuucagugagaagaauuacaauuuucuaguaaaaaauaucgaauuucuguuuuaaaagauaaauugugccuuuuuuuuaugaacuauaugccauuggcaaaaauaaaacacacacacacacaaaacacccgaaaagaacaaagaaaaaaaucuagaagcaguuguuuugaucaauccuuuccaccccugccagcaucaauguacuucguaagacuauaaaaaucaaauauuuuaaaaaugcugauucauucuuuggaaagcucuaccuugaguuaggguaguuuguuuuuuggcagucuugucucuucagaugugaugugggguguuugccaauauacugaaaacgcagcaucacggcuguuucucugaccucagcauccugaagugguguuucagcuccugcucuccuuacaucguuuuaccaguagguccagugcauuuagauuugucauuagcuuuuaaggugagguuugggcaaaauccauuuuauuuuggaugacuuaucaucccacugauucuugacuccuugguaauucugcuaaugcuaauuuuuuuagcuucauauauuuucauuagggcuugaaagucucugagcuuuucuuacugauugcauccuauccauggcauucaaaugugucugaauuucaacuuguugaaaucauugaaacuuaaauaaaaacugagagguuguuuuauaguuaaaaaaaaaaaaccuguuaagaauaucuuuaaaauaagucuugugauaaugaaauguaccgcuuagcaguaugcauguaccaguugggacuacugguuucuauauuuaagaaguaacucuugcuaaugagggugcuguucaacaaugauuuuagcacuugugcaugauccaaaugauaauguuuaauuauucuguuugcgugccaagugacuuuuuuuauauaaccuugauuugccucuuuguaagccuuuguuuuccucuguauguaacuuauucauauuuguaauuaacaauuuaaauccacuguuuggagcauuaaggaauuaguuaauacugauaucucaaguuaagaagugacuccccaaaaaaaaguuguggggagaauuaaaacaaauauuuucuguuuuguuuuguuucuuuauuugugguucuuuaucuuguuuuguuuaaauuguuugguaauuagaaguuauuuacgggauuuagguuauuugguagcauuguaaauagcuuccuuucauguguugcuuugccggucuuuggggauaauaauaagaguccuuugagcugaccuaguaaagccguuuauucaaggaucacuugauuaugaauacugggggaaggggguuagcuuuucuacauucuagauucuucuauaccuuauccuugcugcuucuugugauacauauuagugaaaagggaacuuucagccauguauuaaugcuuuugaaguucaguagugcauagauuucagcauaaaguaagauuauacaguuugcaauaugaacagggacauauagaaggauacacaugcauucauauagagauauacaaacucaagcaaaagauagaguaacucuaaauuauguuccaugugauguaucuauauuuguucucugucaaggauaaaauggaagaaaauugaaaauuuccuaacuguauuuugguugguaaaauacaaucucaaaaguaaaaaauuauuugauuucgccuuaaaagugauuuuguuuaggguuuuucuuuaggguuuugcuacagauagauguaucacaggguacauuuuauaauucagugauacuuuccauauuuuauuuauucauuuauauuaguugguggggaacaaguaaaaaauugauuaauucuuauuauacagguaaguuuucauuguuuuacggcuacuuaauagcaguacaguggaguaaagcacauuuucagaauucacaugcccacuuaucuguguagguucaguucuaaaauguuuuucacagugagucacugucauuagcuuuccaaaaaugacaauuucaaggacagcccuaauuuguacaugugaauuuuuaugugcuuguugaaaaucaguccagaggcaucuggggaagauggugguagcauggcaucagaguuuuuuuguuguuguuguuuuauuuuuuuauuuuuauuuuuauuuauuuauuuauuuauuuuuuugaaauggaguuucgcucuuguuguccaagcuggaagcaauggcgcaaucuuggcucacugcaaccucugccucccggguucaagugauucuccugccuuagccuccugaguagcugggauuccaggcaugugccaccacgcccagcuaauuuuugcauuuuuaguagagacgggguuucaccuuguuagccaggaugaucucgaucuccugaccucgugauccgcccgccucggccuccccaaagugcugggauuacaggcaugggccaccacaccuggcccagaguuuuuccaugucuuuugccuuugccauuuuccuuccauugguaaagcaguuacauuuauaaagagacauuuguaaagagaauaacuagacagcaaaacuaaaacguacaauguuugcaaccaaacuagaugacaagagagauccaaaauaaauccagguggcgauaagccaccaccagccacaaaacguacaagacaucacugccuguaugagaggaaagacaaggaagugagggugccuaagaaccagauagcccccaaaauaggcaacagauauuuaauggaaagcuggcuugagagcagagcuaaaccuggaaggguuuugccaugcgcagaggcuaggguaaaaaaggugugacauuucuagaaugcucuugccugcugugagcucucagacuggacccaucagggcuuccuucuagaaagaaggucucaugcugagcaaaacuucugggaauagaaucaauauggagcaucucaaggcaacagaaaugaaaggagaaggccuaguccaaacuguuccuacgugcugguagaggguaugggggaacaggaccaggaagucucaaacucaaguacugcuaugaauggaauguuuaugucccccaaaaauucauggguugaaaucuaaucccuagugugauaguguuaggagauggggccuuggaagugauuaggucaugaggauggagcugucauaaaugaaauuaguacauucauaaaagugaccccagagagcucucucuucccuuccaccaugggaggacgcagugagaagacggcuguguaugacccaggaagcagacucacuggaccacagaucuaccaauccuuugaucuuggacuugccagucuccagaacugugagagauaaaucucugcuguuuuauuuaagccacucagucuauaguauucuguuauagcagacugaauagauugagacacaugcuguaauuguaaauaccacacaaaagcaaaagaagaggaaucucugugaaguuagaaaagcucuccucaaccucauuuuguuauaaaaguuuaggaaaauuaauuauacaaccaaaaaaaugagcaacaaaaguaucaagaccaaaucucauauaaaggaauuuuaagaaaaagagauaaggaacaaaauuauaucacuacaaauaaagcaugccaguguaacuacuuuaugaaugggaggaaaauggaaaaguaaaucuauauuuuaauguuuucacuaaucaugugggugguaguauugguauuaguguucuaagacuauuguguacguaauaugauaaaaagcaaaugaauaauuaugggauugucuaggucuaucaucucuuguguccuugagaaccagauuuuugguuuugaaaaaaggagauagagguguauuagaaaacaaguuaaguuaaaucagaaauuugaauuggaaucaucaauguaacuucaagagaaauuuuaccuucaaaugcauauuucccagcucugugcaaagaaaaagccuguuaacacugaaaaggccuaaaaggugugcuuggaacaucuuguaauaguagcuaauaaggaagcuguugaagacuguuagagucacauuaaaaguugccaacugaacuugaccuucaauaaugagaauugcaauagauugaaacccaucaaauacauuaaaaucucaugauauuuaaaaugaacaaaagcauugaucaucuuuggaaaauaauaggaaaccauuucaugauacugaaaauuagucaacacaguaaaauauuuauccugacuuuucuaaaugaacuguaccacagaguaccuaaauguuagacauggugauguuucuuuauaaaaguauguauuaggcagggcugucuagagggucagaacuaauaggauagauguauauaugaaugggaguuuauuaaggaguauugacucacaugaucacaaggugaagucccacaguaggcugucugcaagcugaagagcaaggaagccaguuugaguacccaaaccucaaaaguagagaagccgacagugcagccuucagucuguggccgaaggcccaagagccccuggcaaaccacuggucuaacaguccaaaaguugaagaacuuggaguuuauguucgagggcaggaagcuuccagcacggaaaaagaugaaggccagaagacucagcaagucugcucuuccaucuucuccugccugcuuuguucuagccauacuggcaagugauuagauggugcccacugauuagaugguacccaccggguuugaggguguaucugccucuccuaguccacugacuaaaauauuaaucuccuuuggcaacacccucacagacacacccaggaacaguacuuugcauccuucaauccaaucaaguugacaguauuaaccaucacaaaguauuccaaguaauaaaugaaaaaugaaugauagaaugacaccauuuugcaauucccaaugaauggauacggacacuuagcaugaacagcugcuaagaucaccuaagagaggugacagcuauuaugugccuccuauaacacugccaaauaccacuaauugucuugacaaaagucugcugcauuaucuggaucaaguugcagauuuguaggagguuaucaagaggacagacgaaaguacugagcuguaccaaaaauagacauucuguaaaauccagacucuggaaaacucugcaggucaaauugccugaguuuuccaacagacaaacuguagggaaauggcagguguggaggagggaccuguaaauuaaaagugauuuaaaauaugucagauuuuuuuuuaauaagcaaaacaaauuaaggauagacauuggagugauaaaacuauuuuugaaacauaauucaaguuauguacuacuucaaaaaaugaaguugaugguaauaauggagaggggaagaaaguuuugccuggaagcggcuucucgaaugugcagcaguguuccauuuucugacugauaauauuucauuaagccauacuuuuuuguguauauauuuuguuuuacuuuaaaauaaaaagaauucuaaaaauaaaucagucuagucaccaaaauuuuacaaauggcugucucuggauggucaaauagcuggcaauuuuuauuuuauuuuuauuccuucauguauauuuuauuuuucuuucuaguuguacuuauaccaaacguguuauauacaccauuuaaaucuuuuuuaaguagcugggacugcaggcacgugcugucaugccuagcuuuuuuccuuuuuuuuuuuuuuuaaauuuuuuuuuauagagaugggguuuugccguguugcccaggcuggucucgaacuccugaguugaagcaaucugcccuccuuggccucccaaagugcuggcauuacaggugugagccacugcauccagccuauuuauaaaaugacauuuuaauauaauuuuuuagaaaaccaaccacauggcaucuaaucaguacauuauuuaaaaugaaggacaaauuuaggaugcaauauuagauauuuuagucaauggcuauggauucuuucccuuucaaaacuuaaaacaguuccauuuuucuagaagcagugacauagucuuguaaaaaggcucaaguuuucaagaacauuuuuuuccuuacugaacuugguuggaguccaucaaaggcuuagugugaguuuacuuaggcuucaaaaaccugaugauaaucuccucagaggccaugaugguuaaaugagauugaaggaaaacaauuuauaagguacaagguccuaugcuaaccuguuacccuuguguuugaucuaaugggaucugcaaaaucuguucuccuuuucuuacagaaauaaacagaaaccgaaucuuccaagaaaugcauuuaaaauguuggguaauuuguguaguaaugauuguuccuuucaauuuuaucuuucuaucauaauaucaaaaguuauuuccuuaaaaaaaagaaaaauguauuauaccuaguguaaaggcagaguugaguuugauuauauuuauuaugguaagugggugguucucuuuuuucuuucuuucuuuuucuuuuuuuccaaaccaaaccauuacuuuagcauuuuaaaauagagaaauauuagguacuacuauuauauaauaaaaaucaaauuggaccaaguauauauaaauguuuuaacauuucggugcaaaaauggguuaaauucacuuuauuggcucuaucccagcugaagaauuacauucugauaaccugaauauaaucccuaauuccuugggaugaauuacuuuucacuuuuucuuuuaauauugcauaaaguuuauggcaauaaugaguuaaugcucuuagauuacaacucuuugugcuagcuuuuccccaaggaaauaaaaauaagcuauuucuguguguguacuaacuuuuaaaaacauguaaauaugaguauuauuagaaacucuaauuucaauaacuacuauaacuuuuggggacagcaaguaguuguuuguuauuuugugcaugggauagaaagggguuguuuuuguuauuggugguuuugcuuuggucuuucaugucuugaaaauauuuagcuaaagaauguaugcuguggaauugaacuggcacuuuugaauaauuugucauuuuuuucacaagcaagaguucauguuggaacucaaauauagauaaacuagaagaacugaugcuaaguaaaagaagcaagucauaaaagaccauauauuauauuaauuuguuuauaugaaauguccagaauaagcagauucauagagaaaauagauuaaugcuugccauggguugugggaggcgaagggucauggguacagaguuucucuuuggggugaugaaaaugaccuguaauuagauaguggugauuuuuuuuaacuuuaugaauucacugaaaaccacugaaguguaaacuguaccuuacccuuucugaggcacacuggguaaggggccugaugccuugcccaccuggccuuuccucucacccacucacuccacucagggcugugaauugaagaccuggauauggcuugaaaaccacuggccuaagagaucaaaacuuuuacauugcuagguauggaguuuacucccaaguaaaagcuggaguccauugcuuauuaaguauuucucuauauuaacaguguacuaagaacagacaaagaaauaaauugggucauaaaugcuuauucuuauacacggguccucuuuaugcauuucuauuauggaaacuucuuuuuuuccuuccuuaccaagacauuuaggguaagcauaucucuacacuaaauuaucugcaguugugauaaccauugcaaaagaugugaaaaucguuuauaguagaugauauauccuuuuggcuuuauucugagacccagauauugcuucucuaaaaguuuccuuauuugcucccaacuacaaucuguuguuuuuuuuuuuuuccuuuucugccugguaagagcugaauacucucaaaccgucagaucuuauaacaacccuuuuuucuccacaggguuuccuugaauucuuuuucuuuucaugaauaccuuuuucuucugcacuuuugcuuugcauuugggaagcccuauauccauauaacugcagaucauuauguaguuaauauucaguuauucaggaaaagaugggucauugugaaucugauggcaaagccuggugauagcauggggcuggcaccuuguugcagguuguuuguuuugucaguguaaaaacugaugaauuuuaaaugauaaguagcugcggcuuaaucaugucucaucucugcuuugcaagccaagagaaucaaaaguucccuuaauuauugacuagaagcagacauguuuugauagaaggggaauggauagaaaguggcaaaacuauauaaggguuaacucagaacuuaguuguuuucaaaaauaguuugguuuuuguuuuuguuuuuuucaauuuuugguugggugcaguggcucacaccuguaaucccagcacuuugggaaucugaggcaggugaaucacuugaggucaggaguuugagaccagccuggccaacauggugaaaccccgucuacuaaaaauacaaaaauuagcugggugugguggugcgcaccuguagucccagcuacucaggaggcugaggcacgagaaucggcugaacuugggaggcagagguugcagugagcugagaucgugccauugcaugccagcuugggcaacagagcgagacucugucucaaaaaaauaaaaaaaguuucugucugcaaaacaaguuucugugaguccugggcaugcauguugugaaggaaaagcugaagggcagggacagggagcaggcagcagguaagcaaauauacuuaucauucagugucugugauuacaagaaaguuucucucuccuucuccccuucuccuccuccgccgccuccuccuccuccuccuccuccuccuccuccuccucucucucucucucucucucuuucugucucuaagaggagggagugagguauaaugagugguagguugagcagccaaguuggagccagaggaucaugggcuucauuaaguucugugcagguaauguaaauauuuuaaaugcaucuucggaaggaucacaguugauaucuguauuguaaauagaaacuagaauugugauauacaguagaaaacuggggcuuggagaacaauaguucaugggauaggaugauggggugggugggguugggauaguguuaguccauaucacccuaaaugauuaucaaacuaaucauuuagaaauaccuaagggaacagugacauuuuauaccacuauuaaaaauguaguucagguaaaauaauuauaugucugcauaguugggaaaggacaaagaaauugacaguauuccuucccaaacagagcaccaauguggcccugcucuuucucucuuauuuauugucuuaccuuuuuccccacuagaauauaugcuggcuuguguguagccagcaucggcucuaugacuaauuuccauuaacacagcuugguuaaaaccauugugguuaaaaccacaauacucugucaucacuauauuaauagcaaauugaaaauuuuuuuagugauaagaaccagccaauaguuuggaaaaauuaguuuggaaaaauuucaaaacuaauuauacuuuuuggcccaaguuuuaaaauauuggggaaaugaacuagguaugguuuauuuucaacagagaaugaaaaaguauaaacauaucacuggauauauuuagugaugaguucuuauugccaaguguuuucaugagacugcuuuauuucaaaaaugcauaaaacuaccaaaacuguugacauuuaauugcaucaauuuacaucggcucugauuuuguuauagauaguuauugccuuccauuuuacugagagaaguguaauuguuuucaaccuuauagacaacaucuggggaagauguacgagacuucacaaagguacuuaagaacaaguucaggucgaagaaguacuuugccaaacacccucgacuugguuaccugccuguccagacaguucuugaaggugacaacuuagagacguaaguuugauuuuaauauuaaaucuagugugaacauuuauaucugauguugucuuuuuuauguuaguaacacaagagaaauuguuuaauaccaacugcauuuuagaggagguaaauuaaacuuggaaucagucuucacaacaugaauuuuuacaauucacuuuugacaaugucacagccaaaauuucaauuuuaaccuugcacauguccuuaaauuuuaaaaauauguauuaauaugucaaccuuaauacacacuggucaucucuuuuguuggucaucucuuuucuuuuuaaaaacacuuaaaguguggcauuauauagucuuucauuauuuauuuuccuuuuuuuccccuuaugggggguguuuuacuauuucucagaguauguuuuauacucuuuuugcaucucuuuaauauaaauuuauuaauaauacuuaaucuguugauucagauauuuaugcuaaaauucuaaaguaucacauuaugauucuaaucuauuuuuuauugaaaaugaagacagcaaacugagauagcuuuauauauuacauaaaauagaaaaaauuuauucaaaguguauaauuugaguugguuagcauacaugaaaguuucaagauggugaaauuaccaugugauuauaaagcaaagggaauaagaauuuauggccugaagugaaaagaaaaaaaauguuuuucaaugacccagaaaaaaugcaaagaaguaauuuuaagauacuaaacaauuauguguuaagauccaaauagauagauuuuaaaucuuugaauugcuuuuucauaugucaggauaaauauuccugcuaaggccauuuucuugugguugaaucuuggggaaaaugaacuuuuauuacuaaucaucaacagagugcccaguuguauagcauaaugaaguucuagucagagaaagacaccgucucagaugacuagagaagagaaacucaaaagugugaaguuuucuacuuuauaaaaaauagagaaaauuguaguaagaaguauaaaaaaugucaagugcaauuuuugugaaaugaaacuuuagccuucagauucauaguucauuuuauuuuguacaugauagaaaaucaggaaguaguaauauuuuagugcuuugugauagucaaugucucaaacaugucaaaauagaagaauacaguauuuggucugcagaccaaaauagauuuuuuuaaaucccuguagaccucaaacuuugcuaaauuuauguaccaguuuaucucuuuuauuuguggaauggcuaagaaauagaagaaagaacacagccaaagcauaggagauaccuuuuucccucuauagguaaugucguguguguguaaacagaaagaaauacaaugcaaaugcauauuuagauagguccauguauaacacauacacauacaaaagguaagaaaaaauuucaacugugugauuacugugcuugauaucaaacuguguacacuuaagauauauucuuuccacuugauaucaaacuguguacaauuaagaucugugucuuucuaaacauucuuuugcauaguacaauuuagaaaaaguuuuaauaaagcaauuucaauugaaagagagcuguucgaauacauucaggaacaguagacuuuugguccucuuuuugauuuguggguaugcuuuuguccuuuccuucaaaagguugugugauaauagauucuuauuugucuuaguaucuaauauauguuuaacugugcugaugccuuaggauaaagacaaaauuguacuuuuuuuguaucccauccaguuaaccuuuggaauggauaauucugaggcacagaauuauuacuuggugcuuuaauuuacgggauaauuugauagguuugaacuaagcgaugugccuuuuaaucuuuugcuaaaccauuggcauuuugcaucacaaauaucuacacgcuuuacaggaaucaugcagauagaugcauauuuuauacuccuuuaaaacauuuuuaauuugccuuucaaugucaaaauaaucauuggugucagucauccuauucugagugacucuauuagguaaaaauuaacagaaaagcaugccaaauaauuuugugcugugauuuugggguguaauucugaaaaugccucgccucaauucauucaauugaaaaugaauuuaugagcauuuuuugugagaggaaaacaagagaaaaaaaggaagaaguguaagcuugcaucagaugcaccaagauccuuuuuggacagauuuaugaacuacuagauauagugggcagguuuucuuuuuuuaauccuagaccaagcucucgggauuugauauaguucacuuuucggcugagcccuuucuaguacagggccgcuuaaucuucugguguaacaauuuaugugaguggguaauaaaaaaguuugauuuuguuuauucuccuauuugugggaggagaacauuggagaaaaaccagcgaaguggcaaauguguugaaguuauuuaugaagcuaauuagaauuuucuuuugcuucuuucuuuuucauccuugcaaaauguagcauuuuguccucugcccaguaguuacacaugcaugcauggaggaggggauuuauggggaaaaugaguuauuacuaaaagggaguaaacaaauccaugcuaagguuuauucgauuaauuuuauaacuaugcaaaauuuuccagaaaauaaaucaauaaaugaguagaguuugauuaaagaauacuccauugaaaauaaaucugaggaacaagcuaaaauaguagcaaaaguaauucaaggguugugagaauuauuauuggcuaaagagauagguugguuucccuaaagauuaaaaaaaguaaaauagacaccucucccugguauugguuaaaggggaguaaaugaguuuaaagauuuuuuuaagagccuuugcuauagcaagaaacaaauacacuauaaguuuaacuacaguugcaguuaacauccgacuagaaggaaguaugacagccaaguugagaccugaaagauuaauagggcuaaguaugauguguuugaugugggagguugagagggagaguuucugguccaaggaagcauuuucaaaagcuuggaggcaagauaguuucagaaacugggguggaaaacuaucaacaauggcaagaaauggcaguggagagagaagauggaaccauauaaugaagggccuucuaagccaugccaaaguguuuggaguuuauucugagagcaguggggagccuuugggggucuuugaguaaaagcagcagggaucccacuuacccugcucuggagcaaauggauugaagaaggcagaagacaaagaacaaggaagagucuaaugacaauuuaaggcacuaaaagggucauuaaguucuucaaaaucuggguuuuauauauaaaaccauuauauauauauauacacacacacacauuguauauauauacacauauacaauaaauauguauauauaguauauauacacauauacaauaaauauguauauauuguauauauauguauauauacacaaauauaauacauauguauauauauuaauauagcauuuuauuuauauauauauauauauauauauauauauauauauauauaucuuuuuuuuuuuuuuuuuuuuuuugagacgggguccaguucuguuucccaggcuggagugcaguggcacaaucacagcucacugucucauugcagccucgaccucccaggcucaaguguuccucuuuggaaauuccuaggcaguaugugaaguuggugguggggggggguguccccccagcguuaagaaugacgcugaaugaucuggcuccagacauaagccugugagucaagcagaacaaguuuucuuguaucaguuuguaaauuaacuucugggugaaauuuucagccucccaagaagcugggacuauaggcaucaugacaccacgcacagcuaauguguuuauuuuuuguggagauggggucucauuauguuaccaaggcuggccucagacaccugggcucaagugauccucccgccucagccucccaaagugcugagauuauagguauaagccaccgagccuggccuguguuacauuuuacaugauacuaagugauccucuugccucagcuucccaaacugcuaggauuacaggcacaagcuaccgaggcuggccuggguuacauuucauauaauaucuaaguauuuguagcagagucugcuuucuggaauauuagugugugauugacaaaaucaccuguucagcccccaugcuggagagcagggauaggcugcguucugaagccugggcuaacacacacauuguucuuauuuccaaggcuuuguaaugauagguuguaacuaugcaguuucuuauuuucuccuuucagaauuaaaugaaaaagcuuaucauuuaaucuuuuuuucuacaaaucaaaauuuucugaagucaaugaagcccaagguuugacuuuuuuaucucuauuucuuuuuuuagaaauuuuucaaauauauaacaaaacuugagaaacccuucaguucaguucucuacccuugccauucucauuuuuuaggucauggaucacuuuugugcuaacuggauuaaguuagcaagaaccagucaagcaauuugacagagcuuucccaagguugauuaagacaaaaaaaauacacacuuuucuucuauuugaaguucguggcauauguuuugcuacacuugaauuuuggaaauaaucucuuaagcaguuacuguuuuuagaaaguauauagcauaucauucaccugacauuuaacauauucaggguuaaugaagaacagugacguggaaauaguauugacuaauacuauguuguuuuauuguuauuguaucuauuuuacacauauguaaauuaaguuuacugacaguauagauauucugacaaacagucuggauaaaugccugguucugcagugagaacacauggacacaggaaggggaacaucacacaccggagacuguugugggguggggggaggggagagggauagcauuaggagauauaccuaaugcuaaaugaugaguuaaugggugcagcacaccaacauggcacauguauacauauguaacaaaccugcauguugugcacauguacccuaaaacuuaaaguauaauaauaauaaaagaaaaaauaaauaaauaaauaaauaaauaaaugccugguucugaaaauagaucugaagagucuuaguuuuucaucccaauaagauaauguucaaaagucuuugcugugcaggcaucaaccugcacuucacuauaggagaugaagagaaaaguaggcauuauagauaccuacuuucuuugucuaaguagguauguauaauagaaauaggagaaucaaggaguuuuggaauaauuuuguuucaaacacuguuagcuuuugcagacuuuuauuuaauuaaauagcuaauuuucuuuguacuguaaauguucuacauucauuuacucuccuuccuccucaaaaagcuaggguuggaacuagcuuuuaauuaggaucaguuguuuucaaaaguauuucauggagacuugggaauucuuccuaggcaguauaugacauccccagcauuaagagugacacugaaugaucuggcuccagacacaagccccugagucaagcagaacaaguuuuuuugcaucgauucauaguuuaaacuucuaaaaaacuuuuuuuugaagaaaauguaucaugaucucaggaaguugccuucaguguuauuuaugaugugacauuuuuggugggaucuaggggugguaucuagguugcauguuuguucaaugugugugugagguugagguauuuuggguacaucuggguuuggauguuuacauuuaaaauuacaugaagaacagaaaagucuaauuuuauugcaccucugccaucaacauauaauguaguguuucauuuuuaacuucaucuuucuaaccaaguuucuucucuaggaaaaacaaaaauaugauugcaucccccuugguauauuauagaaugguaucuuuacauuauucuauaauuuugaguuauuuuugagcauucugguuuuuuccccaguaugacuguuuaaagauguguuugcuauccuugaacaaauauccuguaauaucugugaaaaggccccugcagacucuugaauacacggcgacuucucuagaauacacugugacuucuguuacuuuugauuuccccaugguggcucucagggcaaccacauauaugagcggaagauaauugagaaucuccccacacccccacugcuuuugucuuaaauugcucuaaaguguuuguucugugacuuuugucucccucuccccucuuugcaguccuaucacacucaucaguauguggccagagcacuaugagugaguauucauagcccacgugcaggagagguguucugaucagugguacuagcaugggggucuuacuaaacucuuggucuaaaauaauacuucuguguuccggguaacaauccuaguggucuguuugcauggcagauucauuacuuaaguaaccuaacauuucuaauaguaacaccuaucaauauuugggcauaaaauuauugcuuuguuuuuuucuuuuaaagccccucacaaucuccucaacuguuucaugaugacacccauucaagaauagaacaauaugccacacgguaagaaacuuugaucagagcccuccacugcacugccacccagaauguaucuaugucuaauuaaucuaauaucauuaauauaccuugauuuaagaaaugcaguuuugcaggaguuaugauuccauuauauuuggaauuugggcucucauauuuucaugacacaguuugcacuuuaccaaacaccugcuauauauucuaugaaaaguaaaccuaaccaggaugugauucuccagcuaaugagaauccaaacacuguacaagcaggauuuagaugguguaaccaaguuucaguaaaugaaagugggauugcagguauucucaggagauggugcacaugugaauuacaauauguaauuaaauuuaugcuaaugcuuuaggauagggguuuauuuuagagucucuaaauaauauauaggcuggucuugauggugugcacagacuuucagaaaagugguauauacuaggugucugugauucuaguaaguagcuuugccuagaaagguuaauucaagcaucauaaaaaugguaacauuugaacugggucuaggccaacuagaauuucuaggggaaagucuuggacuaauggaauaauauacucaaaagcauugagcugggaaagggcaugguuuguuuacugaacugcagguaggggaaagagaaauagaugagaaagugaaggacacagaaguugaggucugauaaugaaaaacccagccacugaagaguuggaucauguccuuaguugaagggaagucauggagaguuuuuguuaugagaggaacaucauuuuauuuguuugagaaugucacgcucacuuagauguagaccaacuagaggguuaaggaaagccuaggucugggagcucaauuagaagauuaggucaguuaggagacuuuacaacauggcguaagauaaaggccuacaggcauuaaggcaguggugauagaaagguagcucaacaugaaacguuuuaguuuuacagucguguuaggagauuuggaucuuucuauguuuugucagaauuuugacaauuuaaaaaugauuaaggauguacguccaauugaccauguccuauauggccauguugucuaaccuccuuauuuuuauuuugcagacuggcccagauggaaaggacuaaugggucuuuucucacugauagcagcuccaccacaggaaguguguaaguaaaucaugaaauuagugcugccugggaaggcuaguucuuguauuauggcugucagaaacaaucuucacugauguggcucugaaucuugaucccaaucaaaauuauuaagugugguuccaaaaauuucuacguagauuuuaugcuuucaaaccaugauaguauaaacucaauauguuuauuuacuuuguuucauauaaguuaaugaaaaaaaucuuacauuugucaacuuauauaccccacgaaaaucagauuguuuuauuuaggauaacagguguauauauucauuccauuugucuuauauuucuuauuaauuuaacaaagguaauuugacagaauaugugcccuuucugugaaauccucuuucuuccacuagcuaacauuuuuuccauaauaucugcauuuagcaccucugacccacacauacuuagauauauacuccuacccuucauugaaaacuguuaacuccucugccaauauuuuauuuuauuagcaacuaagaaaagccucauugacuuuagaauacuaaaaagauauuauauacuaaaaagcuuucuagccaauuaguuuauuucugauuuccccauauguguauauuccacuugguuguggaacuuucucagcaaauauuuuaucacugauuaucccacuauuguguguacucuuacuuuuggaacuuuuuauucuuuuuuuugugcccuggaauucacauuuuuaauccugaauaauaucuaaaagacuaauacugucaagcuuaugugacuaacaaagcucuauugugguuuggaucugaugggaaucuguaaaguagacagaaaaguugucaaacauaguaguuggguguuuucacuaaaaaaaaaaaaaaacuauggagagugcuagguuaaaauacuuaaagugcucaaauauagaauauucucuuuccauauuuucuaaaacuuguuuuauuuauuaugguuauaaauaaaaguuaucaggagguuuuucaauuucaaauuucaaagauugcaucuuaauacuugacaguaauguaguagagauuuauacauuaucauucauguacuaugagugugaaacaauucccaaaucaaaauaaagguguauucauaauguuuguuucauauuuaaccuacuggugugcauuucauguaaaguaguuaaguaucuugaaucuuuccuaaaucaacaaauuuccucaaggcugaccauagccaaagcguuaaaggaaauaaaagauaauaauucagaacaaaaucuuacuucuuuaaaauguuuugucaugcccugugaacacaguaaagguaaugcucaaauuuaguauauuguaucuuaaaauaggaauaaauacuauuuucagauuuagcacuguuucagaaaagauuaacauuuuuuaaaaagaaaagaaaaaagucagaagauuaacagucagauacauuuuaauauacugucauuauauauauuaacucauucacccauccaacagacaguuguuauuaauauauaccuaccauguaaugguaugcuggagccaauugugagagcugauuguuacauuuucaggauguuuguaagcuguuaaacagagccuuuuuaaaaauaauuuauauacauguauauacaguuacaauuaaauaaauuagauuaaaacaaaaacaaaaguaauucucaaaacucaucacacccuaaugauuuuacuucauuucacuaauaucuaugcccuugggauuauuuauuauaaacuuguccauccugcaacccacaggccacauguggcccaggacagcuuugaaugcagcccaacacaaauucauaaacuuucugaaaacauuauaagauuugucugugauuuguuuuuuguuuuuuguuuuuuguuuuuuuuuugcuuuuuuagcucaucagcuaucauuaguguuaguguauuuaauguguggcccaagaaaauucuuauucuuucaaugugguuccuggaagccaaaagauugaauacuccugauucauuaucucugucaggugguguacaaauguguaucuuuucccaguuccacauucagugaagucaugaacuugaaauuggccaugaucaaaaaguauuuaaaucacagaaguugcaaaugccacaaaucaaggucuuuuucucuuggagaaccuguuaaacauuuaccaacucacgaccgccaugcacccaauacugcaauaggucuauagaugcagauacugucuccaugaaucuuauaggcuagaaaggaaauagauaaguaguccuaccagaagaacaugaugaaggcauuugugguaaacagaaugauggccccccaaagauguccacauccuaaucccugaagccuaugaauauacuacuuuacuuggcaaaagggacuuugccacagguuuuuaauuaaggaccuugaaauagagagauuauccuggauaauccagauggccccaguguaaucccaaggguccucauaaaggguaggaaggagagccagagucagagaaggagacguagcaauggaggcagaggucagagagagaucugcagaugcugcuguguuggcuuugaaaaugaggaaugcaggugaccucaaggugcuagaugaugcaaggaaacaaauaaucuccuaugaacccuaggaugggcauuauuaugaguccuauuuuauaaacaaggaagcugacauccagaaagauaaaugacaugucccugaucacccauauaucuauuacaauuagauacaugaguacguucgauugacucuggacaauuuaaaaggaaauugauguuacgaauacuacauaucuuugaaggaaaaauugagcagugacaucucaggacaggauaggacucaugacgguucuggggaaucucagaagugggaacgcaaggacaauuccuugggccauggcuaucaggacgucucacuccaucugccaucugcccuugggugacacuggaaagaaagaauggggaggcugacugugguuuacacaggcauugcaguuugcaaaucugaaaccuagaacagaacaauccuuaaaagaaagaaaaucauuauuuuuauuuaugucuugucuacuuucaaaaguucauugaaugaaucacaguuuuuuugucaucugauauguacuaauuuuguaaucuagauaguguuuacuaugugugacuuaacuguaguauaauuauauuccaucuaaugauauuuccuuggugcaaaccuauuauuuuugcaacauuuucuauuuuagcccaagacauacgauugauguuuaaugucccugaucugguaccucauguucuaucugcauuuaaagaguuuguuauugguuuuuacuauauguaauuaagaacuagaauguaucuauuuuuauauucaacauuuagaccuaauaaucugugaaaaacacuuaagacuaaaauuguauguuuuauauaaaugauuguuaaauucuuauuuuugugaaaacugccuuaacucucuuccagauaccauaaugaaagaaugcaaugauaguggggaugauaauuauaauaauguguuaaacucuaucagcuuccccagagaagugaaucuauauguauguugacaacaaaaauacaucucaaaucuaauuuuggcugguuucacuauggauagucagucuccaaaucuuuaaaacaaaaauuuacuugguauuaauauuaagcacugaaguuaauccaugaggucaggugcuguaguaaauguucugagggcauaaugguggcuugugaucuuggaggaacucuacgccaggaucuguggucaaaucauggccacaagaucagccacauagcuuaaagggauccaaguuuucuuuuaauucuuguuguccuuauauuaguucuuauuuuaagucuuuucuuuccauauuuauuauuuucuuuuagguauguuauugauagguaucauagaacuaauuuuuuguuuguuuguuuuguuuguuguuuuguuuuguuuuugagacagagucucacucugucgcccaggcuggagugcaguggcacaaucucagcucacugcaaccuuggcuucccggguucaagugauucuccugccucagccucccgaguagcugggauuauaggugcccaccaccaagcccaacuaauuuuuguauuuuuaguagagaugggguuucaccauguuggucaggcuggucucaagcuccugaccucaagugaucugcccaucucgaccucccaaagugcugggauuacaggcgugagccaccgugcccagccaacuaauuguuuuuuuaacuaauauuagaauaaguuuaccucuauuuuuaucguaacaccugagauuaccaucuacuuuaguuccauuuugcauuauccuugcucauucuuucuuucauaugcuauguggacaaagugcuuugccuguacacuugaaugaccugccuggucauauggauggauagguuaggacuguagauauugcuccauugucuuuggacauuuaauauuauggaaaauaggaagcuaaaccuuuuuccaccgcugaacaugauuuacuguuuuauuuugauuucuggcagauugcuugugauacuuuaucuuuaaaauacagacauuuuccagggauacauaugaaugugcuucuuuuguuauuauuauuuuuggguacucugucuuuauaguuucuauacucagaucuuuuucauccugagaaaugagaaauauuuacaggauguucuacugaacucuuauuuugcuguuuuauuuuauaucuaucuacuauaucuuuacgcuuuguccauuuguccuauccauauguuagagcugcucuuuugucauguuuuaucaccucucucuucacaugaacuuggugaggugccuccaggcaucgcugacuuugcauuguguaauucacugcagcucauugguguccuggugguguugagacauuagucuuacagcuugcuucugccccggauaacacagcuagguuuaggguguuggccauuuacuuccuaugaggaaaauauacacauacacagacccauaucucccugccagucuguuugauuuagcuacaugggaaacugaggagcuuuuggauugcuuucaaaugcugcucucugcaguggugcaguacccauacucucuucuucucguccuucuaaacccaggaacaagcaugggguucuugcagagguuccuucauucauuucccagugaugcugcguuuucucaggaaagggaaucaaaggauaaugccgcagcuuacuucaauccuuaacccacugguguuccuuauuuccaguugcuaacuguguuguaagggucccaccccauccucuuuuaaaauuuauuugauaaaagcaagaaggucagguuagguacuuauuauuauauuguggccuuaaccaaaguauaugaccuuuauuuaaauauauauauacucacauacacacauguucauaucuauaucuauauauuucuagagggagagaaaaagagaggggguuuauugaugaagaaagcaaaauaaaucaacaaguggcacaucugaacuuuugcuuuggcuguuugacaagcauaauaccagaacguucaguuuucucaauugcuucaucuagcucucugaucucaaugcuuaggauaaaccuuuucuaggaauucaccaacugucugauacaauuucaagucccuuccuuguuagaguaaacugcaguaacaccaagaugaauuuucaaaccagaauuacaaguaccagaggucuuccccagcaucaaguguuacucaucagcucaagggcacagguaaucucaaggcucuggugaagcugagagaggcccaggacugccagcaccacacaccagguucuuucuggcugcaacaggaugcugucugacuccagaguaacagaagaagucucuaagggauguucgcagcccccaucgcuuacacaggaaggagcugcuucagucaugagauagccccauuugacacucugauagcuacauaacugacaugagguuuuccugcugcccuauccuguaaagccaucgauuuccaggacuuguuuaccaaaagccaucaaaacggaccacgugccaucugcuaauggacugcccugcuaguauuagccaggagauugguauuugcacauuuauaagaucucacuggaucucucuuguugaaagaagauaagaaauuccgagucugcuagaaagcauuuucuugccauaaauauaucaacuuuguuagacauucacuuaugucaguuacuaauucaaccacguuacugcuaugucuaguucauuagacagguaguuagauaagugggagaacccacaugcauuaaauguaguuucuuguucuaaugcagagugaucaacccuaaaaaugaccugcuaauaauauaaaguaaaauaucuguagagacauuauaaauaucuacaauuauaauuugugcugagcuauuuaaauaaaagaacauaaggauuauaaaccuugucauauggguuacaaagcauuucaaaguuacuuucaacgaaauucuaaagacagugaagucagaugauucuuaauucaguagucuuuuaaucaacucuuuaggcauggaguaauugauuuugucuacaguagcuuuuauacuaaaugcuguuccuuauuuuuguuuuuucugcugaguaagauaucccuucugaaguuuaugagauagagcuguuagaugaaagagaagccugaaauguugacucauguaauauccaugcucugcuagaugaacuucuuccuagaguuuuaaaagggaggucauggagacacugagcucuaagacaaacuuggcccagccacuauccuguccaucauuauuucuacuuccuuuauguccaaaaacaucaccauccagaugugagccucugggucuguuuccuuugucuugcuagggaagacgagcacgcccucauccagcaguauugccaaacacucggaggagaguccccagugagccagccgcagagcccagcucagauccugaagucaguagagagggaagaacguggagaacuggagaggaucauugcugaccuggaggaagaacaaaggugugcuaggccugggagaaggaaauaugucauccuuucuuuuguaugaauuucacuguagcccccauuuauucucuuuuucaagacuauugucuaagaaaucucaguggagugaaaauuuuagaggcuauuaacaaacugggaugcuggcugcaauacagcagcauuuggggguucauugaugaugucuacugggacacuugcuuaaaacuacaauuuuauuccugcaugcucauccugcuauuaauacacauuuuuauauaagaggaacuagcaugagcuaaauuugaaccucacagacgauuuuggagagacgauaaugcacgugguagucauucuguuucucccucuuucuguauuagaaaucuacagguggaguaugagcagcugaaggaccagcaccuccgaagggggcucccugucgguucaccgccagagucgauuauaucuccccaucacacgucugaggauucagaacuuauagcagaagcaaaacuccucaggcagcacaaaggucggcuggaggcuaggaugcagauuuuagaagaucacaauaaacagcuggagucucagcuccaccgccuccgacagcugcuggagcagguaggguguguagaauucagcgucacaccuccccaggccaucuguccacugcccugggagaugaugguccaggugucaggagaggcagagaaguccacuuucaauuucuuaccuccguaguuaauucagacuggcuuagaaauuuccuuuuacauguaagcauauaaauccucauuggcacacaaaaauguguuugcccagcuuacaauggaauuucccagucuucuuuaacaaugaaguccgccucagcucugaacuguuugagagaaaauauccuaugacauauaucuuccuaaauuauacaugggaagcaucuguauuaaggaacagcaagagaccugaaaucggcauucuaaagcuuucuuccagugagacaagaaugcugacuccaagaaucauuauuuucuauucucaagaaauugaguuaaagaugguuauuaauuugcuacuauuauuuccuaacacuggaccauguuuuaugggaguugcuugcaagcuuucuggaugauaagaaauacaauuuacauuaagaugaauacaugcauguauggagaauacaaaauaauacuugccuuuauagagaaaugccagcucuuauuuucuauuuucccuuucuuccucccucccuuucuuccuucuguuuuucuuucuuaaugcuggucaggaccuacuaaauugauucuauaacucaucgguggguuauugcauucaguuuugaaaaacacuguucuuugagauauaaaagaagcaucaauacaguuucugccuuucuggugccugccaucuuguuagagaucacagcaagauacuuucauaugugaagacacagcacacuguagggaauuaagugcuugauggcacauaguaguuaggaauaggagugaugucucagaaguagugauggagagaccuuugcagcaggugcagagagcguagagucccagcacaggggccaagagcuccucucucuugaagaaucccugacaucaacaugcaugucaucuuuagucuuuuucucuagccugugcuguguggagcuccuaugugauauaauaggagugccuuucuccagaaaugauuuauugacucaaagcaggaacaacuuucucuccagugauucucucaaauuuuagaaaacugccuuuucacaguugcucucagucuuuuuaacuuaccagaauaauucaaaacagugucauuucugccuuaccuacacagaaauuuguguaggcaauucauaauuugaccauacacuuuucucuaugucucucaguguuucagaauuugggugaggcuguucaauggaaggcuuacuucagggccucucaaucccacaauuuggaaaguaagaguuucccaagagugacccaagacguggguuucuugaagcccuucggaauguuugagucuuacuuagugccagccacauacauugaaaacguuacauuuuucauuccgcgaacuugaaguuuccaaauggugcuguguaagggauggauuuucucuugcaaucucuuguuuagaauaugaaguguuaguguuaacaacuuagugcauagguggaauugcuacagaaggaagcugugcucaaaaccuuuauuugccauggcugguugaugcccacaggagagcaaaaggcuuuucuguucacccuugccuuccccuacucccuccaucccauuagacagugcugccugauggcucaugugccuugagaaucacauagcaaugcuuuuagagauagcuaauauccaaauggcuucuauauccaagacugcagagcucuuaucucuucuaaacaauuuaggaugaugaaugcuagaaguagauggaaaauucaacucuaauaguaaaaacuagcagaacuaccaggcuucaacuaauauagauuuaauggaaaaaucugcaugaaaaacuuguaacaucugcauucccuauaugauggcucacacuuucuaauuugaccauauauuugucagcguauccauauugaagauuugcgugagugccuuuacgaaguauuuacuaagugucaggcuguucuaaccauuuuagaaauagucauucuucacuccccucacaaaacucuauaacacagcacuauuauuacccuccccauuuuacaaauaaagaacugaaagcauggaagguucuacaguuuucccagaauuacacagcuuaugaguggcagagugggaauuagaauccaggcaaucugaauccauaaucaugcuucuaaucacucucucaauauugccuuggaguaugagcugauuuugaaauuggauaaauuuacuguauuagaaacccagugcugauguuuaaaauaugagugaacuaugcuuaugaauucacuuaacauuaaaacaacagaaaaauugagggauaaaaaugguguugauaaaugagucuggcagcauaaccaaguggauucuucaagguguccaagcggaaagagaaggaccaaagcccccaccaagcugaugcuaaaauguauggaaaacaucugaaggcaaagacuucuauaugauuuaauuauccauggugagggcggggaaguuaaaaaggaaauguuuuuccuuaugauuauuugaauccuuucucugcuuuaaccucugaaugugguuccagccugaaucugauucccgaaucaaugguguuuccccaugggcuucuccucagcauucugcacugagcuacucgcuugauccagaugccuccggcccacaguuccaccaggcaggucgguguccccagcacacagcuccucugcugagucugcuuugugcuuugccauuaguuuguguuuccuguuaaguaacauuccuacacacuggugccuuaggaaguaaaagaguuuuuuguauuuggucuuaaauaggugcaaauccauuucaacaauaucaaaaagcaaacauuuucaaauaagcuauaauacacuuguuuauauaaucuguagaaguggauugaaguuuggaugaaaaagccuccucugcccuuuagaaugagcaagaaauuaaauuauuugcuuaugaaugauuuuuuuaguacacuuucugucucuaaaauguuacauuggugcauauucaggacuaauaauauuacaccaaacauuaugguuguaucugccaagguguggaaacucauuuauucacuuuucuucguccuaguccacuuagacauugucuugccugucccaucagaggcagcggucccacgcagccuguccuuggucacaauggggaccugucacugaugcuaggaaggacucaguaaacuagguguuaaccaaugacauuuuguuaucaauuaaauuaaaauucuagaauuuuacugagaacgauauauuguaaccaaauuaauuucuuggugggauaucuuuugguacauuaaccagaaaaaaauuaaaauauuagcuggaugcaguggcucccgccuguaaucccagcucuuugggaggccauggugaaaccccaucucuacuaaaaauacaaaaauuagccaggcgugguggagcacuccuguagucccagcuacucgggaggcugaggcaggagaauugcuggaaccugggaggcggagguugcagugagccgagaucgcaccaaugcacuccagccuggugacggaggcuccaucucaaaaaauauauauauuaaaauauuaagauuauuuucauauuuuuuaaauaagagaacuaucuugacuauggauuauaggauaaaaaacacauccuagugaaaaguaucuuaaauaagaugccuuuacuuuuguggcaggauaagcuggccuaagcugaagucuccaaaaagaaaggaggacagaaaaagaaauuggugaaauuuuuuuuguaugaaaacauaccuguggugcaaaaauaauagauuucucauucaaacacugaaauaauaagaccauauuacuuguuuuucagucucauauuuuucaguccccugguguguggauucuuucuacacaaacaaacagcuaguacgugucaauuauguaaaauuauauuaccaacacucaagcaaaaauguuuuggguauauuccccuaaaauuguccuuugcaaugggaaaucuuuucacauugauauuuagaggcugguuggaguauuuccuccugaauuuggguuuuaguggaaggcuagacauuaauuugagaagcuuuguuguucucuuuauuugcugucacagcgggagaggaccugcuggccccaccgcacgacaccagcacggaucucacggaggucauggagcagauucacagcacguuuccaucuugcugccgugaguaugaaagauugcagcaccacagcugcacguguuccuucccuuucucuuuuucugcaugcggcccuucgccuucuuccuuaagauaacaaaaaccuuauuacaaacaggacugaauauuauuugaaaauaaggcaaacauuauauaagaaaaugaagcucaaccuagauacuaucaaguaacggggguacagucgcaacgcaauucugcucuuugagauuuuucaauaugccugaugggugauaaaaugaaagcaaauaaaauaauaagucugguuuuaagaagaaauuauccucuucgaugcaagcuaucauaaggaacacaucuuaguucaaagaagagcuuucaguggcaugccaaacaaggcauggaaacagccuuucuaguguaauucccucucuuuucuucaaacauuguucuccaaugucaucagacuccagugcagaaagggauuguuuucagauuuucccuuuuuauucccgcugguuucuuuucucauggaauaaaauagucauuguauaaaggccaaacaauuuaagucaucauagauuaggauccugugaaguuuccaucugaacaaccaagagccagaaaauaaccaaauuccuggggaaauuauauaauaauucuuacuuauucauuuuuuccaaguguuuugucuucagcaccuugccaccuugcaauuuuggcugagcucucaccuaaaacacuucugguguuucuagcagaauauauacauacaaguaaacuguauauauguauacauauauauacacacacacauacaaauauauaaaugcauauaaauuacuuaguacuauaauuauauuuuaaauaaucuuugacaggauuugaagacauuauuuguaauuuuagagagauuuacucucaaacugauuuuaaauccagggcagucacuaaaauaagaauucauguaaagcauagccucuuauuuuacccuugucugucaucuccuuagaaaaugccaucccaggcugggcacgguggcucacaccuauaaucccagcacuuugggagggcgaggcagguggaucaugagaucaggaguucgagaccagucugaccaacauggugaaacccugucgcuacuaaaaauacaaaaaguagccgggcaugguggcaugcacuuguaaucccagcaacucaggagguugaggcaggagaaucgcuugaaccugggagguagagguugcaaugagccgagaucgugccaccgcacuccagccugggagacagcgugagacuuccucuccaaaaaaaaaaaaaaaaaaaaaaaagccauccgaaaugaugaaaaagagauuaucaauuaucaggaguguagguaaauaagauauauugacuucauuuaaagauuauuauuuacuguauagaacuuuguaauuuuuaaaauaccaucauuagcagaaugugaaaacagcuauuuaaaauauauuucuggcccaggugcgguggcucaugccuguaauuccagcauuuuggcaggcugaggcagguggaucacuugaggucaggaguuugagaccagccugauuaacauggcaaaacccuaucucuacuaaaaauaccaaaaaaauuuuccagguaugguggcacaagccuguaguuguaguccuaccuacuugggaggcugaggcaugagaaucgcuugaaccugggaggcugaaguugcagugaguugagaucaugccacugcacuucagccugggcaacagagacucuaucucaaaacaacaacaacaacaaaauaaaugaauaaauaaaacauauauuucuuugugaauuuucaggaauauuugccugaagauuauauuaugguuuccaccagcacaugaauauaucuauuuguguuuugccaguguuucccagguuuucauuuguagaucuacuauaaugcuucucaaaguuugcagaaucacauuuacacuacaucagucuccacacccaccuccccaccuccccaccccccaaagcacaugcaugcaugugcacacccauauagacacacuuuuggcuuuuagagucucacaaaagcuuaagaggaucacugaaugcucacaugcuaccagauuguugcuuauuuucuaggcucuguaaccacaguaauagauaaacugauuaaaacuaguuuauuaauuauaauucaaggucaaauuuauuuagagguuuugauuuucaauuguuauguuacuuagugaguagauaaaaucucaucauagucuuuaugagccagaauuaaauucuuaaaggaaauuacuuuuuaguucagcuuauaccuaaauaaccuuaauaauuaguuaaaaacaaauucuguacaucaaagcuguuuagaaguuuuuauuuaaauaucauggacauuuucaauuguaaaagucaguuggcagugacagccaggaugggaaauguguuucaauauacaccuuguaauauauauaaaauauauaauuuccauauuaaaaauuuuauucuaaaaaugugggauuuuuuccaaguuccauuuccuaaagaauuuacucuuaaauuuuucucaaaguauacucugacauccagauuuuacaaaagcuggacccaugucauuuuaaaacagaacauuauuaaaaauaaauaaucauaauuuagagcaaaaaugaauuguaacagguaaauguauguaucucuuuuuauggccucacuuuaaaggcaaguauaaaauuccuauugguuggggaucuuguuagcuguucauugauauugguuucugagaggaguauacacaguaccuucaaugggacccacaucacagagauucauccucuccccugcauugguccccucuucaccaaugucauucucaguguucagagagugguuuauggagcccugagauuccuuaauguuuauuaagcuugagucacauucgucaaaaacucaaaaccuacugaaaugcaaugauuuccuuuuaaauauguuuguauguaaaauacccuuagccuucuaucugauaaaaagcuguugguuuaaaaguauugguuuggagcagcuggcuucauguuuucauaguguuaacuaugcacauucacaaauauuuauaauagucauaguuuucugaaugagcauuacuagucaugucuucuuuucaagaauucaagcacauccauguaugaaaugaugaaaaguguauuuuagaauccuuugaaaucuccauguuuuaauuuuuggcuucugaaaguucugcuauucauauuuuuucucugguauuauauacaagacagggacagcuuuccauaaaaauaaaagcuguauugacuuauuuauaaaauugauacauauuuucauauucugccuguaauuauuaaaccuuuuaaaaauugaugcaaaauagaaaucagcgugggagguagacucagugcccagugcaugugucuuucucucucuuuuuuuuuuuuuucugagacagagacucacucuguugcccaggcuggaguucaauggcacgaucucaggucuguauaaccuccaccucccaggcucaagcaauucucaugccucagccucccaaguagcugggacuacaggcacaugccaccacgcccaacuaauuuuuguauuuuuaguagagaucggguuucaccauguuggccaggcuggucucaaacuccuggccucaagugacccacccacccuggccucccaaaccgcugggauuacacgcgugagccaccacacccggccccaauacauguuucugacuugagugaaugauuacauuuucuagcugggaagguuuccuuguagcauuccuagauaguacucagaacguuuuguaggauucauuuguucuuuugucccuuuaaaguugcucagccagcaaauauuuuaauaagccuuugugauucccaaagcuuaccaaccaccuuuggagaauuuaucuaaacaaaucggauuggcacccucccaaugccaagccaaucccuugagccccuguaacuaaugagaacuuuaaaaaugcuugucgccagcauacaaugaauugaucuucauguuaaucuugacuuuugauccuuuguggauuaaaaauuagcauggccccaaaugaauuuccacucuuggcaaucuuggaauuaaaaugaaacucuguauucauaaauccuaauugugugaauugccuauuuuaacaugaccguuuuuuaacugugucuacacauuguugcacauaacacuuuagaacuccuuugucugaauuaauaucccaguugguccugauagcauccuugaauuauggccuuuuaaagucuuuuuaaaauuauuuauguugagucuuagagcagagaagcagacauuuccuucacuuccuggcaaggaguuaaggaaagggguuuaaauguacugccaauuaacaaguguacuuacuaaaauucccacugacugcaguaacuauuuuuauuuuuugguauaaauuuuuuuuguccauuuuuuacuuauguccuucaaauguaugaaauacuggcaguaagccaacuaauuuuugcugauagaccaagaaaugcuuucaaaauuauuuuugacccacaggcauauuuuuacuaugaauugccuauguuuauuaagcuugaauggcauucaucaaaaacccaaaacccacugcaaugcagugauuuccuuuuuaaaauauuuuugugugauuuguucaggcaaauacccauagccuuuuauuugauaaaaggcuguaagguuaaaaguauugguuuagagcaaaauggauuagacuucugucuaggguuuggcuauuuguuauauuuguuacuugcaagagaagcauaacucugucuguuuuaaaaagaguguguaaaccuaugguguacuuaauaauaauucaacucagcuaucccuuggacacuguggagguccacucuuuucuccuggauguaacuuacagaucuguuagaacuaggcuucuuuuagccugauuucucccccaaauaccgggccucacacuuucccuccagacguuauaggaaggguacucuucaugccugcucuuuuuuucucacauagcucccagcacacagcacauggucacugauguccuuucucccacucagcauagaacagugagagauggaaggagugcagcaugcuagaugacuagggacaacuuuuauuugaccaagaacagauuguugccauuacugggggacagaucuccucuuuuccccccagcauugagaacgagaugaucauguagcaaaagaggggacgaaaagcagaugccuuagagaagagauggcaguggcugcccuugcaaagcccgccagaucgucuucacuguuaugggcucuggaaccaaaaaggaauugagcuaucuguguggaaaggagaauuagaugccauauucuaacuucuccguuguuccuaacugggcccauccaagggacuauuauuaucccaaguguccagaaggacacugaggauuaggccagcacuuuccuugaugcaaguacuuggccaccauuuuccugggcguuaggguccagggugugucaagggugggucaagagaggcagaaaccaaagacuuaugccuucaguggucccuuggucagaauuaguacucagcaaaguaaguagaacaugcucuguucugauacauaaaccaaauacacaguaugauuuaaauaggaaaugagauuuuuugcaagacuaagugcucagugaaugcuuuaguguaugcacuaaaucuuaaaucacaugggauaugagaaacuaaccaggaaaacuagcccucauugaagcauuaagccaggaaaaaaaaaauguguuucuuguuuuuccuauuagcauccauuuaacaacugggcuauuauuacccuauguagagugauacuuuccacgcauuugcaugccugagaguuggaaccaacaaaguaacaggacugccauuaagugauuucuuuuguuuucucuuucagcaaauguucccagcaggccacagguaagaguuaauggcuugguuggcucuauguuacugaucccaaccuagaguaagcagauuauccacgacugauuuuauuccuacuuuauucuccauguaaauaaguaaacuuacuugacauuuaaauguuaguugauucuguacaacaguuugucagucugggagugggggguggcucccaagccacagauaccaaaaauaccauguguuugauccuuuguguucuaacagcuuuuuaauggcaucuuaugugcuacauaaagucacucuagauagauuugaccaccacugcucucucaaaugucuacuuaagguggcuaucacagaacauugaccuaaaaaaaaaaugacugguaccacagaggugguuuuguuacuuugcaggggaaaauauuucaauuuuuuacuuaaaaauuuugcugagaacuguuggcagcuguacccuuaugccuuuuaguauuuucuauaaaccaaaaaguguaugagacagguuuacuuugccaagguugaggacacaccugggaaaaagagagauaaauuucauuaggauuuguagccuguuuuguuuuguuuuuuuguuuuguuuuguuuuuuguuuuuguuuuuucccaaaaaggauuuugagggcuucacagaaacgaaagagcaggcaggaggggguggaggaacagucaauuaugcauuugucuuaugcucaguaaaucugcguuuuauauaauuaagauaagguaugccuagaguagaagaagcagucaaguacacauuuuucucagggugggaggagagaugacuucuaguccugccuuuguccuguaaagauaagcuguuaauucacauugucagggugaaauucaacaaaacucuguuuuaggguaaagauuuggggacccuuagaaauuuccuugugagcaauuugugagggaggucacuggccuucuaucuuugcaaguagcugcuuaggaagguaguuuuugugugacucaguucccacuuuuaauuuuucccuuuagcauagugaguuagggauccugagauuuuguuuuccauucacauuuucuuaucacauacuuuuaguaauaaugugccacaaagccacagcagcuuuggagaacauuuucuuucaugaacuuguuuacuaaucuuuuugaaacaaugagccuucugaaugauugucuuauuggcaagagaggcugggaucuuaacuaaaagacaaggguaugugaaguaggcuagggguguggugagcuguggguguucucuccugcuugcuucuguugucuaagugaauuggaagccgggacuuuagcagggagugagguuggggaggaggugucagaagugcgaggagagacuggaggaugugugauagcuucuuggagaauagaagagcagauggccugggaaauagagugugacuauaagcagcauuaaaggugccacucaugaauuuaacaugaggccauucugcaggguuguaaguugcccucuaggcauauucacguucaugagcacaggcaccagaaugggcugaguauuggcauuuaaaaaguugaaguugggguuugacaaagugaguacagugauucaagggaagaggcaaagaagugauuauaaugauugaaccagaugcuuaagcucaguagugaaaggaaugaggaaauguccagugugggagacagaaauaaagaugggaggaucaauggauccuauugucaaaggauggauaaauuugcaguuguaggggaaguaagcuguggagguagaggugguugucagaagcuagguugaaugauacugaaauuagagggguugcaaguauugguaaugguccauauuuggaccuuugugugaauggcuaagaagguuggaggacaggaccauuggaggaaaagagccuaaagaaccaagaagccagagugcuggaagaaucaucuccauggguguugaaaucacuaacauuuaaaaauggcuuuagaguaggggacuuugagccauuuuuuacuucaagaagugaaggaacaugaccuacggagucaguagaugacugcauaauggagucauauagucugaugauaugagauucaaagcuggguguuuuuagggagaggagaaagaagauaccccagaggccccaaugaggaccaaggaagacucaugcaguguaugaggaaugggggagaauggggaggggaagugcugugugagaggguuaugagggaagcugugucuucagguagaugcagauauugauuagagcaaguagaugcaggcagcauucagagaaggguuugggaacauggguuuugcggaucacaggccacaugaccuauaggacagguuucaagagcuaggaagagugaggcauagggucacaaaaagggguaugcagaucucuauaugacuagaauacaggugauggaagggcaaccaggagucuagagcuuuuuaggguggcccauuaaaauuagggauaaaggguacaaagagguuaguccugaugguccccagguggaaugaggcugugagugacaaaggcaaggagggaagagagaaucuuuuaaaauccucagauauaauacaagugcucagaauuuaaagcagaaaauuaucugaggaggccuucuccuccuacucuguuucuagauuuuagaaauugaguuuacaaagagcuaaaugguucccaguuguacagcaacuuaguggauggagcaaacauguaacucaauacaagaggccccuuucccauuuucuuccuucccuuuccauguguuuuuuccugcucuucucuuuucuucauuuuuucaugucuugggucgaauggaaauucaugaaaaguauauauuuucaccuggaggguugggcuaauauuuacauagcaugaucuuaaauuuuuagaauucugacaccuaaaaugagcaguauuguguguccaauuaauagacacaucucauucucaaggauaauggaguauauaggcacaauucaaaaauccucuuggcuuuauauuuaacaugaaucagcgccagaguuucaguuaucaauauuaauauguaacaaaauguuccuuucucauaugggguuaaucucuccccuucucuguccucaaaccacuucuuugaauuuacuguggccggcacuuaccucauauuacaauugaaugaggcugccuggcugagauaucuuccacaccugcuucacaggagggccuccccucaguacaaugccuggaacccaucaguguuugcugaauuuuugcucccucuaacauggcaaucaaauguucaaaauggagaagcaagugucugaagaauccaaauuugaauagucauggagaaugggcucuaggccagagucaaaugaguuugcugcuuucagcauaccugggaaaaggaggggcuccgugggcaguuuuuccaguggcuucauuaggaacaugcuuccagggagcaggauaaagucccccauaaaauaagguguaaagacagauggaauaucuuuccugaggguccagaaaggccuuuuaugauuuaugaggcauggaccaguuuggaugauuucauuuuagcacuuuuuuuuuauuuuuuucuaauuucaaaauccuuuuagaagaccaaauguuugaccuucccuucaaaagguugauaccacuuccaugaguguggccuggauuuauauugucucugaccugggacauuuaacuuuaacuggcaccacuaaacacccuuggguuaugauuccugccuugccuuccucuucucuggacuccagcuugggaucaagaugguuggcauuguuaggguacccccucuacagaugaccucccacagucccccaggaagacaugggauauuuucaccagccucauucgcucaccauugguaccuucagcagaaagaaaugaaguccucuccauuuuaacuuugcuuccagccuggccaagagaaaagacuuucagacuucccucuaaaucagcugcagugauagaaagcagacuagguaacuucagcaugagagggagggaccucauugcaggaagcaaaagucacaguagaguuaagacucuugaaagaagcacuuuuauuuucuugaagaauugacagaucucugcuuccuguaauguuuugugcaaauuucugacagugcuauuuucccuucccauaggcaaugugaaguauucauccggccaaccaauguuuccugacguacaguguugcccuuuucagcaaaugccaauuccaaguuccauuaaaucagaagcuccauggcuccuuggcccacgauguugagugcugacuguguguucuacugaaagaguaaaacacugacuauccaaagagaaauggauauuuuguuuuuauaauaaccauauauuauuguuuucuucuucccuuucuaugcaaguguaaauuaaugaacagagagguauuuggaaaugguaauacauuugucacggauuuguauaauguauacagcauugggaaagugggugggggcuuucuaauaugauaccgucuuuuuaauaacuaugacaaagcuuacauaagaauuagaagaccacuuuacauuuuuacauuccuucugcuguucauauuaaccuugcacaauuacuucauuuuuucuuugacucuuuuaccacaauguuuugguuauuuauaauuuaucagccauauguuuaucagccauauaaccaacuagaucccaaauagauccauguauuuguuuccgugauuuggccacauuaauaaauucauaaauuucaaucaaauaucuuauauauacacacauaugguuuaagcuacagcccuguguaugccguuuaacuuuauuugacguugcccacuuacuucuuugcugaccacuuggauaaccguaauaaaaauccuauaagccuaaauggcauuucuuuugggauauuuuuccugcauuuuauucccuuuuuauauaaguaggaauuaauuauuuauuuuaugucuuaaucuauuugauaaagaagacuacauuauaauaaucucaaagaucauauuaccaaagguugcccacuugagcauauuuucauuuugacacagaaacaaaauuuaguacaaccuuuccuaguucccaugucuugauuuucaucauuacaugcacagcagaccuuuaccuauugugauaccagaacacaucauugucuuugguucccuucaaagagaauuuuauuguuguuuuguauuuucaaguccuuaauaguucuugaaacuccuaguuguuuucuuguugaaagcagacacacauuuagugcacggcuuauuuuaccuuucgggugaaagaucagauguuuuuauacccuucacuugaucaauauauuuggaaagaauguuuaucaaaagucuaugucacugcuucuacagaagaaugaaauuaaugcuuaggugaugguaccuccaccuacaucuuuuugagugcauucaauuauguauuuugguuuagcuucugauuuaacauuuaauugauucaguuuaaacauguuacuuaauuagcaaauguagaggaaccaaaaaaaggugaaaauaauauguuuugauucaaaccuaaagacauaaaaacauaaagacauuuuaacuuuggguucucuuuagcugggaucuggccagaaggaggcuuaaaguuagaaauugcuauuauuuuagaauagguuggguggguuggggggcaagggugucuauuugcagcagagauauuuugaaaagaagaaaauuguuuuauauaaaaaggaaagccaugaccaccuuucuaccucagauccaucuucauccauugcauuggaaacugcuuuaugcugcugcagucugcaaagucuagagcuuuuaucaggccaugucauacccaagaaagcaccuauuuaaagaaaaaacaauucccugagcucucaacuccaaguuguagauuuggugucuuccuuguucuuacuuuaaaaagucauguguuaauuuuuuuucugccuguauuuguaugcaaaauguccucuaucugcuauuaaagaaaagcuacguaaaacacuacauuguaaccuucuaaguaauaauaaauaaaaagaaauauauugcaguaacaaugggaaguaaguauguaguucuuuugaaauaugugguaaagaacuaaucacagacuaucaucuaaucugguuacauauuguauuuuucauccugaauaaaaguaauuuuaacacaagaugacuuugauauucuucagcuggauucacugauagaaugugaguuuugaaugcacauuuaugaaaacaagauauagagauagccuguguccugauacaucuacauuuuuuccugcaguuucucucauacacacuaauacagucuccuguugcucucauucucucucucuccccaucucuuacacauacauauaauuauaugauucucaauuuauuuuccagauagaagguuuauugauagagaaaaguaauauuggauguaaaaauguguacauaaaaccuguugaguguuuuaauaacuagaugcuguugacauuaaguuccuuucaaauguacuuuuaguuucaugcucucaaauac

SEQ ID NO: 16205 - RNA, 553 nt, Homo sapiens
uggacccuuuucacaacauggcgccgaaagcgaagaaggaagcuccugccccuccuaaagcugaagccaaagcgaaggcuuuaaaggccaagaaggcaguguugaaagguguccacagccacaaaaagaagaagauccgcacgucacccaccuuccggcggccgaagacacugcgacuccggagacagcccaaauauccucggaagagcgcucccaggagaaacaagcuugaccacuaugcuaucaucaaguuuccgcugaccacugagucugccaugaagaagauagaagacaacaacacacuuguguucauuguggauguuaaagccaacaagcaccagauuaaacaggcugugaagaagcucuaugacauugauguggccaaggucaacauccugauucggccugauggagagaagaaggcauauguucgacuggcuccugauuacgaugcuuuggauguugccaacaaaauugggaucaucuaaacugaguccagcugccuaauucugaauauauauauauauauaucuuuucaccauaaaaaaaaaaa

SEQ ID NO: 16206 - RNA, 553 nt, Homo sapiens
uuuuuuuuuuuauggugaaaagauauauauauauauauauucagaauuaggcagcuggacucaguuuagaugaucccaauuuuguuggcaacauccaaagcaucguaaucaggagccagucgaacauaugccuucuucucuccaucaggccgaaucaggauguugaccuuggccacaucaaugucauagagcuucuucacagccuguuuaaucuggugcuuguuggcuuuaacauccacaaugaacacaaguguguuguugucuucuaucuucuucauggcagacucaguggucagcggaaacuugaugauagcauaguggucaagcuuguuucuccugggagcgcucuuccgaggauauuugggcugucuccggagucgcagugucuucggccgccggaaggugggugacgugcggaucuucuucuuuuuguggcuguggacaccuuucaacacugccuucuuggccuuuaaagccuucgcuuuggcuucagcuuuaggaggggcaggagcuuccuucuucgcuuucggcgccauguugugaaaagggucca

SEQ ID NO: 16207 - RNA, 2053 nt, Homo sapiens
uguggaacaaugcuacaucuauacuuggguuggcuuaaucaaccucuucgauggugggcccuaaggaagcaccaccagaaggaggagcuccaccaacagggaaucccccaggcauucuuccuggcaugccuucugcacucugguacagcuuggugaugauuggguugcaaaguuccuccagcucuuucugcugauguucaaauucuuccuucuuggcaguccgauucuuauugugccaguugauaauuucauuacaccuguccagaaucuucuguuuguccucaucauuaaucuugucuugaaguuucucaucuucgacaguugcuuucauguugaaugcauaggacucaagugaauucuuggaugacgccuugucccucugcuucucaucuucagcuuuuuaauucucagcuuccuggaccauacguucaaugucuuccuugcucaaauggcccuuauuauuagugauaguaauuuuauucucuuuuccuguacuuuuguccacagcagagacacugaggauaccauuggcaucaaugucaaaagugacuucaaucugaggaacaccuugggguucaggagguaugcccgugaauucaaacuugccaagcagguuguuauccuuggacauggcacgcucaccuucauaaaccugaauaagcacaccaggcugguugucagaauagguaaugaaggucugugucugcuugguaggaauggugguauuacaguugaugaggauggucaugacuccacuagcaguuucaauaccaagggaaagaggagugacguccaagagcagcaaaucuugaacauuuucagacuugucuccagacaggauggcugccuggacagccauaagcaacagcuucaucauggcugaugcucuuauucaguucuuuuccauugaagaagucuuggagaagcuucugaaucuuggggauacuaauagaaccaccaaccaggacaauaucaugaauuugugacuugucugguuuggcaucucgaagggcuuucucuacuggguccagggugccacagaacaggucagcauucaauucuucaaacugggcacagguaauggagguauagaagucaauuccuacauagagagaaucgaucucaauacugacuugggugcuggaagagagaguacgcuuagcauguucacaagcaguacggaggcaucuuacagcucucuugcucucacugauguccuucuuaugcuugcgcuugagcucagcaauaaaaugguugaccauucgguugucaaaaucuucuccacccaagugguugucucuggcuguagacuugaccucaaagauuccauccucaauagugaggauugacacaccgaaagugccaccccccaggucaaagauaagcacguuucuuugugcuccaaccuuuuugucugaacuuuuguaaacaauagcagcaacaguuggcucauuaauaauucuaaguacauugagaccagcaauaguuccagcaucuuugguaaccugaaacugagagucauuaaaguaagcuggcacugugaccacagcacugguaacagucuucccaagguaggcuucugcaauuuccuucaucuuugucagaacaauagaggauaccuccucuggauagaagcuuuuggucucucccuuguauucuacuuggaccuggggccugucagcaucauucacuaccaugaagggccaaugcuucauaucagacuggacaacagcaucaucaaaucugcguccaaucagacguuuggcaucaaaaacuguguuggugggguucauugcaacuugaugcuuugcggcaucaccaaucaacuguuuaguguccauaaaggcgacauagcuuggagugguucaguuucccugaucauuggcaauuaucucuacuuuuccgugcuggaaaacacccacguaagaguagguggugcuaagaucaauaccaacugcaggucccuuggacaugguugcuggcauguagcccuggcuccgauaaagaagaaagccacaggaacccgagagcugcaggcgaguucaaugagcua

SEQ ID NO: 16208 - RNA, 2414 nt, Homo sapiens
agaaacacagcucauuguuggcagcugccgggcgguccugccgagcugugagggcaacggaggggaaauaaaagggaacggcuccgaaucugccccagcggccgcugcgagaccucggcgccgacaucgcgacagcgaagcgcuuugcacgccaggaagguccccucuaugugcugcugagccgguccuggacgcgacgagcccgcccucggucuucggagcagaaaucgcaaaaacggaagguaagcgcgacgggcgaagcuggcuggggcucuugccagcccaguccuccgagggcaggguuugcccggaggaagagcgugaggcgaagcuggggaauaacaacaggaugugcaacaacaggaugaggagggcugauuuaaugccugaaguucgcagcagggcuacggggcacuuccuuuauuaggccacuucggggagcaaagggggugugggcucggguccccccgcccgaucgcaggggaaggggcuguuugugcagcguccggcuguguuaugagugguagcucuuccgugguggcuagcccgggugcacaggcuguuagugggaucuuggggguggugguucgcagccgacgugcgcccgggaauccuggggggcagaggcgagcaaaaguggggugcgcuguggugggcgacacguguggcgcgggucucauuaucugcccuuuucacuuccaggacuggaaauggcagaccauaugauggccaugaaccacgggcgcuuccccgacggcaccaaugggcugcaccaucacccugcccaccgcaugggcauggggcaguucccgagcccccaucaccaccagcagcagcagccccagcacgccuucaacgcccuaaugggcgagcacauacacuacggcgcgggcaacaugaaugccacgagcggcaucaggcaugcgauggggccggggacugugaacggagggcaccccccgagcgcgcuggcccccgcggccagguuuaacaacucccaguucaugggucccccgguggccagccagggaggcucccugccggccagcaugcagcugcagaagcucaacaaccaguauuucaaccaucaccccuacccccacaaccacuacaugccggauuugcacccugcugcaggccaccagaugaacgggacaaaccagcacuuccgagauugcaaccccaagcacagcggcggcagcagcacccccggcggcucgggcggcagcagcacccccggcggcucuggcagcagcucgggcggcggcgcgggcagcagcaacagcggcggcggcagcggcagcggcaacaugcccgccuccguggcccacguccccgcugcaaugcugccgcccaaugucauagacacugauuucaucgacgaggaaguucuuauguccuuggugauagaaauggguuuggaccgcaucaaggagcugcccgaacucuggcuggggcaaaacgaguuugauuuuaugacggacuucgugugcaaacagcagcccagcagagugagcuguugacucgaucgaaaccccggcgaaagaaaucaaacccccaacuucuucggcgugaauuaaaagaaacauucccuuagacacaguaucucacuuuucagaucuugaaagguuugagaacuuggaaacaaaguaaacuauaaacuuguacaaauugguuuuaaaaaaaauugcugccacuuuuuuuuccuguuuuuguuucguuuuuguagccuugacauucacccaccucccuuauguaguugaaauaucuagcuaacuuggucuuuuucguuguuuguuuuuacuccuuucccucacuuucuccagugcucaacuguuagauauuaaucuuggcaaacugcuuaaucuuguggauuuuguagaugguuucaaaugacugaacugcauucagauuuacgagugaaaggaaaaauugcauuaguugguugcaugaacuucgaagggcagauauuacugcacaaacugccaucucgcuucauuuuuuuaacuaugcauuugaguacagacuaauuuuuaaaauaugcuaaacuggaagauuaaacagaugugggccaaacuguucuggaucaggaaagucauacuguucacuuucaaguuggcugucccccccgccgccccccccacccccauauguacagaugauaauaggguguggaaugucgucaguggcaaacauuucacagauuuuuauuuuguuucugucuucaacauuuuugacacugugcuaauaguuauauucaguacaugaaaagauacuacuguguugaaagcuuuuuaggaaauuuugacaguauuuuuguacaaaacauuuuuuugaaaaaauacuuguuaauuuauucuauuuuaauuugccaaugucaauaaaaaguuaagaaauaacuuguuuucuagaag

SEQ ID NO: 16209 - RNA, 2414 nt, Homo sapiens
cuucuagaaaacaaguuauuucuuaacuuuuuauugacauuggcaaauuaaaauagaauaaauuaacaaguauuuuuucaaaaaaauguuuuguacaaaaauacugucaaaauuuccuaaaaagcuuucaacacaguaguaucuuuucauguacugaauauaacuauuagcacagugucaaaaauguugaagacagaaacaaaauaaaaaucugugaaauguuugccacugacgacauuccacacccuauuaucaucuguacauauggggguggggggggcggcgggggggacagccaacuugaaagugaacaguaugacuuuccugauccagaacaguuuggcccacaucuguuuaaucuuccaguuuagcauauuuuaaaaauuagucuguacucaaaugcauaguuaaaaaaaugaagcgagauggcaguuugugcaguaauaucugcccuucgaaguucaugcaaccaacuaaugcaauuuuuccuuucacucguaaaucugaaugcaguucagucauuugaaaccaucuacaaaauccacaagauuaagcaguuugccaagauuaauaucuaacaguugagcacuggagaaagugagggaaaggaguaaaaacaaacaacgaaaaagaccaaguuagcuagauauuucaacuacauaagggaggugggugaaugucaaggcuacaaaaacgaaacaaaaacaggaaaaaaaaguggcagcaauuuuuuuuaaaaccaauuuguacaaguuuauaguuuacuuuguuuccaaguucucaaaccuuucaagaucugaaaagugagauacugugucuaagggaauguuucuuuuaauucacgccgaagaaguuggggguuugauuucuuucgccgggguuucgaucgagucaacagcucacucugcugggcugcuguuugcacacgaaguccgucauaaaaucaaacucguuuugccccagccagaguucgggcagcuccuugaugcgguccaaacccauuucuaucaccaaggacauaagaacuuccucgucgaugaaaucagugucuaugacauugggcggcagcauugcagcggggacgugggccacggaggcgggcauguugccgcugccgcugccgccgccgcuguugcugcugcccgcgccgccgcccgagcugcugccagagccgccgggggugcugcugccgcccgagccgccgggggugcugcugccgccgcugugcuugggguugcaaucucggaagugcugguuugucccguucaucugguggccugcagcagggugcaaauccggcauguagugguuguggggguaggggugaugguugaaauacugguuguugagcuucugcagcugcaugcuggccggcagggagccucccuggcuggccaccgggggacccaugaacugggaguuguuaaaccuggccgcgggggccagcgcgcucggggggugcccuccguucacaguccccggccccaucgcaugccugaugccgcucguggcauucauguugcccgcgccguaguguaugugcucgcccauuagggcguugaaggcgugcuggggcugcugcugcugguggugaugggggcucgggaacugccccaugcccaugcggugggcagggugauggugcagcccauuggugccgucggggaagcgcccgugguucauggccaucauauggucugccauuuccaguccuggaagugaaaagggcagauaaugagacccgcgccacacgugucgcccaccacagcgcaccccacuuuugcucgccucugccccccaggauucccgggcgcacgucggcugcgaaccaccacccccaagaucccacuaacagccugugcacccgggcuagccaccacggaagagcuaccacucauaacacagccggacgcugcacaaacagccccuuccccugcgaucgggcggggggacccgagcccacacccccuuugcuccccgaaguggccuaauaaaggaagugccccguagcccugcugcgaacuucaggcauuaaaucagcccuccucauccuguuguugcacauccuguuguuauuccccagcuucgccucacgcucuuccuccgggcaaacccugcccucggaggacugggcuggcaagagccccagccagcuucgcccgucgcgcuuaccuuccguuuuugcgauuucugcuccgaagaccgagggcgggcucgucgcguccaggaccggcucagcagcacauagaggggaccuuccuggcgugcaaagcgcuucgcugucgcgaugucggcgccgaggucucgcagcggccgcuggggcagauucggagccguucccuuuuauuuccccuccguugcccucacagcucggcaggaccgcccggcagcugccaacaaugagcuguguuucu

SEQ ID NO: 16210 - RNA, 2057 nt, Homo sapiens
cagauuuuuuuuuuuuaauucaagauuuucuuuaauuucccgccuaaagccuccccacgguagggccgcauccccuguaauaaaaugaauucugauucgagcucugucuccagcagagcuucaucuccggacauggaugagauguaccugagggaccaccaccaccgccaccaccaccaccaggagagccgucucaacucggucucguccacgcagggcgauaugaugcagaagaugcccggggaaagccucucgcgggcuggcgccaaggccgcgggagagagcagcaaguacaaaaucaagaagcagcugucggagcaggaccuacagcaguugaggcugaagaucaacggacgcgaacgcaagcggaugcacgaccugaaccuagccauggacgggcugcgcgaagucaugcccuacgcgcaugggccgucggugcgcaagcucuccaagaucgccacacuccugcucgccagaaacuacauccucaugcucaccagcucccuggaggagaugaagaggcugguuggcgagaucuaugggggccaccacucggccuuucacugcgggaccgugggccacucggccggccaccccgcgcacgcggccaacuccgugcacccggugcaccccaucuugggcggcgcgcucucaucuggcaacgccucgucaccgcuguccgccgccucacuucccgccaucggcaccauccggccuccccacucgcuacucaaggcgcccuccacgccgcccgcgcugcagcugggcagcggcuuccagcacugggcuggucugcccugccccugcaccaucugccagaugccgccgccgccgcaccuguccgcucucuccacagccaacauggcccggcugucggccgaguccaaggacuugcucaagugagcagcgggcgggcccggcugccaaggaggagggagagcggcgggaggggccgcggugccgggccgggagggaagagggaggcugcacgcucggcccacgggagggcaggcuccggggcccgcagccucccacgcugucugagagaucucagacuccacuugacccccggagggaaaggaccaaaaucaaaccgcaauuucuaggugguagcaaagggggacucgaaccagaugucguguguuuugcaugcaugcuucuuuuccccaugccgcgccaguauuuuucacugccauaugcucuugucaaaacugcauuuguuguauaaagaugggaucgguguaguuaaaaacuugcgaagggacuuuugaguuggcuuucucugacucuguguucucgcuuuggaaaaagacggccaucccuuuugugcaaaacaaauguaaauauuuucuugagauggaugcgauuaugauugucucuguccuugccacaguuuuucuagagacaauggagagagaaagagagagagagcgcgagagagaucaagacccaaguuuugaaucucaaccgagguccagggcaugacaccuccuauguggguuuuccuuucgacgcaguguaggucaaaagaaugcaugcacgcuucuaaaugaaucuugucugaauaugucgugcaggcuguggugccguuuuccuuguaacaaggauuuauuagugaauuaucccaaguacuccauauaucugucugugguuguaugaaaugaaaaaaggggcagagugcaaagacccacacucacgcacacgcgcuucuucucccacccccacccccuucaaacuuuauucggaaccuuccuuugcuguucuggggccgcuauuguaaaagccugggcucccucuaguagcuugcgccacccccccucgcucaguuauucugcaugcgggguuggcucucucuauuaucagcuuugaaaacuuauccugguuuugggaggggugccguuuuuauuuuccugaacauuugcuugaaauauuuuguuagggccucaaagacgauaccugucuuuauuuuuuauauauucuugauaacuaugauauauuuauuaauaaccaguguuucuggaugagauuucaaauaaaaaagaaccuuuaaaucgugg

SEQ ID NO: 16211 - RNA, 2177 nt, Homo sapiens
caccccggccggcuucccggggaggagggcagcacaccuucugggccuguccaccuccugccuagcucugcuggguggaaauaucgcucuagcacaggcauucugucuugugccccagaagaggagguagugguggugguggugcugcugcugcugcugcuguugcugcugcugcuguuucugcuucugcugcugcugcugcugcuaccacaggggaaauucuucccaggcagggaaaagcgaacccccguaagauccucuccagcuucggaaagacaagccuccuccagccuggcacaaccucccugucucuucaggcccuccacaaacacugccgacgagagcgauucacuucccuagguuucucucuggugagaaacuguuacuguacuccuuccuuagagauagaaugcauuuuuuuuccccuccucucucuggcacugaguucacagcacuuaauuaaucccaggcuacagcuggaacgacagcagggagaaaaaaaaaagccaucgagguucuagcauuugcuuuuccucuucuuucuucugauuuauuuguucucaauucucuuuuggugcuugucaaaguuuguugacucuuagcucuuugucggcuuagcucuuaaggacuucaggcaaagaagcggggcuuccccuuugcuaaccucacagaggggcuccccccuugcuggaggccaguuaucuggaggugucaggugaggagucaccccugugguacaggcucaggccugcaagccccaaggaguucucaaaaaaacagaggaagcugagagucugcagagccaaucugcagcugcuucucucuggagggccugauggggguuggggggcaccuugcccagucaccaagaccagugcugggaugggcuugguugauccucagugccucaguuugaucacucucgcuccuucuccacaucccucccccuugugucauuugguucucggcaaaccuaucuggguuaugaccuauuagucaaaucccuucauaaccucagcugcccuucagcuggaagggaaauaacauugaaucacauuccacaguuaacuccgaaagaugcgaauucgggaagcaucaagauccucaugcguaugggcaguggccugcauagccuggauauguggcucaggcucauucaaaacccauuuucaaaggaacaagcauuuuaaaggauguucacaggggacauaaauggcaaugaaagaaagaaaagaauguuaacaauucaccuucuggagggagagcacuguugauuuauuaugugggccacugacuacuguguccccgaccugagagugguugaaucgagggcaacaucaacugugggccaugccucuuguuccuagucucagagauggaggcgcuaacccugaaaguaagaaccaauucaacaaaaggcgaugcccccuguagcuuaugugaaaggccuuggacagaaacgaaaguaggguaguuuuguauuuggcacuuuugccagcaaauuggguuuguaggaacaauuugaacuugcacauucaagugaauagccccuguuuucuuggagaacauuguaacaaucccaucuuccucucuucacgucuccacauugcaaagugcuuuauuuugcuuggcaugccauuuugcugguguauaaucuguugcuucugcucuacauuccuuucaaggcugguuuaucacacaauuauuugauauuucuucaugggagagaggaggaaacuuggggaagaggagaaagaucguuguagaguguguuuuauuuucauuacucccaccucauuucuuuuuaaaguugaaaccagcaaagacaacuguaauuuuauuguuguuuuauuauuucucuaaauccaugguuaauaaguuuaguuuuccauacuggauuaagugaauuuucuuuuuucuggauggaaaagcauacuggcaaaccuacucuccuuccuaacaggugaagaaggggcaagaggguauaaaacaauaauaaagacauugaagacacugcuuuuggugaauuuuguuaugaaaauauugaucuagcagcucuuucuauaacaaccagauauacauacaacacaauuagggaauaaucagcggucuacuugauuagaaagaugugcccuuccuuuuucccucucugauaagagaugaaaggauuucaccau

SEQ ID NO: 16212 - RNA, 3807 nt, Homo sapiens
uuuguuaugaaaauuaagaauguaucucaaggcucuauuuagcuuuaaaaauuagaugccaggauaccuauguaaauugccauuaauuaauuaauuuuuuuuuuuuuuuuuuuuuuuugagacggagucucacucuuccgccaggcuggagugcaaugcaguggcaugaucacagcucacugcaaccucugccucccagguucaagcaauucuccugucucagccucccaaguagcuaggauuacaggugcacaccaccacgcucagcuaauuuuuguauuuuuaguagagacgggguuucaccguguuggccaggauggucucaaucucuugaccuugugauccacccaccucagccuuccaaaguacugggauuauaggcgugagccaccgugccuggccgucauuaauucuuaguacuagaaacuaaguaaagaugaauuaaauucaauuaaaaauuucagugacucacaaagauuuucaaguuugucagcaaucccauccuuccuuuagaaaaguaauaaauaugucugcucaaaaguuuagagaggaauaugccuaacacugcuuugguacuucagcaugacauauggaaaggaaguaguuuuuuuaaggcagguuaauugaaaauucugaguugauagacaagcuggugauggugagagacaauuaaauguaggauaaacucagucaaguguuucucagucacuuguauaugaaauuuuauaauguauuuuaguucaaauuuuaucuugaucuuuggugaauuuugagucugcccagauuuaauagcuuucuaguuugauaauauggcauaugacagagaaugaagaacacaaaauguaacaaaaauuuuaagcagaaacaucugauucauuuauguuagucagugagcauuuaugucuuucuuacauagaaugagcaucuaacaaauauuuccauuaaugaaaaguuggaaugaaaauuuaaauuugcauauuuucuuggagcuuaguccuugaccuauuuauacacacucuguaguuauuucauuguaacccauagcuuuaaaugaauuuccaauuacaucuccagcuccaacauuucuccuuuauucaagaugccgauguugaacuugaguauguaauaagcaucucaacucuaggaugcaauauaaaguagugauggguaccaugaagcagcagaaagcagaauuaggaauuagaaagcaaugaagggauggguguuucagggaaaugauuagggagggccucucuucaggaggugacaucugguaagagaccugaaugaagugagaauauugaggggauaauauuccaaaugaaagcaacagcuacugcaaagcuucugaagcaugaacagauuuggugugugugaagaaccaugcaaguuccaguuauaugacugggguggaaugagaguugaauuguuuauauacuuggaguacauugauuucaaguauauagagugagagauuucuauacaccuuguauuuuuaauuaaucaaaugucuuuuuggauuaauauguucuuuguguuugguauuguacuugauuucagaaugguagauuuggagagcaguuauugcagucuuggauaagcuuggagaguaguauuuggacauuaauaugacuauauagaacagaaccuuaugugaaaaauaaugcuuaugagguaaucagauuuuuuuuccccccagaaaguauuaaugaagcuuagaaaaccuagaauuacagcuacaauuugguccucaggaaaaauuauuugcacuggagcaacaagguaaaugcuacuuggguuuuuuguuuuuauuuuuuacuuuuucccucauggaaaggacauuuuccuagacuuaacagcaaaaucauauguaaaguuuguuauguuccucaguauaacauuuauuuccuguguaacugauaaucuuuuucuuuccuuaaaaccguagugaagaagaagcuaaauuuggugccagacgcuuagcccguagucugcagaaacuagguuuucagguaacguuuucaaauaguaucuaaacuacaaauauucaaggacuuauuuuuauagaauuaaaaauuguaauagacucaagaaaucacuaugcguacuauucuuaugauuaaacuuuuucuagguuuuuuaauacugcccuucagugugaaaauuaguagcaaaauuuggcuauguggguauuuguaaaggauccuagcuuuuucccuaauuccuuucccauaaagagacuuguuuccucacaaguuaauuuccuuuucaacucuuuuuuaaguguuuucaccucugacguacacaaacaaaaugguuuuuggucaucucaagaaugccaggucagaauggugaauagagaauggcagaggccguugacauggacacaccagcuggcaggcucucacacuuguaacgugacugucacuggcaugucagccucaucacuauaacuugauagagguauaccuuugaauaaaacgauuacauauuauggacuugcuaggucacuugcaaaugaugaauaaaugaaagauaaagaugagaauggucccugaagaugagggcaaggcuguuugggauugagacaaguuuguagaaguggggauaggaaguuaccuuucccucugaugacucagucucucugaaguagagggugauaggaagagacugaacggcugguggggaguggggguuggugcuugagaaggguggcaguagagagaggcuugaguuguacugugauuugagagugcugccacuuugcgguuuccuggcuuugcgcaacugcugugugcaaggcugaguugaaggauaguucgcucacccaaaauugugguuuuaggaggaauguuugaaaagauaaugagaugaaacgaagauguugguuggaguggccaaaguuauuaauguuaacagcauuauuuucagccuuggaacuucuuuucuuaguguaacauuagaaguguugagagaaaucccaauuaguuagaaacaaauuuaucacucuauccccagaaagaaaauaaacaucuagcuaaucucacagaaaugucauuuugccuuauugcauaugagaaaaacaucugacuuuuggagcccaguguacacucuguauuuacugacuuuaaagugacaucuuuuccauuuuuacucuagcaggaugaccuggacuuaaauuuuuuuucccucacuauucucucuccuuucucaguaguuuuaaauauuucacuuaaaguauuaaaaaauuaaacauaugauuagaaagacccauacuguuuugaucaugcaaauaccucaguuuuuaauuuuuuuaauggaguuuuugagcuuuuuaaaaaacugaauuaaagcuuuccaugcuacacaacuuacaguacuaaacauacacuuaaaauguuuuuguuuuaucuuguuugcucuuguuuuuaaggauugccauuaugagcagauuuuuuguuuguuuguuucaaaauaaauuuauugaauuuuacuucucuccuaaagguaauauuuacagauuuuaagguuguuaacguucuggcaguguguaacaugccauuugaaauccguuugccagaauucacaaagaacaauagaccucaugccagguaagucuuugaagcaauuuaucuugagaaauuaccaaauuugaaauuacuagucaggguauaaauauuuauauuaauuguggcuuauuuuguguaguuacgaaccugaacuucauccugcugugugcuaucggauaaaaucucuaagagcuacauuacagauuuuuucaacaggaaguaucacaguaacagguau

SEQ ID NO: 16213 - RNA, 1717 nt, Homo sapiens
ugguccccaaaucaggccccuccugcccacccgcugggcucggugggagguaagaggugggaugggggcggcgcuaaugggcaucggacuagacuuuuuuguuuaagaaccgcuugaaaggguucugaaaacaccguguauccuuuguauauuuuuaguugauaucuaaacguguaguaauuucuggcauacagucgaauauuuagguggacuuuuuugucaaaaccguagaacuuucucaucagcucauuaaauuuauacaaaagguccuccccaccccccauuauauaauugcuaaagcuaguccuuaccguccagacgagacuuguuuucugccugaaaaaaguccuucgcuuuuucagucaaaaugaacccguuaauuuaugaugucgcgauaaauuccccuagugagauuccucacuaggcgaauuggaauccuggucuuagagcgaccggggaugacagaugacagacggagggaaggaaguggggagagauggagacacaagguguggcgagacggagggauaacgcaggaccguaugccacuucugucgccugucccacauuccuuacucuacguggguuugcggucgggacugucccucgggaaccgagaggcggauccaggaaggaugggagugggagagggcggaugcuggcgaggacucaggcagcccgggauaggaggaccucuaggaacggagacccuccgcggcucugcgcccaaguagcccugcaggggccgggggaccccgggggcgcacaauggcccguuugaaccgucgcccuggggcccgagugcguccucggggucccucgggaguggccugagaggcgcugcccgcgggagcgaaaaucgcguaacggcccugagggcgccacgccacgccacgccacgccacgccgcgcggaagcccccggcucccggccccacguuucccacucucaggccggcaucggccuuuccaccagagcucggcugcagucagaagccccuggcguuaguugaggucaauggcagcccugauuuaauuauuaaaagaccacgccgagccggguucauggguaccuggccucugauuggugggaaucagaugaaaaaaaugaaaaugccacugccuuuuuaaaagagaagacgugggcugaauucuugggguuuugacaguaggcaaccauuuagguauuuuauuauuuacgagaucuccaaggaugccucuugauuuuuugcuuuccccucugaguguucagaaacauauucgagcauuugaaagcuccguagaaugauggaguuuguuuucauuucuguacuaauuuauuuuucaagggauagugauuauaguugggucagguuuaauaaagaaagugaacaagaagcuggguuagaaaguaaugucuguguggugguggggagaggacuuuuaggagguaacaucucagccaauuucuaaaagggaugggagugggaagaauguauguagaguguuccagucagagggaacaagauaugcugaguacuugcugugcugggguauuaguguggcuagggcaucaggaaacagugcaaaggaagaaugacagucauugaaauuggagggaaauuaaggucuugaacuuucagugccuuguagaccauagaaggaguuuggacuuucuuccaagugcuagggaaaguggaguuuuagccuggaaaauaacaugauuugccaaggaaacg

SEQ ID NO: 16214 - RNA, 1097 nt, Homo sapiens
uaaaucaacacacaaagggaaaaguaaacugauugacagcccucaggaaugaugcccuuuugccacaauauaauuaauauuuccugugugaaaaacaacuggucaaaugauguccgugcuucccuguacaguuuaauggugcucauaauucugaccacacucguuggcaaucugauaguuauuguuucuauaucacacuucaaacaacuucauaccccaacaaauuggcucauucauuccauggccacuguggacuuucuucuggggugucuggucaugccuuacaguauggugagaucugcugagcacuguugguauuuuggagaagucuucuguaaaauucacacaagcaccgacauuaugcugagcucagccuccauuuuccauuugucuuucaucuccauugaccgcuacuaugcugugugugauccacugagauauaaagccaagaugaauaucuugguuauuugugugaugaucuucauuaguuggagugucccugcuguuuuugcauuuggaaugaucuuucuggagcuaaacuucaaaggcgcugaagagauauauuacaaacauguucacugcagaggagguugcucugucuucuuuagcaaaauaucugggguacugaccuuuaugacuucuuuuuauauaccuggaucuauuauguuaugugucuauuacagaauauaucuuaucgcuaaagaacaggcaagauuaauuagugaugccaaucagaagcuccaaauuggauuggaaaugaaaaauggaauuucacaaagcaaagaaaggaaagcugugaagacauuggggauugugaugggaguuuuccuaauaugcuggugcccuuucuuuaucuguacagucauggacccuuuucuucacuacauuauuccaccuacuuugaaugauguauugauuugguuuggcuacuugaacucuacauuuaauccaaugguuuaugcauuuuucuauccuugguuuagaaaagcacugaagaugaugcuguuugguaaaauuuuccaaaaagauucauccagguguaaauuauuuuuggaauugaguucauagaauuauuauauuuuacuguuuugcaaauc

SEQ ID NO: 16215 - RNA, 1032 nt, Homo sapiens
cauggaucuaacuuauauucccgaagaccuauccaguuguccaaaauuuguaaauaaauccuguccucccaccaaccgcucuuuucauguccaggugauaauguauucgguuaugacuggagccaugauuaucacuauucggaaacuugguuauaaugguuuccauaucgcauuucaaacagcuucacucucccacaaacuuucugauccucuccauggcaaccacggacuuucugcuggguuuugucauuaugccauacagcauaaugcgaucaguggagaguugcugguacuuuggggauggcuuuuguaaauuccacacaagcuuugacaugaugcucagacugaccuccauuuuccaccucuguuccauugcuauugaccgauuuuaugccguguguuacccuuuacauuacacaaccaaaaugacgaacuccaccauaaagcaacugcuggcauuuugcuggucaguuccugcucuuuuuucuuuugguuuaguucuaucugaggccgauguuuccgguaugcagagcuauaagauacuuguugcuugcuucaauuucugugcccuuacuuucaacaaauucugggggacaauauuguucacuacauguuucuuuaccccuggcuccaucaugguugguauuuauggcaaaaucuuuaucguuuccaaacagcaugcucgagucaucagccaugugccugaaaacacaaagggggcagugaaaaaacaccuauccaagaaaaaggacaggaaagcagcgaagacacuggguauaguaauggggguguuucuggcuugcugguugccuuguuuucuugcuguucugauugacccauaccuagacuacuccacucccauacuaauauuggaucuuuuaguguggcuccgguacuucaacucuacuugcaacccucuuauucauggcuuuuuuaauccaugguuucagaaagcauucaaguacauagugucaggaaaaauauuuagcucccauucagaaacugcaaauuuguuuccugaagcacauuaau

SEQ ID NO: 16216 - RNA, 54486 nt, Homo sapiens
cugcgggcaugcgcacugggcguccccacgccaccgcccaucagcugagaauugcagcugagggcuccgggguaggugggugacggcggucggagguguaggagggagccguggagguccagguaagaggacccuggggagggggcucccuggccgggcgacagggaggcgcggugccccugcggcugcugcgccuucuuguuugugcgcguggucagguggccgccgcccugcgcucugcagcaggcacucgggaggcuaggaagggcgggacugccccagcucccggagcgccugcggcuccccacgccccccggccgggugcaagggcgcggcgcguuccgcauuccgggugcgcgcggcuguggucaggugggccuacccagccacgcacccgccgcgguccccugggcagagcuccggaggcgcacggcuggcggagcgcaccccggggagggcgccagagccggcuggggcccagcucaggaauccagacacgaccaaaugaccucuuccucuuuucaacucacggauugaaaaacacacuaaacuucccgaauauagaggaacugaaaaauguauggcuguagcaggcgaaccguguauguuuauuuauucagaggaucguaguauuguuuuuuuaauuuggcuugaugacuuuaacauacuuugacauucuuugaguauacaccuuuaauuaauuuacauaaaaaccuuuaaacguacauaaaauauuucuaguauuuccuccaccuuguuuucuaguuacuuucuuuaaauucagacaaagaaaaaaaguugcauuucugaucaaaugcuguguguuuuuucccacaaauuucuuacauuuguuuggcucuuaucuguauacguuaauuuuuguuuaccucagaucguuguauucugacuauaauuauauauaauauauaaaacuugcccagaaucuggaagaaaagaaaguaauuaugaaaugcugugcuauuuaauaauguuggaaguggacauuucuucugcagguucucugagcacaccugggcagaggcugauaacgguguuaaacuguguuuuguguuguggacaggccuuauaggcuacuuugagaaguuggccucagacucgugacuaguuaagaauuaugcucuuaacuucacaguuucuguagagguuaauaugauaccauauuaacugauuaacaucauaauuuuuccucagauauguuacuuauguugcucuugauaacaaaaucaauccuuauuuugguuaugaccccaaacuuuaagugcugaugauugaaaaguaaauuauagaaaauauucacaguaagucugagugaaguuugcugugauuccauuuaauuugcaaguuucaugugugaaaguaugaaaaaaacaauccucgguauugugaacuaaaaccaaguaguacaaaaggucagugaugaaagagcuaaggccaaagaauacaguuaauguaguuuuugcagaggauacuuauguagacagagcacccucacauuccuugagcauuuacuaugcaccaggcacuguagauuacacaggaugacaaggucaucucucuccuguuuauauuccagaaguagcuccuguuuguauuccagagguguagggauaaauaauaaacagugauuaauucgacuuuugaguauugugaagcaguaaguuagauugacaaagagugaccaguggugaguucucacuuucauaucagaguggucacaaagguuucucuagcaugugaugaggccuugcuggggagaaggagccagucacguggagaucaugggaagagccuucuagaaauaggaaauggcacccagcaaaggcccaaggcagcaagaagccugggaccuucgguaucugaaagaaggcacuggaauuuuauguuuuggaaaugguaauauuuacccucacgcuggguguguguucuuaggagguggguacauucauucauucuacaaauguuuguuaagcacuugugauguagccaggcagugagaauagugcaguccacaaaacagacaaaaaaaugcucaccccccaccccucagaacuuacuugggguagaggguauagagaaguccaguuguuuaugcugaugcuaaugauuaagaaagugaaauugacuacuucuuugcccaggguagauuuauagagcaugagauauaugcuaaauggaaaucuuaaggauucuacaguauaucggauuuuaacugggaguaguguuugacacuucaagauuaaauuuuaacauuccuuuuguucauuccuuuguguucuuuagaagccgucuugagaagacucucaucugaguguugcacuuugauucucccuuccuguuuuucucuuuauaguguuuguauaucuucauagaaagaugauuauugcaauguggagauuagcacugugcaauagaucuuucugugauaauggaaguggucuaugaaugagcuguccaagcugcuggccacuagccacacagaauuuuugaacauuugaaaggugucuagugugacugaggaacugauuuuuuucauuuaacuuaauuuuaauuaauuuuaauuuuuuaaaaacgagagcuacaauguaauuuaagugauacacaauauaaaaugguguaaauugucacaugaaaaaaugaaauguagaguaaaaguguaguuucuuacugcaaucaguuaucuuguuagcagcuuaaaauaaccuguaauaagauuuuuuugcuuuuauuauuuuaaucgacagauaaugauuuacauauuuguggauacaugugauacaucaguagauguguacaauguguaaugaucaaaucaggguaauuagcauauccauuaccucaaacauuuaacauuucuuuguguuaagagcauucacaauucauucuuucuucuaaguauuugaaaauaugcaauaaauuguaauuaauuguagucaccuuuuagggguauagaacacuagacuucauuccuccuaccuagcuguauuuugguguuaguuaaccaaccuuuggcuauccccuucccgccauccuucucugcuucuaguaaccacuauaauuuuaacagcccauuuaguuaguggcuagucuguuaguacaggucuagguaaugaauuauauaauuauuauucugagcaauuaaauaggaauucugagugggcuuucaaaaguauucaacaagaguacuuuagugcguagcagcucugggcuagguaauggagacugauguggaaagcagacaucugaauaacucagcauccauuuagccuauaugcagagaucauaagcuuuuaaucaauuuguaguuaccuauccugucugucuaugcuuguauauauauuuuuuaaagacaaccauuugguuccuuuccuuugugugucucauuaucaaaagagccaacuguuguugccuuuuagauaccacuuauuagcagaauaauagagaaaaggaguaagcuauuccucuguguuaccuugaucaacucauguaguuaucccaaacauauuccuucaucuuaggagugggaauagcaaaacuucauauggggcaugcagaaaagugguaaauuugguuuuucuuuugucuuuuuuuauuuuauguuauguuauguuauguuauguuauguuauguuauguuauguuauguuauguuauguuauuuugagacgagucucgcucugucgccgggcuggagugcaguggcgugaucuuggcucacugcaaccuccgccuccuggguucaagcgauuguccugccucagccuccugaguagcuggcacuacaggcgcaugccaccacacccaguuaauuuuuuuaguagagaugagauuucaccauguuggccaggauggucucaaucucuugaccuugucaucugccugucuuggccuuccaaaguuccgggauuacaggcgugagccaccgcgcccagcccaaauuugguuuuucuaacugaguucaccugcccucaauuuuguuauacaaggaagcaguauggcuuaguguuuaaaaaaugucggcucugugguuauuuucaaauauuugcuccuuugcuuauaaugauaaugaggcauaaugauaugccucaguuucuucauguaaaaaaaucacauuagcaauuauacccacaugauaggcuuauaagaauuaacugagaaaauaaauuuaaaagucauaagcacaaugcuuaggaaauguaaguccuggaugaguguuggccauuguuaacuuuguuuuauuuuacacaucuuucuucucuaucuuuugcaaauugcuuuucauucuucacacaugauuccuggcuagauacaguggcucaaaccuguaaucccagcacuuugggaggcugagacuggaggaucgcaugagcccaggaguucaagaccagucugggcaacaaagugagacccccaucucuauaaaaaaaucaaaaaauuagugggaugugguggcaggugccuguggacccagcuacucgggaugcugagaugggaggauugccugagccuggaagucagggcugcagugagucguaaucacaccacugcacuccagccugggugcuccugucucaaacaacaacaacgccaaacaaagaaaaaguaaaacaaaacucauaauuccagucaaucuaaguagcaccucuuugggugaaugaagccacuugccaauugucucaccagcaggaacuuucucacauuuaguagcuugaggaaagggaugaagaaaauugauuguguuugugacuaagugauugauuuuccagagaggaaaaaagguggccuugaaagaaaacagugagaagacuugggcuacacuggugugaguuuuaaggguaaggaaaaugcuguagaauacuguccuugacuugauggaacucuuuaugggagagagaguaggccucaggugugcuugcaugguuuugagacaggugaugaguuucucuuggucuugugcugaugcugguccugcagcugcaagaacagaucauaacuuuccucuguguaggguggaaaagcauuuguucucuggaugugcauuaucucauuuugauucuggcagugggcccaaaugcuaagugucuugcccaaaguagaaauuuccaguugcuacuuccauggugugccgcacaggcaauggcugaguucuuguagcuucacagacauguagacacgagagaaagccaaggguacgagcuggagacauggaugugcgacucauucagguauagauuaaaauggaaccauguauauggaggagcauccccagagauuacaugaauaacaaacugaacauuuuuucauucaauguguuuguuuuggcuuguaagccaguuuuuccagagaucuacuugauagagggaaaggagaaaggaagaugucauugaaccaagagaaaauugucuuucuccauaccuuggaauauuauuuggcaauaaugaaggaauauuauuuggcaauaaugaaggaaugaaggacugauauaugauacagcacagauggacuuuggaagcauacuaagagaaagaagcuagucucgaagaacacauuguaugauuccauuccuaugaaauguccagaauagcaaagcuauaaagauacaaaguagauuaguagucaccuuuggccagugagguuggggagaaauggagagcgauugcuaaugauuacaaacuuuccuuuuagcguaauagaaauguucuaaaagugaugauuguacaauguuguaaauauauuaaaaaccauuggcuuguguacuucaaguagguguauuguauugccauaucucaauaaauuauaucucaauaaagccauuuuauuuauauaaauuuaaggggugcacaugcaguuuuguuacaugguuauauugcauagcgugaagucugggcuuuuaguguaaucaucaccugaauaauguacauuguacgcauuaaguaauuucucaucccucacccucccauccuuuugagucuccaaugucuucuuauuccacucucuguccauguguacacauuauuuagguuccacuuacaagugagaacaugcagcauuugacuuuuuucugagucauuucacuuaagauaauggccuccaguucaucuguguugcugugaaagacauaacuucagucuuuuuuaagguugaauaguauuccauugcauuuauauacacuacauuuucuuuauccauucaggaauguuaauagacacuugaugggcacuuagguuaauuccaaaucuuuguucuugugaauauugcuacaauagacauaugagugcagauuaucuuuuugguauaaugguuuuuuuuuucuuuuggguagauacccaguaacgagguuacuggaucaaauauuaauucuauuuuuaguucuuugaugacuugccaugcuguuuucuguagagguuguacuacuuuacagucucaccaacaguguguguguuccuguuucucugcauucuugccaacaucuguacuuguuugacuuuuuuucuuuuuuuuccguucaagauguguuuguggaugaauuuuuaauagccauucugacuguugugagaugaugucucauugugguauuaauuugcauuuaucuggugcuuacugauguuaaacauuuuucaugugcuucuuggccauuuguaugucuucuuuugaaaaaugucuauucaugugcuuugcccccuuuuuaaugggguuauuugugggguuuuuuguugaguuguuugaguuucuuguaaauucuggauauuaaucucguuggauguguaguuugcagauauuuuucucccauucugcagguugucuguucauucuguuuauuauuucuuuugcugugcaaaagcuuuuuaguuuaauuaaaucucauuuugucuguuuuuugucuuguugccugugcuuuugaggucuuagucauaaauucuuuuccuaaaccaauguccagaagaguuuucccuauauuuucuuuuaguauuuuaaucguuuuagguauuacuuuuaagucuuuaauccaucuugagucgauuuuuuuuuuuauauguugacagauaaggguccaguuucacucuuccgcauggggcgauccaauuuucccagcaccauguauugaaaagggcguccuuuccucaguguauguuuuugucaacuuugucaaaaagaucaauugacuguagauaugugacuuuacuucugacuucucuauuccauuccauuguucuaugugucuguuuuuauaugaauaucaugcuguuuuaguuacuauacccuuuuaguauaauuugaggucaggcaaugagaugccuccagcuuuguucuuuuucuuaaaauugcuuuggcuauucaaaaccuguguuuuuuuuuuuuuuuuuuuuuuuuuaagugacuuggagaugcauuuaaaauugcaugguuucaaggauguuccggaugguguuggugucauugaauccccaugucuacucuuguucugucugggcccaaguccaaggcuaccuggaaggaaguuuauuccugucuccccacuguagugguccagcugucugacuuuagguuugaauuuacccuuuaaugaaauugcuuuuggauccaucucuaggauuuggugagacccagagagcccagaauagaucagcuguaccugagagggaaguuggagaauaucuaaaagccaccaggacuuucagcguggccaggcacauucaaagugcaccagaguuccaggcauagaaccaguacuguucuaauggucucaacaguucagcuguuguacuuccugccaacacugucccuuagagcaaagacacauacuucacuguggcuucuucucuaccagaaaucuucuguggcauuaguucuaugugguagcaagcauggauagccuuggcaucagaacccugggacugaaucucaccuccaccuguggguggguuggguuaccauuacuuaaucauaauaagcccgcuguuugcucaucauuaaaacaagaauaaugccacuuaauugaaggagguugugaaaaaauuagucugugaaauacuuuuugugucgcagaugugcgagaaauguuaggccauuccucucuuucccuuuauguuguuuuccccuugucccagcugugaaucaucugauccaggguuggccaggaaccuucccuuccuuuuguaaauaccauacugcauguggccuuuccacgugcucugggucucuccaccccagccuucacguccuugccuuuguuguucugcauacuggucauaaccaagcauccaaauccuauguuucuauuucauaaauucuuuccagacaaggaugauggucauuuuuucuuuuuguagcccuucucauuuuagccuagcacgugaucuuuuauggauuugugggguuuuuuguugguuugcauuauuaacuuuauccuuccuccuaaaugacaaacuugauuugagcagauacugugucaguguguuuuguuuuguuugcaucucccaggugcuuaguuuaaugcugggcauguaccaggcucuuaguagagagcuagcuuacaaauugaccaccaacaauuuugcaguauuccagugcauauucauggaaaagaugggguggcgguaguugaaauucuuugcugugcgcaguucuguaugcagggacauuccuuuucaaccuucuuuccaaacccugauuggagugguguggauugaagagguagagaaugucaucucaccugccuccuguggcaguaucucagugucucuucuauucugagaugcuggcugcugaaaggggagagucauucguucuccuuccucugucaggaagguuugauaaacauuuuauaugacauuugcuucgcaguaguuggcucugcuauuucagauuuaaccuuuuccauuaaaauuagagcccuauuaaucauacauuccugagcagguccuguguguguguuaaauuagauauuaagguugguacaaaaguaauugccauuuuuaccauuacuuuuaauggcaaaaaccacaauuaaaaguaaugguaaaaacugcaauuacuuuugcacaaccuaauacagugaaauuucuggggauagccugaagucuguguuccauuuaauaaauauuuaaaugccuguuugugcuaagaguuguuuuaaauauuggagaaagauaaauaagcaugugggcccugccuuauaauuguuuggaguuuaguuaaggaaaaaauauguaaacaacuaaaauuauauacagguaagggauuuaauaauuuuucuugaagagaucaaagacguuuucaaaggaaauaugcaauuugaaccuuauuuuaauuguuugauguguuuaacaugacucuguccuuugaaguccaguuuuuuuuuuuuuaguagacaugagaguuuugcuauuugaugugucacuuugccagauuucaacucuauuagauuaaucaaguuuguccuuguaacuucacagauuguuaauuuggaaaauguaagccaguaacuuaaaaaauauaucugugugacuuuuauauuauuuaggugacugcuuagaaaacugcacagcaucugaugaaauuagcgaauaagaacaucaaccaugucuuacacuccaggaguugguggugaccccgcccaguuggcccagaggaucucuucuaacauccagaagaucacacaguguugugaguugaguuuuaaauggacuucacuauuuguauccacucuuaacugaacuugguggagguucauaaaaggacaacucugcugauugagagagggaggagcauuccucuaacaacagguuuuaaagggcucgaacucuuuagaaugaaugcaagagaauuauauuugagauaacacuuacugcauuuuucuauaggaagucagggccaggcacauaauacauuauuucauuaaauaaaauaaagauuuaaaaggauaauggauucuuauaucugcuuuaaagcuaucugguucuagaugagaugaugagaccugaugacucagucucauagguuuggaaccagguagcacuaccaagggcuuaaggaacauaaaguuuauuaaaaauaaaaucugacuggauauggauuagguuaaucuuaugaugggcaaguaugugguaccuuauuaaggagcaagaggaacuaaggagaggacguuuuaaucuauugaggaagguauuuuagaaaaucagaccugcauuccccacauauucuuuuuuuuuuuuagagacagccucacucugucgcccaggcuggagugcagugguacgaucuuggcucacugcaagcuccgccucccagguucacaccauucuccugccucagccuccccaguagcugggacuacaggcgcccgccaccacgcccggcuaauuuuuuguauuuuuaguagagacgggguuucaccguguuagccaggauggucucgaucuccugacuucgugauccucccgccucagccuccuaaagugcugggauuacaggcgugagccaccgcgcccggccaaauuauucuuugcuauacuugucagagauagauuaccaguagacugaugcaguguggcacuucauucggaaguauucaucgucaggauauguauuaaaaaaaucauuauagcagauuugaguggauagguuuuuauuuuuuuauuuuuuuuuacuuuuuuuuguuuguaaauuaugguuaaucagauaccuugggugauucuagucuugcucucaggguuuggcccucggggcauuaccugaacucuuucauccuucggaguauguuaauauaguuuuauucuucagccuaguuccuuacaaggcuauucuuuuuaacagaauguuaacacauugcagaaauaguguuuucaaaugaccauacucuguuucuuuaucuaaucauuaacuccucaacagcuguuccucuaccugaauuauuuaaaugagaugcuaguguguuuuaggagcaaagagaauaaaacuagacucuaaaaaggugcugcugugcacagugguauaaaauaacccuuauucugauuuggggugauuucuggguuuuuuaccuauuucuggaagaacaaggaagugcacagugccaggcaccacguuguccacagcagggacuguaggaaugguacauugagaacugcugcaguuugucacaggccaccggcguuggcucugcuuugcuccucuggcaucagaucuguucugaugguggccacagaagagccucuuuccuuuucuuuuuuuuuuuuaauggcucccuugcugcugguuagaaauagcacuggucugccccaaguguaucuggcuaccugugcaaaaauuaaggaaguuuauaauucuaauuacauauguggaaaauuaggaccuuuaugcaagaaaggaggccaagaggccuuucuccaaagaagaggauaagcauccuguguugggaaagcuaaacaguguuaggaauugaggaugaggaaugacuguccuguacugagauuguagaaguagcaagcaguagguaguaugaaagauacauggauugaagauugugugugaacaugaacuggaaggagaaaagaguugacuuaaaucaggccauguucccuaagaaagagaucaguugauccagaggaugagaagugacagauugggccagaguugaauauuuauggcagguugguagcuaagugugcgaguacauccggggcaguauuggaucaugugaaggucuggcuaugauacuccacagucuaugugaagagcuguuaagaagacugggacuguuggcagggcaugguggcucacaccuguaaucccagcacuuugggaggccgaggcaggcagaucacgggaggucaggaguucgagaccagccugaccaacauggagaaacccugucucuacuaaaaauacaaaauuagcugggccuguuguggcauaugccuguaaucccagcuacuugggaggcagaggcaggggaaucgcuugaaccugggaggcggagguugcagugaucacgccauugaacuccagccugggcaacaagagcaaaacuccauuucaaaaaaaaaaaaaagacagggacuguucaugcaggugaagguacagucaccaucugcagauguuugaaucacugucauaugugaaacagaagccauauguccugcaugaacauaggggccuccacaaauguacggaagcuacagguagucagauuucaccuugagaaggaggaagggcuuuugaauaauccaaguuguuaagguagaauugccucccucaggaggaaugagauuccuuaucagugaccagaaaaaggauggucagauauuucucagacuuauuaauaagaauuuuaaacauaggaauaaugguucagacuaagaggguuuuaauuuugauauucuauugugauucauucaacaaauaauuuuugggauacauaguacuugcuagauacuguuccaaacuguaggaauguagcaguaaacaaucuauaagguccugcucucauuguaguuuacaguguaguaaggagaaauaaugagcaacuuaacuuucuguaaagaaaauauagugaaagugaggugagagcaagugacuggggaagcuaccuuuacuuuagauggucuuugaaugaggaugaggagggacugguagugagaagauucagagaaagggcauuucagacagaaggaauaacuagcauuaaaaauucaaaagcagaccugggcuugaaauacucagaaaauagggaaaagggaaaaagcuaguguggcugaagcacagcaucuggggcaagagugccaggagaugaaaccagaggggucuggcgggucagcuggggccuugcaggugguucaggaaguuuagauuucauuuuaagaggcaguggaaaucacuggaggcauuuaagcagaggagagacauaaucagaucuacacugugaaaaaauuacuuuggcugcugcuuagaaaauagacauugagggaauagcagggagguaugcuggucaucacagaggucuggggagagcucggaugcuggcuugcaccagggugauggcaguggggauggagagaagcaaugaguguguuuuggagguagagccagcgggacuugcugaugcauguggguagggaugguagaggaaggaaggaguuaaagaugacuccauaguuuuugcauugagcaaccgacuaggugguggcaaguguguacugaaacgggagggacuacaguucaggacaaguaggggagaguuuuguuuugacuaaguauauuuugagauaucauuuagauaucuaaguggagauaucaaacaucuacuuuagauacaggaauuuggaagucagaguguccucagaguauaaaugguauuuaaaaccauagguguaaaguaaucacguaagagugaggaaagagaagaggccuggaacauuaaaaaauguggaaaucaggaagguagcaugaagaaucuaaggagugaccugugagguaagauaaaaaucaagaugugguagauuucuagaaauuaaagaauguuucaagaaugagugaggcauuaucucucccuaaugcugcugagagacuaagauaaaagcagauaauuggauuugguaaacuggugacuuugaaaagaacauucucauagccauauugcaaguguagauggaggaagggaaggagaagcacccacucuuuccauuuuaaagagacuuuccagauuuucuccucaucucugcuuaugucauugaucagguggcuacaccuagcugccagagaggcugaaaacaucuuagcaggauuucagugugcucacuaaaauuggggauuauucuauuugagaaagaaggaugagagaaucaauauuuaguaggcaacuagcagacucugcuaugaaaguagaaagaggaucaaagaaaggguuccauuuuacacugcaacagagaaauucugguaagcguauaauugcaaaggaaauguuuugaaagugagggcaugggaauggaccacuagcaaguucacauuucauccaccguauagaggugaggcuacgugugguacagauggaaacauggugggcaaacaugggagauuuccuguuugagugggucuguucuuaaaugaaaugggaagcaaggucaucagauagagaaugggcgggaaagaaggggguuuagcaaauguguugaguauacauuuaagauuuggggccaugaauuuagugaaaccagucaucacuguacuuuuucuaauucugagauucaaugucuaaaugaaggggaguuuagauuagauaaaguauuguuaaaaaucuaacuacugucaaguauguguacugauaagggcuaugcagaaaucacguggaagugaaaggcagaagugugaaauuucaguucacuuuuuuccccauuugguaaugcuaauaauacugggugcgauugaauaaaaugauacuuugcaccacauuuagguucucuucacacuacauuugcaacuuuugaaauugugucaguacaauuaucugauuuuacaaaagaaaccuaaagagaagaugcuguaaguaagguaaccuguaauuagaauaugagcaucuguuaaacuaaagcuaaagucuucuugaguguugcagugggaaaguuuauuuucacauuaguuuugaugaaauaaacacuuauaaaauauuaaguuuuaugguuuaguuuauacccccaaaaaaggaaaauggcagucaaaaauauuuuuaaaccauuuuuuugguuuaagaccaucugcagucuuuugaauuuguuucaccaguaaagcauuuaaaccauauuauaaugauauaauuuauauuaagcauaaaauauuuaaauauuguaaaugcuuacauguaaaauaaauuagaaauuuaauuauauuaaaauaauaaaacugguaaauaguuauaacaaacuaugacuuuauuacaggcucuguagacaguuuaaaaugauuaagaaaauauuuguauccuaugagagaaagcguugacuccguaacagucaacaaggcccuugugccacccaugcuccaucuuuuacccauggcauagacaguauucucuguugcuggccuagcaugccauccagucuuuuucaacccaaggcuccaggcaaccauucccaguagacuggaguuggcaggcaaacaaaaucguuuguuaucacaggucuagaagaucaccaugccucuuagaaaggcuuagauuuaguuuucaaacuuuggauugagauguucaaaagugacauuuuuauuagcaacaucuaugccuguuuaccuucuaucauuucuccauauuuucugucagacauacuccuagcugugauguauaguauaaggauaagcaagccuuuguggguuuauaaguauaagguaccuaucauauagguaaaccagaguaggcauuuucacaagggccauucauccuugcccaaacacaaacaacauagaaaaaugucuugagaacacacagagaaacucauguuuuuaaaagcagcagaaucaauauaucaaaauacaucacauaaguaaacacaggcuugcuuuuucagacuuuuuaaaaauggaaguauaauguauacauugaguacuagacaaauuauuuguguauagcugaaugaauuuucuauuguauuaccacaaaugucaagaaauagaacauuccuuaguccccuaaaaccuucuugugcuuacaccccuucaugcccuucggagauaaccaguguccugacuuuguuaacaucauugauuaauuuuccuuuuuuuaaucuaauagaaucaauaaucaaauagaauuauuuuauguugggcuucuuucauuauguuugugggauucauccaugcagcugcaggucauuuguuuucguuacuguauaguauuccauauuuaaacauacuacaauuuauuuauucuuucuacugguuguaguguuuccaguuuuugauuuuguuuuuauuuuuugcuaggaugaacaaugcuucccagaacauucuuauauguucuuuuggugcauguaugugaaggaauuggguuacuggcucauaggauauguuuauguucagcuuuuguggauaacagcuaaacaguguccuaaagugguuguaccagauaugaguacagccaguguaucagaguuugugcugcucaaaguccuugucaacauuugauguuuacagcuuuuuauucauuuuagucauagguuucucaugauuuacuuugcaauucucugauuagaaucagaguuuuuagaguguagcugagcuaaagaaaucaaugagauaaucggaaacauuucuaaucaagcaagcuguaugugauugcauguacauuuccugaaaucagauccaaauagcggugugaccuugaguaagcucucgaaccuuccaagacaugguuuucucauguguauuuucugugggcuagguuauggucucuucaaacuuuaacaggcaauaauucuaaccaaaguuuuuuaagagucccgaaacucuucuaacagguacaagauuauucuauguuuuguuaagaggcugauugccauaucugaauccauaaugcaugcucauaaaaucccauaauugaagaagccaucacacucaagacuagcuagaguuccaccaaggcuuauguauuauuuuuaaguguuaggagaugggaaagcuggggcacagagguuuguauccugucagaauuaacaaaauuuuguauugaaggaaauuggugaauagaaaugagaauagcuaugaaacacaguccuugagauaaaaauuucccuaacuccuaaauaacauaguaagccuuuccacuagugcuaaugugaauucucgcauuugaguauuuuuuuuuaaaauaauaaccugaaagaggaagauguaguguggcuaaaguuggaaagugaauaaaacagauauauuggaaacauaaaaucuacucaucagaauuuaugaguauagaaguuucugcuaaaauaugcaucauguaucacaugggcuuguggauguguguuuuuuccagaaaauuuggaaagacagaaccuucuaggggcacauaaaguaugaacguaagcuuuuaagugcuaagagaaggugacugaaaaauauuuuuguugaaucuucacuuguuucauuuuuaaucaucucuccuacagauuaaagguauuaguucagcauagacuuuaguuuaaaaucgaaacagauguuuuugguuucucuguguuauaauuagcuuccuaugcugcaaguauacuuuucaaaauuguuuauuaagaauuggugcauggcuccuguccccauaagguucuuugagaugaaauuaaaagucuauguaaaagugugagcccuuuuguuacuuuuagaaugaucacaguucuuuuaauuaguuagggucuggugaaggggacacuuguuuuugcauuuuaacacaugacugcacaaaagggaagcuaauauuaucacuuuuuuuuuuggugccagggcaaauauuuuuuuaaaaaaggagcuccaguccugagaaauuaaugaauuuacuggaaccauauauuuacucaggaauuaagaauguuuccuuuuuuucugggguaaucuguuggugggaugggaaggcaguuuauuaaaggaaaaagaguugaaaaauuguugcuucccuccuccuaaaaugcuguuugaaauauuuaugucuaagauugcacaucugaaaaugugguuggaugguuuuuucccccacuuagaggagaaaaacuucaguaguuuuuauuucauugugauuuucuucaugccuaaggugcuaacauaaaacagagauagaugugaaaguugcuaucuuguccaaggaaauuuuaacagagugugacaacuuuucuucucuucagugacuuuuccuuuaugacugaacaugguguuuauggccggauaugagugaauucuuuguuuuaugaacuaaaucuuuaagauguggcuccaagaugcuucaaggagcuuuaucccucacucuccuaucugugaaccauacauaugcuucugcccugaacaugaacuuucuuacccuugguuccaaccccaaaccauaguaaugggugucuucacucccucuguuuaaucuaaguguaaaucuuagugguucuaccggucagaucugucugugucucuccaucucugccauuaccacauaugcucaagcugcugcuauuucuuuggaugacugcagucuccaaauuguucuccucacuuccauuccugccucuuuccgucuucuccaaauaguugccaagguaaaccuguaaaacuguaaaucagaucaugucauccuauagcuugaaaggcaacaguuaaauucuguggcuuuuauaaucagauauaaauccccaccaugccccacaauauccucaagaucugaucccugcccccacuugucaacuaccacucucucccauggugcugcucugcugcuccacauuccaccagguagaucuucuuucugcuuagugaacagucagcucauccucaccucagggccuuugcacuugcuccucuucugcuucagacaucuucccagaucuacauguaacugguuucuuucuggcauucaggucuuagggcccaaagcucacuuguuuagcaaugucuucccugccuuaucauuuugcuuccuccagucauucuuuuucucauuaaccuguuuuguuuuuauauugccuuuuaucaguaaauuaaaguacuauuauuguuuacuuauuuuuuuacuuuccuacuaaaaccuuggcccccagagauaaagggcucaugucuuggcuacagaaguauuuacacauaauuuuauucguucauuuuuuaaugaaauugagaucacacuauacagguuuuuuggugcuuacuuuuuuuuucucuuguuauugguugcuuacuuuuuuaugugguuaugccauuaaaugauuuuaauuaauccuucauuaacagacauuuuauccuaaguguauauguuuaaaaaccugagaaccuaaccauuuguggugccuccacaaaugaauccucugaguucucuguagauaaagugucauggugaccaugugauaaaaauccucauguguauguuuugauacuacauuuauuuaagaauuucuauaauaaugacuaguuauuuuccaacaugaucuaugcucaguaauuguaugacaggguaguuucucuuugauuacacauauucaugguuaguuguguaguggcuacucaacugcccugugaggcugucccucuguacauuuugguugauuuggugcugaaguaggaaucgaacaguauaaguuaagcuuggcauuuaguuuugguuuccuguagugauuuuggcaauuaugguccucaucucuuugaucccuuuuuguuguuuucaccaauuacugaacaauguuuuuauuaaacaguguauuaguccauucucacauugcuaauaaagacauaccugagacuggguagcuuauaaagaaaaagagguguaauggaucacauuuccacauggcuggggaggccucacaaucauggcggaagacgaaggaaaagcauggggacuucuuacauggccaugggcaagagaggacuugugcaggggagcuccccuuuauaaauccaucagaucucaugagacuuauucacuaucaugagaacagcacaggaaugaccacccucaugauccaauuaucucccacugggucccucucacaacaugugggaguugugggagcuacaauucaagaugugguuuggguggggacacagccaaaccauaucaaacagugauugcccuuuauacuuaauccaaacuuuuuuucuuaaagcaauuguuaauuggugugccuauuaguugcuuaggaaaaaacuagaagucauacaagauauuauucugcaagucuugguacauuuauuuuccuacucuucuuucucauuauaguaucauuaucauuaucauuauuugaaguuacguauuaaugauauugaguauggccaccuacuucuuuaagauaguuugccuuuuauuccauauaaagucaaagaaaaugcccacagacaucaccaagauacuguccuagucuguggacuguucuccugcuugggagcauggaaaccuucaacagauauccagccaaggccugcuuauuugugaauacccaguacacugccuugcugcugggcaugggaggagaguggggcaggguggcccaaguacacccagugauuuuaguuguaugguauuuccuauauacccugcuuuguucaauaaucucuuucuggaagauauguaagcuaguauuuuaaaacuauuuuuaauuaacuguuuacuuugugccuuguauuagguaucuuuuauuccuuuuuuugugcauugcuuuugaucuuccagucacccuggucaggugagaaaauuuagguuuggagugguugucacuugcucaaguuuguacaacuguuaaguggcaaagcugguauuugagcccaggagagucugguucauauaacaugguguauuuggaucaugcuguauauuguaccaggguguuacuugugcauuuauguucauucccugugugaguauuuauuaaacaccugugaugugcuagggacugucuggaugcugaagcuaugucagcgaauaaaauaaaaauaccugccuuuauggagugaaccuuuaaugagagaagacagacauaaaauaaauaaguaaauuaugucauauguuagaaggagauguuaaguguuacaaaaagaaacaaugacaaaaacauaccggcaugugcuggagagggguuugcauuugauaaauagggugcacggggaguugggauggaccauacugaggaguuccucguugagcacauauuugaaggaaggaagggaaugugucccacaguaucuagggaaagaguauuuuagauggggaaauagcauguccaugggcccucagaguuaagcaccccuggccauuagaggaauggagaggagggaagagagagaguugguaccaggucagguagggccuugcaggcugguguaaggacuuuuacucuggguggagcaaggguuaugaggagaggagugcagugcuggugcagaggcagugcaauguuggacucaaccagaauuuuagauuuugucaagugguuaagaagggagagaggggcuuaagauauaugcaagagucuggauauggacugacuccagaguuuaaguugguuagggagugggugacgacauuggaggugaggaaauguggcagaguggcaggaucaauggauggcagguuggaguuggggccaggggagugagcuggacaugcaggaggugauuucuaaguagauugccugaaaccaagauuauggaagagugacaguuccugguaaugagaagguguuugaugggaucuuggaguguguggcugagggaggguggaggacagaaucauuucaguaggagacgugugcaaagaauggaggccagcaggaugguggaaggaucgucagccuguguauugaaaucacaaaaaaauuaagauaggagucauguuggacagaauggcagcgagccagaaacuacaaccaaugaagagugaggggcggcccaaggaaccuaaaaugacuaaaccugcaguggguggugaucaugaggccugauguguucugcgucugucuguuauugugcuucuugucauggggucuuuauuuuugaauuuguccuucuuuucugaguuccuucagucucuaguuagucagugcaugcauguuaucuggccaucucuuaagaguucuuuugugaucuuccuuuaaacugugauuacuucauugaguuuuuuuuuuuucuuuuaauccuguggguauuuugggguauaauuuuuaccauauucacuuuguggcaacauguucuccugcugugaguucuuuuagggaguuuuacuguucuuuuccacauuuuaaaauagucuuuugugugguuacucuccccauuuuuuuuuguuuuucaauggaaugaguuugauuuuccuggcaggagauuccuguggagggagagggaagugcccauuucucugcucaagggcucuauucucucugcugugcugugcugugcugugcugugcugugcugugcugugcugugcugugcugugcugcacugagggacuguuucuuuccuccucugccucucagccccuagccugguguaggagggcuucccgcuccaucccugaugucaucccaaucacuucaucggccccaagaugcacagacaccucuuuccaagguguuccccaccugguuuuugaguagggucggcagcccauggccuccugaaucuguuccgugucuccuuuucccaccuucuccagcagaguccccggugcuucucagcccugcuucugcccauucucacucugggugggaucagcucuucugaugauuugcuggugacaguguggagcucugcaaccccgguuauucuccgccccacccauacggcuuccugcucaggaccugcuauuuucuguugcuuuuggccguauguacacguuuuugagaauuuggucauauuuacacauuuuguguuaauuucucugaaaauguaauuuuuauggguuuucuaccugcucccccauucuauaauaugccuugaggagggaagaaggaggaauauucagaaacaugcuucuaccguguuucuauaagaagcagaaaucgauuuucaguguuuuagaaacagcugccagcauguguuggcaguuagaacugaucagaaaugacugaaguaaaagguuugggaaucacugccuguaaacuagaggggaacucgugacaacaauucagcugcuuuuggagcaguaggagaauuauugggcccucgaguggaugacaggaaggaagcucaucaugaugggcaaaagaugugucagcgggguuggggaauugcaaggcgcaaggccucaccacugcccaguccuuuccuguuugcuucuuacacaaaucacauuguuauggaaccguuguugcuucugauuccagacuaccucagagcagguaaacugagcagauccaugugaaaaauguuaggaugaauaaauuugcuaaaagacccagcuuguaauguuccagccaucuagaaguccaaauuauuguuuacauacaauuuuagaugacuuguuuuuguacuuuauuuuuaagaacugugcccucagauuuaacccuuuauuaaucuacaauagcuuuaaaaugcccccaaauuuccacugauuugaccuuuaugccuuucuaccuuuaaaguauccgggaagagaaccaaugacaaagugaaaauuaaguguguuguaaauuugagauugcuuuguggaagcgggcuaugccuucagauauucugugcugggaaggggagcacaggaagccaguguaguugggccuugcggguggaugcucuccauugagcuuccagccucgagacucauccuuuagaagauccuucuccaucucccuucccacacuuucucgucucugcaguuuggaucagugcuuuugcucacaaagaagacaaguguucucuucaggucauaagacagagcaugagauauacuagugcuagaggggaaaagccagaauuauuuuaguagccauccuucacauucuccaggaaguuuuucuacuugugauacacuuuuuagaauuuuaauacacuuuucuugguuuuucuugaaaaauagauagacauggguauuucuaaugauacauuuuucucuacacauuguacccuauaacgaaccuggauccuaacucuaauuguacaagacuuauuaguaauaacaucuuguacuuuuauucuuacaaagaucuaugccauuucuaaaauguuuacauauauaucauccuuuuuuuuuuuuuuuuuuuuuuuuuaagacagagucccacucuguugcccaggcuggagugcaguggcacaaucuuggcucacugcaaccucuuccucuggguucaagcuauucuugugcuucagccucucgaguagcuuggacuacaggggugugccaccauacuuggcuaauuuuuguaucuuuagaagagauggguuuucgccauguuggccagguuggucucgaacuccuggccucaagugaucugcuuaccuuggccucccaaagugcugggauuacaggcacgagccacugcgccuggccuauaucacuuuguuuaacacuccaaaccacccucuaacaaagcuagaggguuugauagacgaggaaagauuggagucuaaaacagaguuuguuucuuucaauauuuagauuuuuuuucuaguccuguuuuaaauaugucacuuauaugcaacugcuagauacaugucacuggcacauaguagcugacuccucccucccaauuacgggcuauaacuaucuuuugucaauugauauuuaucaucucuacaauucuuauaauuauaucauagauuauuaaguauuagcacucaaguaugguucacauuagauagucaagaaauguaaauaagaagcugaacacuuaaaaaaaacugagaacucccucauaagacaguuuuaaaauacauggagcaaacacugacaaaacugcaaggaaaauagacaaagccacaauuauggcuuucgguacccuucucugaauaauugauaaaacaaguagauacaaaaucaggauacagaagauucaaaguacuaaucaccuugauggugacagccacuuauagaacagucuauucaacaacagcagaacacacguuuuucucaagugcacccagaacauuuauuaagauagacucuauuccugucauuaaucaagaguuucaacaaacuuuaaaagauucaagucauacaagauaauauuccuugacuacagugaaauuaaauuagaacucaguaacagaaagaucccuggaaaauccccuaauguuugaaaaccaaacacauuucaaauaagcuauggaucaaagagaaagccaaaaagaggaauuggaaaauauucugaacugaacguaaaugaaagcaucacauaucagaauuuguuggaugguauuaacucaguacuuaagggagcacuaaacaccuguauuagaaaagaagacaggucucaaaucaugacgucaguuuucacccuaagaaauuuagaaaaaacaaccgaaauugcaaagucagcagaacaaaggaaauacaaaucauaguggaaaucgaagggagaaaaaaaaucaaugaaaccaaaagcuauuucuuugagaucaauagaacugauaaacaucuaaccagacugaacaugaaaaaaauagaagaaacaaauuacuaauaucaggaaugagagagaugauauauuauaaauucuacauauuuuauauguaaaaaucuauacauauuuacauauauucuguacauuacagaaucuaucauauauuuaaagguuuuuuccuuugaaaugguuuuuauuuuauuuauuucacuuuaagcucugggauacaugugcagaacgugcaggguuguuacauagguauacaugugccauggugguuugcugcaccuacuaacccaucaucuagguuuuaagucccacaugcauuagguauuuguccuaaugcucucccuccccugccccucauccccugacaggcccuggugugugauguuccccucccuguguccauguguucucauuguucaacucccacuuaugagugagaacaugcaguauuugcuuuucuguuccuguguuaguuugcugaaagugaugguuuccagcuucauccauaucccugcaaaggacaugaacucauuuuuuuuauggcugcaauuaagagaguauuauaaacaacuuuaugacaauaaaguugacaucuuagaugaaauggauaaauuccuugauagacacaaauuaucaaaguucacucaaaaagaagucaguaaccugccuagcucuauaucaagaaauugaaauuacaacuuaaaaccuucucacaaagaaccagacucaaauaucuucacuaauguaaucuaucaaauauuuaacuaauuguacacaaacuguuccaaaaaauugaagaauucguuuuagcaggucagcauaauccuuauauugaaaccagauaaagacaguaaaagaagagaacacuacuaggcugggugcagugguucaugccuguaaucccagcacuuugggaggcugaggcuggcgaaucaccugaugucgggaguucaagacaagccuggccaauauggugaaacucugucucuacuaaaaguacaaaaaauuagcugggcaugguggcgggcaccuguaaucccagcuacuugggagacugaggcaggagaaucgcuugaacuggcagcaggagguuccaguaagcugaggucacgccacugcacuccaggcugggcaugacagagcaagacucugucucaaaaaaaaaaaaaaaaaacccagaaaaaaacacuacacauccauuucaucucaugacauaaaugcagaaaauuuaaacaaaauuuaacuaaucaaaucaccaauauuuuaaaaggauguaacaaguggaguauaucccaggaauucaggguugguuuaauacugaaagagcaauaaauauuguucauuauguuaacaaacuuaaaaagaaaaccuauauaaucaucucaauagaugcagaaaaagcauuugacaaauucuacuuccauuccuaacaaaaauucucaguaaacuaggaguagaagugagcucuuuaaccugacaaaagaucaucuaugaaaacuuacagagugucacacuuaauggugaaagacagaaugcuuuccuuuauaagaucaggaacaagacagggaugucuugcccucaccacuucuauucagaauuguacuagaggauccaucuagugcagauggauaauauaaacaaauaaaaggacuucacauuaggaaaaaaagaauuaaaaccauuuguauucacagacauaaaugucuauguagaaaaucugauggaaucuacaauuuaaaaaagccugcuagaauaaaaaagucaauuuaguaaguaucugaucaauguacaaaaauaaauuguauuucucuauacuggcaaugagcaaucaaaauaaaaauuugaaauuuaaaaagcuggcauuuacaauaacaucaaacauuaugaaauacuuagaaggcaauauaagugaaacacuugaacacugaacaguacaaaauauugcugaaauuaaagaaagcuuauauaauugggaagauauaccuugaucauggaucagaagacaauauuguuauuugaacagacacuucaacaaagaagauauacagaugacaaauaggacauaaaaagauguucaacaucauuaguuauuaggaaaauacaaauuaaaagcacggauaccacuauuaaccuauuuggcaaaauuuaaaagacggagcauaccaagugcuggagaggauguagaggaacagaaguuuucauacacugcagguggaaguguaaaguggcaucacuuuguaaaauaguuugacugauuuaagaaagcuaaauguaacaccugucauacuauccagccguucuacuucuauuuauccacacacaaaaauuaaauauaugcccauacaaagacuuguagggcauauacuuauaggagcuuuauuuguaauggacaaaaacgggaaacaacacaaauguccaucaauaguguuguaucauacaguggaauacucagcaauaaaaggaaugcacuauugauauacacagcauggaugaaucauaaaauaauuaggcuaacuuaagccagacaccauccuuuuucaaaaacgaauaaauacucugugauuacauuuauauaaaacuuuagaaaaugcaaaauacagaaagcaacagaaagcauauuagugauugcuuggugauggaggggggaaggaacagauaugcaggagggaggaaauugcaaacuacaacaaggaaacuuuugagggugaagaaucuaauaacugucuuaagugugaugaugguuuuacagauguacacauauguccaaacuuguaaaacuauaguuuaugcgcuuugucaguuguaccucaauaaaguggcauuuaaauaaaaaacguuaauaagaauauuccuauuauucauuucugaccuucaagagaacaacagacucuguugagcgcuuacuauauccaguacacggugccuaccuauauuguucucgguuaaaguuuaugacagcugagaaauaggugcuuucucacuguugaagcaauuauagcuuggagacauuagguaaauugcccagggucagcagccaggaagaagugagauaucaggcugucuggcuccaacucuacuugcuggucagccuucaauuguacuucuuccucagugugauguggcugagucuguguuggaaucucaaaaucaccuguccagggauuuuacuaaccauuauuuuuuuuucuauguuuggcuguuacaaguugguuauuuuacguugaaaacagauguuuucugcuaaaagagaagauagcuauucuuaguuauuuggagacaguucuuuaaagguacucuguguguguguuagguugaucugccaugccgccacagccuggccagucucauuugucagacagcauccauuugcuggugaagucugacgggugguaacauuauguauuaauagccccugauaccaaauucagccuacaauuuuaugacaaacuauucuuuacuguaaagcuuuuuucuuaaauaauccacuagauggcagcagacccacguggaacagaauggaucuucauugcuguagaagagccagaaacgggacacuguuuuguuuuugaugacccaguagugcaucuuuuucggauguguaggaaaugguauuauuuuucuguuaugaaaaauguaacauacucuuugaagucacgucuguggaagugaguagugguacagauaguucaaaauuguagauaaugcaaaaauaauuuuuucuuuguauucucguagagacacauguugauuuaauccuaccuguaugcauuagaugaacuuuucuucaagaaacuguuuauucuuaauucuuuuuaugguuggaaagacugcggcuuguuucaugaguuuuuuucuuuaauuggaccuaugccaaucaaaauagaagaugacuguccuauaaauucauagcaccuaaggcuagauaaugaagugaaauccuacagacuggacuugggagaaaguaggaggauuauuuauuuuuccagaucaccauacugcuugucaucugacuagaaaccucuuaucucccuuucucuaagcuuauuuuucucaagcauuuuugaacauggucaauuggggugucgcagaagauccugugaaccacauauccuacuauccauaccuucuagaaggggaagaacuuaggagauggccaaaaaccagagaguaauaacaugauagagugcuaacaauauuuuugcagcaaauaugcuauaaaaaugcucauccaaaacaaugaaaaaguguuuuguuucuaaauuaguauaagagcagcagaugaaaaugagguacucaagccagcaccuaugaugggugaauagcauauucugagaaucaaagaacuucaacucaguguacaugcauguucaauggaaauuuugugacauuguuaaauauuuuacuagauagacuuaaugcagugacugcaguaggcccuccuuuuccauggauucugcauggauucaacuaaccauggaacaaaaauauucagaaaaauuuuaaaaauaaaacacaguacacuauaacaauuuacauagcauuuauuauauauuagguauuguaaguuguguagaggugauuuccaggaggaugugcauagguuauaugcaaauacuaugccauuuuauauuagaaacuugagcaucugcagauuuuguugucuuugggagguggauggagggaggcauggaaccaauccucuagggauagugaaggaugacaguacauucaaauaacaugccaaguugaguuuuuaaauacaagguuuuaguaauuuuuaauaacugaggacaaagacuggccaacuuucccuguaaagggcagauucuuuuagacuuucuuucauuuucuuuuuuuuuuucuuuuuuguuaacccuuuaaaacuguagcaacaguucuuagcuuggaagucuguacaaaaccagguuucaggcucuacgggccauaauuuguugacccugguguaggaggcuaaugcuaguaguauauaaaaucaagucuguggaaucuuggcaguucauaaaacccagagaaagagcaggcguuucuuccuugaucacuuucagcugggaagaaggauccuugugauccacugccagaccuaaacuuacuuugagcacugcuggaaacaucuaacaucucaauucaacuccuucaaauuacuucuucaaucuagacacacuuauuuuuucuuuguuugcuuugucaacugucacacaccuggauuaugaaauaauguguuuuaacaucuuuuacuuucaguccuuuuagcacauugaaaaaaguuuuuugaaaaccaagaaaucuacauucuaacccuagcucuuguacuaaauagcuauaguuuuuggaacaaguuauucugucugguucucaacuucuuuguuuauaaaauaggauugaacuaauaccguauaauauuuuuuccaaauuugauuuaguaguuucagauuuauguuccuauaagcccuuuaucaccugaucagaugaugccuuuaauugauccucaaguguagaccugcucaauuuaaaggaaugcaaccaaauuaauguucacguucagaagcccucucgcugugccugguacguagcagaugcccaguaaauguuugucgagugaaucaaugaaugaauaauaaaugggcauaacuaccuuucuuaacucuccauuuauuuaugcuguauguuuuagaaauauauauuauuucuuacguacguuuugaucuucccaguauucuuuuuaugguucacucauaaaacuauucauugagggucaacaauaugauaaauucuggaaaaaccaaaaugaauaaaacuuaggccuugccuucaagaaauuugccuucuaguuagggugacuaauagguauucugaucauuucaguguaggucugaguaugauauuagagguuugaaucuccaaacugaaauguccuauuucuuacccuucaaaccauuacaaaugccaccuucauuacagcuuuuuggauuguccuccaauagaacacacauauuauaggucauuguuugaaacauuguuauagcauuuguugcugcugcacccucuuugaguuuauaugguguuuguacuuuugggguuuuuuuguccuuuucuaguuuguaugcugcauaaguguagggggccuugucuuccauuucuguucaugagaagcucucauuaguuaaaugcauucuauuaggcaauaacauaaugguuguuuucugagaggcuucauuuuaugagacauuguauuaucuuaaaaaauuguuucagagugacaaggagguuguuagccagagccuuugauuuuuaagaaauuucaguaucuauaaaaccuaaaucuacaaaaccaaaagcacagaguaaauguagcuuuugauuauaacuagauuguuagugauagugacuaauacuuucauuauuaaucaccuguaugauaaugaagguaagcaauguucaaagaaucuuaaaacaguuuuguugcuuuagcaaccaguuuuuuucccccuccaaagauuggcucuguggugcuacuucucaguggucauauuauaaccaaaaagaucccaaucuaauaguaguuuuggguauuagguggcccaaaauaaauuucacuauaauuuaucccuuuuguuuucuacagugaacacgccuccuuuuuucauaccuaagcuuaaaaacaaaagcuccugcgugacacacugcugcuaucccucaugcaacgagaacuccuuucccauuuccacagaagggauaaaacugaggucuauucaguuccuguagccaaugccaaauuuagggggugauuuccugugugcuccuccucuuucagcaaaacugaacagcaguauuccuuagccuguggaacagugucucagaguaaccacaaaugguacauucuauauauaacaguggaggaaauagggaaggagacgaacaguuaauauaucuaaauauauacauugcagagcaagaaaaagaauacuggcaggugcuaaguuaccacucuacaacugaucacaggcugcaguuuguauuacuauuuuccuguuauaauaaccauuccacuuuccucuugccuucuuucagcaccucugcuguuugggauaacccagauuuucagcccuggguccuuguugcuccugcucacaggcuaugugguacucacuuuuaugagugaagauggcaguauuaucaggcccccuccaguucaucucccuuuuacuuguguaugagcguaccccaaauuccgcuuaauaauuaccucaaucaacauacuaccuuggcccuaaaugaccaguuguagucuugaaaacgugauuguuuuccucccuuggauguugucucuaagucaccuugagagauggaaaaaauuguacaaauggauaauuagguguaaucgugaaauauuggacuuuacuucgaccuguuacuucccaaauccaaguuucuuucuggcuguaggugaaacagcaccauggaguggugguucuuugagaccauaaggauccuucaguuucccaagaugcuugucucccagguggugccaggauugagucucaguaggccguaaacauucuagaaguccagcagcuucuagauaacagaauacauggcagagcagugaaucccauuguccuuggaacaccguuaauuuuuuuucucuguaauuucuugagcagaagcaucgguguguggaacaccuugauugugacuaauagguggauuaggagucugguagaagcauggggucgggggaguggggacgggccacagggggcacagugggugcuuagaggaugcauaacagaacccagaguaauaccauugaagugaauauaaaauucugccuccuccaagauggaaggagcagcuaguugggucaacccucaacaacggcacaucacuaguuuacuuuuuauuuuuaaauuagcacguuauugaaaguguuuguaaagauaauuagccauagaaaauaaaauggguaaaaucaucucuguagagcguauggaugugcaucugggaaguccaaaggaugaaugaaaaaauuaauacaaaaaaucaaacaaaaaugauuuaauagaguauaacaugagauugcuauugcugcaaauugguguacggcaauacccauggucaugucagucugaguaagaggaaauccauauuguugagucuauauguggcuuuuguucugacagccauugcuaguuuauuauuucacugaacaagugcuucaggaguuggggugagggauaggcugacugacauacguagagcaaaauguagaaaggcuguaccaacaagauacaauucauggugaacagcuagagucacuugguuaccuuguaccauuguuuauucuauccagggcucaguagcaaggccagaacaagucucaaaaggaagguuuugcuccaacauucuaagggaccccuguguuuuuccuauugggauuugcuacuaguuuucuucggugcccugaaauugcacaggcuugauguaccauugcaucagcugggucauuaaagccaaguuguagaucugcuuauaccaccacuugaacucgcuggauggucuuuucuuuuugggaguugaagcuaaagcugguaaccuuugggucauucaguaaaggguggaagcagcauaaaaagucuguuucucauuuguacuugaggcuacaaagaaaagcacuuugcagaaguaugccaguuaucuacagauuaauucaccaagauuuuucacugaggaaacacugcccuguauuuucauggauuuauuuucuaccugcuggcuuacuuaugcuuugcaggcaucuaagaguacauguugccuccugcuuuucugguccuaaaagcagacguaaccaguguauuggacuaauguaguguccuguaggaggagaugauccguauccuugacaacgaaauuguaguacaaagauagacagugugcauaaccgugagauaagccugugaaggcucgcugaugucccaucccauugauagcaaauccuuucucauguucucuguccuuuaggguagagcaaaaaguauuugccauauaagcagguauauacagguugcuagagauugugaugcucuguuguaguaaauccaucacauuuugaggaacagugcaguuggagucaccaccugaauaagcuuuugcuaguuaucaugagcauuagccuucugcauucuccagauaggccgguuaaaugggaaugagaggcauguccacucccugcucuuucuguccuugaugguggcauuucugaguaauucccagggaauagauaaugcccuugguuuuauuuuuuuauuagaguggguccccaggggcuuccaaugauuucuuccuuccauaagagcccuuacucagggaguaugagugagaacuggggguugcucaguauaucuguucagaaaccggaaauuaccacaugguggaacuaggcucccauugggccugucagaauccauuucuacucaauucuuuaauuggcugaguaauuuuauauagcauucaugugguguacuuguuuguacuuugcaaaauugauaugcauuucgguccuuuuuuugcuauucaguuuauucaugaauauuaaaguuccuauucuuggcccauuuuucuuuuuuuuuauuauacuuuaaguucugggauacauguacagaacgugcauguuuguuauauagauauacacgugucuuggcccauuuuucuacuggauugucugacauuuucuaaauuauuuauaguuauugacuauugcucccucuuucuuauauauuauguagucuuuaccuuuuguuuuuaaggccuuugauuguaauuauauucucaacugcuuuucauaauuuuuaccaaucagaaacauaaaaguuuaauuaucagugaaguugaaguuuuguuauguacacauuugccuuuuguaaauugcaagauuauaaccuuuguccauuuuuuacugggcuguuguucuguuaccaaaaauaauuaccauuguaguuuaaccucuuuccucaucauaaccugcaguuacugucuccuguguguauaugaacacacacuuacauauauacuugugauauauguacacauuuuuuguauaacauuuaaccaaguuauuuuauguagucaaauuugucaauauuuuccucuguggauuuuaguuuugugucaugcuuagcuaauauuuuauaucucuuacuccaagaucauguauaagaucauauaauaaaaacauuuauauuucuuagagcaguuuaauauuuucaauuuuacuauuuaaauuaaugguuuauuaaaaauguauuuugcuauaugcugggagguaggguucuuucuccccugcccaaaugguuagucaguuuuccuggugucauuuauuaaauaauuuauuuuuucucacuugcuaugauuuuuuccuaaagaacaauaacacuuuagaguugagauaaauaccugccaauagucuaucgaugcccauacuacaguuuguauuaucaauacgcuuaagaaaauaaagccccuauaaggcaguucaagaaaaucuguugagguugagagggaauauauagcuaauuauaagcagccauaaguuaaacacggcaaacaaaauuuguuugucuuaugaaaggaaaaaucaacccccaaaaagcaaaaauaaauuccuauuaaauuagccaaaugcuaagaguugcuauaugcuuugauucuucucuaguguuucuguuuuucagcuuucacuuaaaagcaguauuuauuacaucauucgcggugaccaaaauuauccugcauuuuguaauacuuuaucauucccuugagcauguaaauaaugaauaguuuuaaagcauuuaagcuauauaaguaaaccacucauuuaaauaaaaagaaugaggggguuagauuguuaagaguucuuuggauuuucagcuuauuucuacuugacguuuuauuuauguaccaugacauuuuauuuauguccccacauacauaaaacuguagguccuccccuuuuguguagagccuuuuuuaaaaaaauugcaauagucauagacuuccggauugugaguuuaacaugacuuuuaagcccuggacuuuuuauuuuaaaaucuuuucuaaaccucacaaaauauauauauaaguauauaguacaaugaaccuuucaccuggauuugccaguugugggcauuuuucaacuuuuguuuaauguguuuuuuacuuucuguauucaaauuucuccaguugucccuaugauuuucuuuauagugcuugcuuuuuuccugauucagaauccagucaaaaaucauacagugucuuuuggguauuuuaauuccuuaauuuagaaagcaccucugucuuugucaacuuuuuuuuucccuuuugugacauugacgucuuuaaaugcccaggcaaguuaucucguagauugucccacagucuagacuggucuaauuucuuuuugugauuagauucauguuaaauauuuuggcaagaaaaauccucagaucauauuguggcuuucucgcugcagcaugccacaagguucauaaugucaguuuuuuccauucucacugcuaaauuuggucauuuguuuucagacaacagauuuauauaugauaaaguuauaucuuuuguaauuaaugucaucuguguggugguaauuuaaguuguaugaauguccugugauuuuagcauuuuuugaugaccuugcugaaaucaguuauuacauggauaauugaaaaaugauuuuuuguaauucuauuccucucauuuauuaacaauaacuuauuuauauuauauucuaaugaaauauguaauuguuacuuauuuccucacaauuuuuaugcuaguaguguuaaagucugugugcccuuguauuuacuuaauaauauccugaugggauaaggaagaagauaguauuuuugggucauaagugcauuuucacaaguuaacauucucacacaauuuccucuugaaaauuuuuguuacuaauuagauuuaaguaaaccauuuaguuauucuuuuuuccaguuaauauuuucuauuuucaucuuuguuuuucugucucuuuucaacugcccaauugcuuguacauauuaauuuuuaacucuuucuguuaccuuaacuuuugugacaauuaauacaugaauuuucuauuauaauagcuguggaaauacaaagaacucugaaucaacuuggaacaccucaagauucaccugaauugaggcaacaguuguaaguaucuaguuaaauaaauaaaagagaaagaaaaaacucuauugcuauuauucuguugcuuuuacaguauguaguauauuauguuuacuggaagaaaaaauggaaaaacaauggaguuuuucugcuaccuuauccauacauuuguaccaagcuuuuguguagauuuuucccugucuggaguaggcagguguuuuuauauuaaagaucuggaagacugaggugggcagaucacaaguucaggaguucgagaccaaccuggccaauauggugaaaccccgucucuacugaaaauaaaaaaauuagccaggcgugguggcgagcuucuguaguccuagcuacucaggagccugaggcaggugaaucucuugaacccggguggcggagguugcagugagccgagaucacaccacugcacuucagccugggcgacugagcaagacucugucuuaaaaaaaaaaaaaaaauuccuugauaggcuuacccuaucaaagcagaauuucuuuaguugcauuucuuacaguuuuuagguagguuguuuuugacagcuguugaaaaauuauacucuaguaucucaauuuaugugauuuacuuuccauagcuaaaaauccccgcagucaccagaguuuuauuugguuuagauccaauacauaaccagcuacgugagcugucuccccacaaguuuauaccuacauccuugaauuucagagagcauuagcuuccguuuaaaaaaaaguuauaaugaauuauauaguacauauuccaguaaauuaauaugcuguuagaagaccagcagucauagugauaauauuuugucugugguauguuguggauuuuacagaguauuuuuacauauuuuaucauuuaaaccuuacagaauuagaguaagagaaauagaccaaaagaacuguuuccauuuuguucaugucucuuacggguuuaacgaguuacccaaugucauuuagaacuuaacucuuaaauuuuauuucaguacuguuacagcuguaaauuucaagucacauauaucuaguaagcaauacuucuaaacaacauuaacuauagagggaaaacugcaaagaggacgauauuaaaagauagguaauaggaauucauauuuuuaggaaguacaauuugaaggacuuacaauuaucucuaauuuauauuuuauuuuuccacaguggguaagugucagaaugguaaaaaugcuccaaaucuaaauaauaaaccacaauucauuaaacuaaaguaaaauggaauagaaguacauaauucauaaaaguucuaauauuuugauagaguuaauaaugaagauucugaauauauauccguagucacuaaggauuuuuuuuuuuuuuuuuuuuuuuugagacaggaucucaugcugucacccaggcuggagugcagugacauuaucacgguucacugcagccuggaccuccuaggcucaaucgauucucccaccucagccuacuguguagcugggaauacaggcacauccaccaugccuggcuaauuuuuguauuuuuuguagagaugguguuuugccauguugccggcacuggucuucaauucugggcucagacaguccacccaccucacccucccagagugcugugauuacaggcaugagccaccauguccagccuaaggucuucuuuuuaaaacuuugacuauauuaugauuuccagagauuuacaaaaaugcauuaaagauaggguauuugguaaauagagauagaaauagauuuuaauuacccuuugucagucaaauacagaucccuauucuuaagcauauucuuauacaauaucucauuauuuuaaaggaccccaagugugaccagaccauauuuaaaaugagaugaaauauauaagagguacugauguugugauuuguaaaacaucacaauuaauaugagcuuuuuuuuagugucauguuuuuaaguuggaaaucuuuucaauuuauaagauagcuagauaaaauauggauauguagucagcacucuguauccauagauuauauauccccagauucaaccaacugcaggucaaaaauauucaagaaaaaaaaaaaaacaacacaauaauaaaaaaaaaaacugaacuauaaaauauagcaacuauuuacauagcauuuacauuauuguauuggguauuauaaauaaucuagagaugauuuaaagauaugggaggauaugcauagguuauaugcaaaugcuauaccuuuuuauaucagggacuugagcaucagcggauuuugguauccacagggguccuggaaccaaucugcagauacugagggaugacuauaauuuacuucuuuuauuuauuguguucuuucccuuuacaaggaaaugccauuauuuuuuccagcguaaacuuaaauaauaguaaauuuguaccaauauugccucuuuccuuuuuauuuuuauuuuuugagacaagaguuuuccucuguugcucaggcuggagugcaguggugcaaucucagcucauugcauccuccaccucccauguucaagugauucuucugccucagccacccaaguagcugggaucacaggcaugcuccaccacaccuaccuaauuuuuguuauuuuugguagagaugggguuucgccauguuggccaggcacgucucaaauuccuggccucaagugauccgccugccucggccucucaaaguguugggaugacaggugugagccagcaugccuggccccucccccccgccuuuuuuuuaaguaucuauagcauauacauguucacauagagaaauaagagaggccagauauaacuagaucugggaacugggcaaagucuaagguaacaaaucuuuucuugcuuaccugaccuuccaggugugagaugcagauaaagggcuuccacauccccaguaucucaaacauaaaggaucagacaucuaacagucucuccuucagguucccucugauucaagucaucuguguuucuaaauggccguugaauugauuucucuaagcuugccuacccugugugagugaagaaccugacauauaauauuugcucauuauuuaucaaagaauaggauaugaaauuuuuuuugauagagaaaguugagagccaguuuaugaaaaggcaauuuuuguacaacuguuuaucaguguugauucaaaaggcagaguugaagcuuaaagaaguauauuaguccuuuggcuguaaugcguguuuucucacuuuaggcaacagaagcagcaguauacuaaccagcuugccaaagaaacagauaaguacauuaaagaguuuggaucucugcccaccacccccagugaacagguaucaagcuuuaagacacauuguugauguauugaaugugaaaaaaacccagugcacuguaggaucuuugaacuguuacgcuagaaaggaaauuaugcuagaaaggaaaucaaaaauaauucuguuugagauuaguucacagaacacaaaacuauauuuaauugcucagguaguauccugugguucaauaaagcaaaaauuauuuccaugcauuugcccugacccauaauuaaguuaguucucagaaaaugcuuccugaguaauuauuuccuggccuuccggggcugacugcguggaacaugcaggcucauucaagaugugagguguccugggggcacauauuuauuucccugcuuauuuaauggaaguuauuacuuagcuaaaaguauaaggcuuuauuugccugaaaaagaauuacuuuaaaauagccucaaaauaauaagcuaguuuuuagcagcgugaaaaccugaggugagaaauccagcauaaugggucuuuugccucaaguuaaauaugcacaguauuugacauacuaucagaauguuacugagaguuaaucuguaaggcccuguaauuggggaguaagugaaaacuucaggguuaaauaaagagccaacuaccgcaaauucaguugaacuucacagcuagauucuaguuggcuuuuucuucucuuuccucuagcgucaaaggaaaauacagaaggaucgcuuaguggcagaguucacaacaucacugacaaacuuccagaagguccagaggcaggcugcugagcgagagaaagaguuuguugcucgaguaagagccaguuccagagugucuguaaguauuuuaaaagacauucuagaaaugaacaugguuacuugcuaagggucccauaaaagucuauaguagcauaauuuuuuaagucauaaagaucugugaauaucuuggaaaucagcucuugaauauuuauuuuuaugcuuuccugcuccauuuuuagaaaaggaugauaauuuuguauuacgguggugauuuuuugugucauaguacagaagauuacagaguauauaaaaauauagagacauauuuugucaaaaaagauuagggaucaaauccugaguaguauucucacaucgucuugguacugaggcuuucugcuuguguacacgcuaguguagaaagcacuuuccuccuggauuacaccaagaugacggagaugaauggcgcaaguauguuguaucaauauugaaaaugaacaugagccuggagaaaauaaaugaaaggaagcuuuacaauagaauuuugaauuaaucuaauuuuaaauucccuuagaaacuaucaugaguuauuuucuuauucauuaacauauggauuccaagacuacauuaagcuuuaacuaaauaauacuuauuugauccuugagaauauuuagugaauuccuuucuugucuacuuagaauauaaaauuacuuauaauuauauuauuacuugaagcaguugaccugaaaaauuagaacaagaacuucuuucucucugucucuacacacacacacacauacacacagacacguacauaaaucaguuuaguuuauuauaagggaaaauaugaguguuuauuuuuucucauuuuugcuuuuuuugccccuucucauuccauccuguuacuaaauuauucagggcaguuuuccugaggacagcucaaaagaaaggaaucuuguauccugggaaagguaagaaauacaaaacauuuuacagaucaaaagguaauuuuucaaaguuuauacauuaaggucccuggaacagaauuaaagcuuucaauauauuauaucauaaauauccuaaguuguuuauauguugaaaacagaguaaauuugaaaaaaauuuuaaguaauuauaaaguauuuauuacaaaauauauaaaguuuuccaaauaaauguuuauggacuuaauuauuaauauagacauucccuuauaugagguuuaaaucagcugagaagaaauacccaguugacagauacagcuuccaauaauuaaguaauaacucuaaacucacauuagcuaaaaugauauaagugaaaugaaaaaugaauaaauuuuauuaauauaucuguuauauucuuagaauuuuuuugaguaguucugugacuuuggagaauaaaauauccuauuuaaugaauauaucuuaaauaggaaaugagucccauuguuuugaauaccaaucuuuguuuuuuuccacauucauuuuuuucuguuagccaaacucaaccucaagugcaggugcaggaugaagaaauuacagaggaugaccuccgucuuauucaugagagagaaucuucuaucaggcaacuugaaguaaggcuuacauuguagacuugggcugcugcucuggucuuagugaguuuguucucaagaugcuuagguaaugcugggagaaugcaugagacagaaaaauuuuguuuucuuuuugagacagucucccucugucacccaggcuggagugcggugguggaaucucggcucacugcaaccuccgccucccagcuucaagcgauucuugugccucagcuugcugaguagcugggauuacaggcacgugucaccccaccuggcuaauuuuuuguacuuuuagcagagaaaggguuucaccauguuggccaggcuguucucaaacuccuggucucaagugaucugccugccuuggccuccuaaaguacuaggauuauagaugugagccaccaugucuggcccagagaaagaaaauuaauguaucaguuugguagcauuuguaauguaugaguuggaauaauuccuuuuuuaaaaaaauaauauuguccuuacuguuugugcuaggacgagggaucauacucccuccuacugcagcuuuuuaaaaauuauuauuguuauaucaagccaucuauggaccaccuuaguauugagaaaauaccaguguagagauaaaugucuguccaagagucuggaugucuucccagagcacaugauacacaucauaccugcaugaguaagaccuuuuauaaggccuucaaagaauuuuauuucucuuuacuauguuuaugacaucaaagagaucuaaaggauuuauuaagucauaguucuuauggaaccuacuuaguuccuagaaagaaggcuaauaauagcuaacaauggcuacaauuuauugaagaccuuccaugugccaggcacuugugggaugaauucuuuauguuaauuaucucauuuaguccuuauaaaaacuuuaugaagcaguuaauugugucauugaagaaaaguaaauuuauauuuaaucaccaaguuuauaacuucuuuauucaguagugacauuucacuaauccacugcauguucaaauuauuaaugugagacuuuaaauuuacaccuaauguuuuauuacuuuaaauugucaaauugauguguaaauuuuacuagaaauacaugcuaagaauauuuuauacccuuguaaguagauacugcuugugauaacaaaacuaucagguuguauaaaaugaacucagcaauccauggcucuucucuauuauagauccuucauuuccauucauuuccauccugccucgcucacuugguauuuuuaaugccacaaacugauuuuagagaacugguggcuauuguucaaauucuucuuaauuauugucaaauauuuuccugauauuuccaaaguuuauguauuauauuuguguauuauagaugcaugcucacccaugugugaguagugguuuggguuuuuaaaauuuuuccucuuuuauggaauggggacugaauuucugauuauaauaauauaugcguuuucucuuaggcugauauuauggauauuaaugaaauauuuaaagauuugggaaugaugauucaugaacaaggagauguaauagguaagaccugcugacuuagauuuuggaggugagagcaagcuacaugcacuuuaccugcuguaacuuucucacagaagaguaaccacuuucugucccuuuuuugguuucccuggaaccaaaagcauggucuauaaaacacaguaagcaucacccuuggcauuaucuaaaacagaucucauuuuuaacucgugcugguugaaauaaccagcuucauuuauuucagaagcccaaauuuaaucagggccuauugcugccaagaccauggaaggcaccaugaaacauuauuccagcuuauuuccagggccucugguuuuagucuuacuccaauuuauuugucaucaugcuaagcacuuuuggggaaacuugugguauauguaacugugcaugacaucuugucuuuuagguauuagggaauagguagacauuugccuaaucauucauuuuaauagcuuuuugguagaugaauuuaguaguauuacauagaaguuaggaauucuuuuuagaagugauuuucuuuucuaaaguugcuaagaaucccuuaaguauugaauguaauagcauuucaauuaggguguaguuguuaacauucaucaggauccugaccaucuugaagucuggagcuauguauugguaugucuaaagaugcuuuuaguauauuuucugaauuugguccaacugaaauauuugcaccuuuacuucaguguaacuauuuuuuauccauucuuacccuccucuguauccccaguagaucacaggguaaaauuucaaaaaccaauuuauucaucauccgaaauauguugaguggcuacuauguccagacacaaaucuaggcauuggagauucagcugaaauuaaauaacagauaaaauacccuaucucaauugaucuuauaaugggaggaaagacaauuuuuuaaaaaggcgagaaaagcaaguaaauggugauaagugcuauggagaaaauaaggccaggguagagggaugggacugcuagggguggaaauuguugcugcuugacacaggguaguuagguaugauagguacuuacugauagguaacauuuuagugaacccuugguagauuuaagggagcaaguaagagaaaguguuccaggcagagagaacagcgaguacaaaggccuugaggcagaagcauaccugacauuuuuaaugagcaagaaggagauggagaucauguccaagugcaggggaugaugucagguaggaagauuucaguuuuuacaaacgaaugagaagccaaggaggaguugagcagaagagugcuauaacccugcuucaguuucgaaagacucacuuggcugcuggaaaaagaccaaaagcaaggaggucaccuaaaaggcuauugcagucauccagaugcucaaucuuguuggcuuggauuaggauggaacuagagggauggugagaaguucauggauuucagauauuuuuuaaguggacagccgaaaagauuuacugacuggcuggguaugagugugaaagaaagaguuaauuuaagggugaugcuaagguuuuagcuuggcccacuaugauggugaaguuacuguuuucugagauggggaaaucuguaaguggagcaggcuuagauggguauaaaucaaucauuuuugaauauguuaaguuugaggugccccuuuacaccaagugaagguuuucuugacauuauuaaagugaacauggaguucaggggagaagucugggcaggggaucuaaauuuaggagugaucuguguacacauaguauuuaacaccacaagauugggugagauaauccagggauuaagucuggguagagaauagaaggggucugaggacuuagcccuggauccucuaaauguuuagaacagugucuucaaacuacauguauucauuuauguaugguuuaugguugcuuuugcacagugaagggguagcugaauacuuguaacagagaucauacaacccacaaagcuuauucauuuucuggcucuuugcagaaaaagcuucuuaaccucugauuuagagcccagacaguugaagaagaacaaauaaaaagacuaaggaauagccagugauauggaggaaauccaaaugaaugcaucguccuagaagggaagugaaaaaaagugcuuccagaacaauagauggucagcuguuucaagugcugcuguuaggccaagaaaaaugaggauuaagauuugacuacuggauuuaacaguguguagggcauaggugaccucaauacgagcuguguuggugaaauaguguaggugaaagcaugauaaaaguaggcucaagagagaaugggaggagaacagugguggauaccaaguauagauaacucuuucaaggaguaaagaggggaagugaaacagagaaugcagucauagcugcaaaaauggauguggaauaaaugagagguuuuugguuugcuuguuuuuaagauggcagcuaugggauugaugaaggugaucuaccagggaaagaaauacugaugauaaguaagagagagaggaaguuugcuggacugagguuuuugaguuaaaugauaggaaaugugauaaagugcacaaauggaaaauuuggcucuugcucgggguauauaguucuuccuggcaacaagaaaguugucagaacacacaaauauugcauguagauagggucaugaaaacguguggaaaugucuucugaugguuccuguugcuucaaagagcuggaaaucaaggucaugggcugagaaugauaaugccagaggaggccugagaagcuugaggagagaagagaaaguaugacguagucuuucagaagucagagaaaugaaguagaccugcuuggcagucaugacuuuaaagugaaacacaguuaauccuuuuuacauccauaaucagcugcauggguacugguugggguuuugucauaugacuaaaguggaggggcaagggggcuaaggaugagaguaagcugaggcuaagugauuguccaaggacucuaaggcuaggguaaggagggaagugaggacaugccauaugugagggacagugaagaagugguaggaucaaugaaaguugaaaauuguuggagccagggaauuagaaggagugagcucuagagauagaagguggugaucaaagagugagacccuugaaauugagauuauggaacaacugcaauuauuggaaugucaggguuugggaugugaccauggaaaugggugggugaggaaagguguucgucuuuggaaaaaguauggucagugaacugugaggccaggguguuagaagggucagcaguuggaucuugaagucaccaguauguauaagagaaguguuggagagagcaucagugagucagaggcuaaaauauucaaggaaugagaagaaaaggccaugcgauugauagaugucugcaacaaagagaguuggcugaguuugauagcaugagccuuaaagcugagagcugguagggaggaagagacaagggcaaagggucucaugcuucaaaaugacacccguuccaccuccaggccccuggagggugggaagaaaaacugccaccaauugagaaggcuucaugggcccucggugagggcuagauuuuagcacagaaguauguugaugaccacagaguaaauggccuucagcacucuguauuuaccuuaaauaaacauugucacaugcuugcuacugagucggccauuacagaacacaaacuaaguagagcauagguauuaugcuccaguaacuuaaauuacauuccauuuacaaagacauagagggaaaagaaauugagaaacauuaaugacuaacauaaugauuaagggaucaaguuuuagcauuuggguuuuucuguuuguuuguuucccucugaggacauaauauucuuugaaaagucaagguaccaguuuuuaucaugaugaacaaaaucuucagcaguagaaagaagagaguugaucucuugugcauuggucuugacauagaccaagcuguggaguuugacacugagacaucucuugugcugacacugauuugauaaugucagggugacaguacuuuucagggguugccagguagagcuggaguugcucuguaaugaagaugauuaagguucuguuauacaaaugcucuuauauuguuuggaucaccugaaaaauaguauagguguauacuauaauucuuaaagccagcuuaaaaaaauucaacuuuaugauauacuacuauuaaccuuugaauaaugaccauauuuaaucuuaccuugaaugaaauuuagugauuuguuacuggagcaucaauccauguuuaacacauuuguguguguguguuuuauuuuacagauagcauagaagccaauguggaaaaugcagaggugcacguucagcaagcaaaucagcagcugucaagggcagcagauuaucagguaauuuaacugugaucaauuuucuuauaacuuauccuuuucguauguguguguguguguuuguguugaggaagcagggagagauuagguuuaaaauggcugaagauguuaaaauuuaaaaucccauggaagagaagucuguuuaaauaauaccagucaguuuagaacuguuuuuagccuguguucuucucaggguugaaccagaauuguuggcccacagggagagaaaguuuaguguuugggcggcagagacaauucuaggcuuucugauggccggggaucucugaugucauugugacauuucuacccagaaaccuuuuugugauaggccccuccuucccauuucuugcugcucccuuuuacuuuuucuuucuuuuugucagugacacacuggacuaaagaggcaaauuuccuuguccuagagagauugcuucaggucuuguggaaaucauauuagcuuggagugucacuguucauuauauauucuguccacauucagcagacccuucaccaggaaugaauuuauuucuugagucggguuaauauagggaguccacaugcaugugucaaauauaaauuauaugucaaguacuauacaaauauuagaacuaucaacuauuaauacaucauacaauaugcagaccuuugauguucaaauuggauaaggccaggcucuuuggaaaccccuaaauaccauguagcauuugauuuccuuuuuaaaacuccauuccuuuguugcuaucauucauaauuaucauuuucuugaccuuauuaacuuuuuuuuugacacagagucuggcuccgaugcccaggcuggagugcaguggugucaucuugccucacugcaaccucugccuccuggcugaagacauucucuugccucagccucccgaauaguguguacccccacgccuggcuaauuuuuguauuuuuuguagagauagaguuuugcuguguugcccaggcuggucuggaacuccugggcucaagcgauccacccaucucagucucccaaagugcugagauuacagaugggagccaccaugcccagccgcuguuaacuucuuauaaaauaucuaagauauugucaccuucucagacauuuucaauugcuuuuuguuuuucucacuaaccuuagaaguugccuuuauuucacaguccaucuuuuacuggacaaauuacugcauauucagugauaaguaaauaauaaugaagcuauggagauugcugaguuauaaccaguuguauucacugacagucacuccuguuuauuaucuuuguccaugucauucagauaugcagcucagugaaauuaauaucacuauaucacugugucauggacuuuagguaucccucacgaauaauugaaaacacacacacacacacacacacacacacacacacacacaccccugcaaaugccagaagucuucuggagcuguuagcauauaacugcugaaacuuaacaggauccaucagugacuagguucacaugguauuuuauuuugcuuuuggauuugggggaaauguggauauucugccaaguuuuacucuuccucuuccuuguggaaggccaagccuacaggaaaaagcacaugucccaagcuacaccccaggacuggaagcugccccuaggcuuaauucccccagcucccgaagcgggacgagauggccaugcagcacaagugcugagaaaagaggcagcuuuccaauaguucuguuuggaagccuugauauguuugggugaacccuaagaauaaggaaggugagaaauucaaguucacuuaucaccacauugccccagggucucauuaccccacgcuagggggaguaccccaggcaacaaacacaccauugugggauacccgugaugacucacagguacauuacauguguguuugugguaaccaacuggagucugggaaaaauauuuaugcaugguauugaaauuuuagagaaauuguguuugauacguaaggaguauucacuggaaaaauuagaugaauauguggaauauucaaacuauuuaugguuuucaguguaauuucagacucagaaauguaucuuuuuauaaauauuuugguacuucuacuugacacaaaguaaauuuacaaauuuuucuacuuuguaagaaaaaggauuccugcauguugaugugagguacaaacgccauuaaagaaaucuacaacugaaccaggaaugaagaacggaacaaaauucuuaaccauucgguuuucaaugacagcauuaugauuuuguuugcucugugguuuuguuuguugagauuuugaauguaguuucccauuaauauuaaagaaugagaaugauuuuggaaacucauuccaaaaucauuguauuuuggaaacaagaaauaugugugaggggcugggcgugguggcucacgccuguaaucccagcacugugggaggccgaagugggcagaucaugaggugaggagaaugggaccauccuggccaacauggugaaacuccgucucuacuaaaaauacaaaaaaaaaauuagcugggugugguggcacgcgccuguaaucccagcuacuugggaggcugaggcaggagaaucucuugaaccugguagguagagauugcagugagccaagauugugccacugcacuccagccugggugacagagcaagacuccaucucaaaaaaaaaagaaaagaaauauaugugaagaaaaguugccaauuuguacuuacugauaucuucagagaacucauuuuuaagaaaaacuuuaauaaaagguaaagaauguuuaagcucguaagcuguucuuuauuuuuauucauagguaaccucagucucuuguuuaagucaguaacuuauuuaguggugucuucuuucuuaaggucagccacacccuuagaaaaauuaccaaugaaaguugaaaaauugcucccuuaauuguagcauuaguucaagaauuuuuuugaaagaauagugccauauguauuaaagagauuuuugaggaacaaaaaaacacagucaaaaauuugagggcaauauacuacuacugauuuuacucuagaaaugaaccaaauuauuuuuaguugcuguagagguacuccacuaaaucuguaaacauguuuuuuuguuuuguuuuguuuuuugcgucugcagcgcaaauccagaaaaacccugugcaucaucauucuuauccuugucauuggaguugcgauuaucagucucaucauauggggauugaaccacugaaguuauaaaggagcacacugucgcacuacauugucuaaauuauguaggaagauuccuguaaucauguuuuuuuaauuauuauuuuaaagcuauuguauaaaggaugguucccauacuuuguuauuuuuauuggggggguuggggugguuccuuuggauuaaaucugauauuuucuaauacugaaagauuuucuaaaugucacugcugacauaacucccuuggucuucaauuuaauaguuguuaaguuuuugcccacauugcauaugccuuucauuuauaauuuauuuacccugcuugacuuaguuuugggaauucguaaauuuaaagguguguguauucuguuugcaucucccugucacugugacacaccuagauguguguuacuucaauuaaaauucucaaauuuaauuuugauuugcuucagcagggaaaauauucucaauaauguaaaauaauuaaggucuauacauggguuguauuuuucugguucacaacagcacaaagugucuuucauuuuuuuguugguuuucuuuuaagaucuuuuuuacccugaagucggugaauacuuuucuaguuuauuugauacucuuucuguguauauauuaagcuuuugcuguagauugccuaguaaaauuacuaaggauagguuguuuuuacauauggucuauuuaagucugauguuuacgggggaaaguguaguuacuaaaaauguuuaacauaauuuggaagaagaguaugaacaaccaauaccaauaccuauugcguuuggauucuuaagaccccaguuuguuauuccacuaaacuaguuaucuuaaccauaucaucugguuuugugggccauuauuuaccuucccuuaugucuuauagaauaaugguuaauauuuuuaggucaaaauuacuuuuggaaaguaacuuucccacaauuaacuguuuuugagcaccugacaaaauuuaguguuuaccuugcgugccauuuugugucauccuucauuaaaaaagcaauuggagguuugccaguuaucucacuucccuuuuuaaaucaauguuguuuuaaugcacuaaucugaauucuguaaagaggauuaucuuaguuuauacuuuguauuuuauaauguucuuguauagcagcucgguacugaaggcgguguuuaacuuggcaagcucugagacuucaaaugggaacaaauaguaaguagcuaaguaaaccacaucuuugcaaccaaaauaaagaugaguuaaaagguaucugguuaggccuauuucaugaggacuaugcucuggugggaccacaggucaccugauacuuagugcugugcugccugaaaccucagcauggagacaucaccacaugcacuguggccauucagcaucuuucuggagcaccaguucacuccagguuuuuauuuuagggugucaucgauuuuaccuacuuugucagacugguagaaguugcuuugcauaucagaaaaacuccauuuuuuuccacaaaagggauuacagaaaacucuuuugugagugagugauuggaacuuagagacuccuguugccagaaucagacugcccuagaacagaauggacaaugcagggaggagaauucacacaaacagcaccuguucugaggccugugccagcccaccaggccugcucaaauguggucuuuacuucaagugcacagaggcacaugagguuucuggugauaaaccagcgucuuaccgcuguuuuaaagucccauccccauggcuuucacaaucaguuccguuuuuuuugcuguacuugauaaaauguuuauucucauacaggucaaguacauuuacuucuauucacagugaguacccaauaacaacaaaagcgcuuacaaauuuggggggcgugauuuuaguaccuuuauuugaaguguaaucauuuuaaauuauuauuauuuuaacuggggcaguuaucagugguuuaaacaggaacuuuaguggcuucaauuuguuuaagaaacauauuaaguuugagggaaaaauuucccaugaaauauuuggaacguaagaguaguauugauuagagaaaauuaaauaagaaacauaguaugguagccaaauuuuuuaaaaaaucuugaacuuuucuguaggu

SEQ ID NO: 16217 - RNA, 3269 nt, Homo sapiens
cauucagcucauuggcgagccgcggccgcccggagcguauaaaagccucgggccgcccgccccaaacucacacaacaacucuuccccgcugagaggagacagccagugcgacuccacccuccagcucgacggcagccgccccggccgacagccccgagacgacagcccggcgcgucccgguccccaccuccgaccaccgccagcgcuccaggccccgccgcuccccgcucgccgccaccgcgcccuccgcuccgcccgcagugccaaccaugaccgccgccaguaugggccccguccgcgucgccuucgugguccuccucgcccucugcagccggguaagcgccgggagcccccgcugcggccggcggcugccagggagggacucggggccggccggggagggcgugcgcgccgaccgagcgccgcugaccgcccuguccucccugcagccggccgucggccagaacugcagcgggccgugccggugcccggacgagccggcgccgcgcugcccggcgggcgugagccucgugcuggacggcugcggcugcugccgcgucugcgccaagcagcugggcgagcugugcaccgagcgcgacccaugcgacccgcacaagggccuauucugucacuucggcuccccggccaaccgcaagaucggcgugugcaccgguaagacccgcagcccccaccgcuagguguccggccgccuccucccucacgcccacccgcccgcuggaaaaagaaaccgcucggacugaguuucuuucuccagcugcugccagcccgcccccugcagcccagaucccaacucgcaucccugacgcucuggaugugagagugccccaaugccugaccucugcaucccccaccccucucuucccuuccucuucuccagccaaagauggugcucccugcaucuucggugguacgguguaccgcagcggagaguccuuccagagcagcugcaaguaccagugcacgugccuggacggggcggugggcugcaugccccugugcagcauggacguucgucugcccagcccugacugccccuucccgaggagggucaagcugcccgggaaaugcugcgaggagugggugugugacgagcccaaggaccaaaccgugguugggccugcccucgcgggugagucgagucuuccucuaagucagggucgugauucucucccagggagggaguccuaacugugccgaccgaacgggggaaauaccuuauccaggcguuuuacaugguguuugugugcucugcucucgcagcuuaccgacuggaagacacguuuggcccagacccaacuaugauuagagccaacugccugguccagaccacagaguggagcgccuguuccaagaccugugggaugggcaucuccacccggguuaccaaugacaacgccuccugcaggcuagagaagcagagccgccugugcauggucaggccuugcgaagcugaccuggaagagaacauuaagguacauguucugcuccuauuaacuauuuuucacaggaaaaacaguggauaggacccaacuuagggcucuugccacgcuuguuaguauaagcccguuaucuccaaaacuaucuaaccauugagcuguuuugcuggaaugagagcuuguguaauagcaaccaccaguuuuccacuacgaaaucuuccacaggguuaguuaauucaagacauuccaagagaggcucuggcuauuuuuggacauagcaaaugagacucaaacuuccuccccucaaaauauaaacagaagucagacaacagaagacuaaaacacagaggguugaagaaagccacuccucuuguagagucgcugauuuuuuuuuuuccucucucuuuucccuugucuuccuuagaagggcaaaaagugcauccguacucccaaaaucuccaagccuaucaaguuugagcuuucuggcugcaccagcaugaagacauaccgagcuaaauucuguggaguauguaccgacggccgaugcugcaccccccacagaaccaccacccugccgguggaguucaagugcccugacggcgaggucaugaagaagaacaugauguucaucaagaccugugccugccauuacaacugucccggagacaaugacaucuuugaaucgcuguacuacaggaagauguacggagacauggcaugaagccagagagugagagacauuaacucauuagacuggaacuugaacugauucacaucucauuuuuccguaaaaaugauuucaguagcacaaguuauuuaaaucuguuuuucuaacugggggaaaagauucccacccaauucaaaacauugugccaugucaaacaaauagucuaucaaccccagacacugguuugaagaauguuaagacuugacaguggaacuacauuaguacacagcaccagaauguauauuaagguguggcuuuaggagcagugggaggguaccagcagaaagguuaguaucaucagauagcaucuuauacgaguaauaugccugcuauuugaaguguaauugagaaggaaaauuuuagcgugcucacugaccugccuguagccccagugacagcuaggaugugcauucuccagccaucaagagacugagucaaguuguuccuuaagucagaacagcagacucagcucugacauucugauucgaaugacacuguucaggaaucggaauccugucgauuagacuggacagcuuguggcaagugaauuugccuguaacaagccagauuuuuuaaaauuuauauuguaaauauuguguguguguguguguguguauauauauauauauguacaguuaucuaaguuaauuuaaaguuguuugugccuuuuuauuuuuguuuuuaaugcuuugauauuucaauguuagccucaauuucugaacaccauagguagaauguaaagcuugucugaucguucaaagcaugaaauggauacuuauauggaaauucugcucagauagaaugacaguccgucaaaacagauuguuugcaaaggggaggcaucaguguccuuggcaggcugauuucuagguaggaaaugugguagccucacuuuuaaugaacaaauggccuuuauuaaaaacugagugacucuauauagcugaucaguuuuuucaccuggaagcauuuguuucuacuuugauaugacuguuuuucggacaguuuauuuguugagagugugaccaaaaguuacauguuugcaccuuucuaguugaaaauaaaguguauauuuuuucuauaaaggg

SEQ ID NO: 16218 - RNA, 4656 nt, Homo sapiens
uuugauuggauuucuuuagauuuaaugguucaaaugaguucaacuuugagggacgaucuuugaauauacuuaccuauuauaaaaucuuacuuuguauuuguauuuaaaaaagaaaaauauuccuauccugcucacugguaauuaacauagguuuaaaauggcuucaaauguggcccuauagacgguuaaaauuguaccuuaucuuggcaaaacuucagagcaccagucagugcaugcaaggugccauuuuuuauugagaugcuuagaauguuucuuucugugcacaagacuuacccuaccagcagcagagccauucucuguugagugguucauuuugaaguuccacagauugaagagaacaugccaccaaucaccucacaucuucuugguggacaugauaaaugacacaaugaacuugauuucuuuacuaccuugacuguagcuuuuuaucccuaccugugaaccuucaaagacugcauuaacuuuuaggcuacauagguccaauugagguauaauaucaguacaccaaagauuuuuauauguccuucgugugaccauucuucaacggccuaagggccagcugcaaagacuuuuggaaaauacaauuuacaacucaaaauuauuuaauaauuuaggaaguugcuuuuuuuuuuuuuuuuuuucaguccugcaguuuccugaagcucuguauaugauauuuuuuucagccugcuucucucuguuguucagauuagguaauuuuauucuucugucucgaagcucacugauucuuuauucugucuaaucuguucugcuguugagcccauuuauuccugauuuuuauauuuuaguuauuguauguuuuauuucuaaaauuuccauucaguuuuucuuuauaucuucuauuugcugagaauuucugucucuuugcugagacuuucuacguuuucauuuguuucaagugcauuuauacuugcuuguugaagaauuuuuaugauggcugcuguaaaauccuuaucagauaauuccaacaucugucaccucauuguuugcaucuacugauggucuuuuuuccauucggaaacauuuuccuguuucuugguguguggaaugauuuuuuauugaaaccuggauauuuuuagguauuauguuaugagacuaugggucuuauuuaaaccuucugcuuuagccaacuuucucagauaccaccacagcaggggaauugggagcacugcuucauuauuaccagguguggcuaggaguccagguuccccagucagccucccuuuauacugaguaacaggguccccucauuacuacugggcaaggugagaauucaguuucccauuaggucuuuauugauucuucccuggcuggaaugugcagcggcaccuuuuggugcacccugggaaucuccacuaaugcuaugggacagagugaccaggaagagcuucauuacaccaggugggaaugaaauucccaguagccuacacagccuucuccgacaccacucuggaguuguauucuuccagcacacaaacauacacaauuuaacucaaagcaucuuagcagagcuuaauuaaauggauagaugccuguucccuuugcuggauaccaagaauacaaaagucagggaguuggggcaccucuuuacagcuuggugagaguguaagucuggacuccccacucagcauuugcugguauggguggggccaugguguuuuuccaugguguuugguuggaguacagccuuuuuuacccuugcuuggcuacccuuuucugguccuuuggcaggagagagcaggacucucuuagggcuuuuuuuuccccugcauuuauugacauuuccagguugcugacuuuuucagcuccaaguuggaaauauaugagcugaaaagaaaauguagggaacucaucacaguguuguuacuugggccccaauguuccuagccuauuuucugucuacuauucagagucuugcuguguuuuaauauaauauccaggauuuuuauaugcauuuagcagaaggaugucuacucugccuuuguagaagugucucacugauuuuuacauauuuuuccagcacacaaacauacacaauuuaacucaaagcaucuuagcagagcuuaauuaaauggauagaugucuguucccuuugcuggacgccaagaauacaaaaaagaacaagugacaauuuucucugucuuagggagaagagacagcagaaguguaaaugaucccuaaagagugauagauguuaucaugaagccacaggaggggugccaggcugcacaaaagagacacuggaugcuucuugguaguagaggcaguggcuucccagccuuggggcuaaggcuuguagggugaauuggaacuuuucagaugagcaaggcaaagaagggaccuucuaacauuccuuggauggaacauuuuugacauuuucccauuuacagcuacuuauauuuucuacaagugucacugugaccaacuuauguacacauacuuuuucuugcuuaguuauaauaaucuguucuuaaagaaaaugucagucucuacauucuaugcugacuguuaaggaaagagcacccacaucugcuccuacuuagcuuuuuuucugugguucuuacacaguauuccuuuuuuucuuuucuugaaagagacuccuccuuucuuuucuuuucuugaaagaguuuuaaacagauaagauggcaaaagugacugaucucuacucccccaguuugaaugguaaauuugaaugguaaauucccaugaacauauauggaaaugucuuuauccuacuuucuccaauaaaggcuguucuuagcuuuucaaaugcaaagugaaaccuuuauuuaucuugauuucuuuuuuuuuuuuuuuuuuuuuuuuuuuuuugagaugcucugucacccaggcuggagugcaguggcaagaucuuggcucacugcaagcuccgccucccagguucacgccauucuccuggcucagccucccgaguaacugggacuacaggcaccugccgucacgccuggcuaauuuuuuguauuuuuaguagagaauggaguuucaccguguuagccaggauggucucgaucuccugaccuugugaucugcccgccucggccucccaaagugcugggauuacaggcucgagccacugccuccagccuauccugauuucuacugucaugccucacaucaguccuuuuuuuuuuuuuugagacagagucucgcucuguggcccaggcuagacugcaguggcaugaucucggcucacugcaaccuccaccuccgggguucuagcaauucuccugccucagccuccugaguagcugggauuauaggcgcaugccacaccuggcuuuuuguauuuuaguggagaugggguuucacuguguugcucaggcuggucuugaucuccugagcucagacaauccccccgccuuggccucccaaagugcuaggauuauaggcgagagcugcugugugcuucuuaagugagguaaguaacuuccauagaaaauuuccaucaguucauucaugaaagaacaaagaaccuggcaaaacuuaaaaaaacguuuccaagaaucagauaaaagaggacaaaccuuagggagaagaaggcagcugcucauuuccagcaggggaaguagcugcauagaguacaaggacugguaggccuguuggcuguuccuguuuaaggagacaagaugggcauggaacagggaccacccccuccucugggagaagcuguuacccccuucacuuuuccuccucugucauuacccacaaucacucuccuucuuugcgcuaugguagguguuuacccaucauaggaaugggcauuugaacuuugaaacugaauguggugauuacacuucaugcugaagcuuuucacaugagugcuuucauaagcauuaaguaaaauuuuauaaugacugcaguccaaggacauuuucccugguuuuuggccagucuaaauauuguaagagagagagaagaaaaguguacggaauauaauugucucuaagcuaagaaauguggauguucaaauaaaacauacguacagaacucuggcugcuuuccuuuguggcuuuguguguggaggauggguaggaucaugggcgauggugcuucucugcagacaugaaacugaguccgaggguuguugacaguuaaccacagcuguaaugcugaaaggcaaaagaauccaaaguucauuucagguucauagaguaaacacuucugaucugugaccuauauccuuguucuugguauuuuaauuauauuuagucauacuuccagguaaaaacaaaugacaggcauauauauucuuuaguauuuagaauggucuggaaccagacuuggaacuucuauagauucuuuuaaugugaaauuuuuguauuuauccucuccauuauagugauugaacaaaaaaauguuuacuagaaaucauauucauaccagaaaacagauaugugaaauacauuuuaaucuacuagaaauggaagaauccuuggaagaggcauuauacucaugggaugucaaaaggaaggaauauaaaagaagccucuuucauccuacucaaugcuguuguuuuaaauuuaacuuuuuacuugccuguaacuucucgauucaagggauaguuuuaggauuuuaauuaaaaugacauuuuaa

SEQ ID NO: 16219 - RNA, 41432 nt, Homo sapiens
gggaggaagcgacgccgaggagcuacgguuuccuccagaggucuccgccccucugccccuauauucccagagcucgagucugauccgggccuugccgggcacccuggaaaggcgggggugauaguacagauggagacgcaacugcagagcauuuucgaagaggugguggugagugcagcugccggccauccaggacuacggcuuggggacggggagacgcgggggcagccgaccaaggaaacuggccugggcaaccuccucucacgccucccuuuuuauucccuuguuuugacaccgagguuguaugcggggaaguuuagugauucucaaacugcugucaaguucauuguauccuuugaaaucgauacagugacaggccagacagguauugauaguuucagagcugauuaaggugacuugcccuguguuacauuguaauacuuggcuaagggaggcgccuuuuuaaaauuaacauuguuuacauuuuguuuuuuuuuuuuuuacagaaaacggaaguuauagaagaggcuuuuccugggugaguguaugcguggcagaguuuuguguuuuuaugugauugugucugucagauuuuacuuaguuucguguuggaagguuauaagauccacuauucugauuguguguaauuaccuuuuuaaaacgaaugacaaauaauguaauuuuuauuuuuuuagcauguuuauggauacuccugaagaugagaaaacaaaacuaauuagcuguuugggggccuucagacaguuuugggguggucuuucucaggugagcgcuucauuuuuaauacauucagcugaugauuuuuggccucuucuuuuuuuuuuuuuuuuucuuuuaacauuuacuuucaugcugcucuuaagaucuuccugagaagggagaaauaaaauuguuaucauuuuuuauucuggcuuccauuuguuuuaauuuguauauuucaguggaaaaccuguguugagaagucaaguugauacugcacagugugagauguuuaaaaaaaaaaaccuccccuauguuagauuaauugagaucauuuucauccuauucggauuuauuugguacacuugaaaacagauauguuaagcuuuacuugucaaggauacaaauuccauuuuucugcuaaauaaaggaauuggcacagcauugauacaaagaugcuacaauaggaauaccaagauucuauaauaaggauaggaaaauauuauaguaaaaaugaggagacaaacuguaaaaguaacaaagaacagcuaccagaaaauguauccgugaaaaagacaaaaaugugucauccucgaagagcucacauugcaguagugccuuaccuucucaugguacacuauagguagggaaaugagaacuguuugcgugucagccacuggugauaagauuugccacucagacauggaucauauaaugccaauacagucauguuuuaaccuuuuuguuuaguuguuuucuaauagguaauacauuuauaugguucaaaaugcacagguauaaaaggguggauccaauaacuagucucuuucucuucucuuaccuguuauuuuuucugucuguagccaauauccucagguuauguuuucuucuagaaguauuuuaugcauauagaaacacuuuuauagcaugaucauauaccauguacacuguucauuaauuagcacuuuuuuucuccuaauaauaaucuacagguaauucccuaucaguccaagcguuacuuguuccuuccuuucuuacuuuuuuuuuuaaauagcagcauaauauuccauuguauggcuguaccuuccuccuuuuaaccaaucuucuacugucuucuaaguuucuucuuacuuuuucuaauuuaaccaaugcugugaugaauaauauuaugcaugaaaaauaggauaaauuccuagaaauaguauugcugagucaaaagccuuaucaguuuguaauuuuuauagaaauuauuaaauuuuccauaaggguuauacuaguuuaugcuuccaccagcaguguuugagauuaucuuuuucuuuucuuuuuuuuuuuuuuuuuuggagacagagucucacucugucgcccaggcuagagugcaguggcgugaucuuggcucacugcaaccucugccucucggguucacgccguucuccugccucagccucccgaguagcugggacuacaggcaccugcuaucacgcccggcucauuuuuuguauuuuuaguagagacgggguuucaucguguuagccagguuggucucgaucucccgaccucaugaucugcccaccucggccucccaaagugcugggauuacaggcaugagccaccgcgcccggcugagaguaucuuuuucuuauaaccucacaauagaguguuaagcuuuuugaucuuugccaaucaaaaacaugagaaauuuuaucucaguauaauuuuauuuugcauuucucucagugauguugaauaucuuuccaaaauuuaaaaaaaaauucauuaaacacuuuaugaauuaugauguggcccucuaauggagagaccaggaagaaaauagguauuuccaaaucauuguuauaugugccacaauagaaguauguaugagaacagugguuguggagagaagcagaacauuauaggcucuuuuuggagauaauccuagaagacaaacuuugauacgggcacaacauuuugacaucguauuuaaaguuuugccagucuagaaaugugacaugucauuggauucauaaugggcucuuguuugggaucuuagggauuggauucacaccuaauucuccuaagccugauacauacugauccauaaugaauuuuacccccagugacaguaauauuuauauaugccauaaagggcacuguuuacaaugccuuacaacaaucuguguuaagaguuuucuauugaccguuaauauguuaacuaauuaauuacuacuuuugaaguucccauguaauaaaaaugguagcauuuuaucuauguaauuacaaaauguuaagcuuaaugugacaaauacuaaaucugaauuuuuuaauuuugcuuuuuuuaaaaauuauuuucauccacagaugcucauagugaaguauuucuuucauaguauugguauacuuccaguuguaguauuagcuauugguuauaaaaauguaacuuuagaccccaaguaaaaucauucucucauuuuccaggagucucaugaacaguguauccaguggauuguuaaguuuauucauggucagcauaguccuaaaagaauuucuuuucuuuaugacugcuuagcaauggcaguugagacuggucuccuuccacccagguacguuuaauggguaugagcaaucugaagaauuuucuuuucuauaugugauuggaaauugguugagguuguuguuguaaaaagguaagagaaugaagaagaaggugagguuuaucaaguaauccuuuauauaauaccucagguuuuaguuucuaggaguaauagucuuugaauuagguaaugcuugugggcucaaaaccagauguuucugcccaggggcugaaauuaaucacuuuaauuaguuuguaacccuuuacuuuugcugcacaaccucaacaccuuauggcuuaaaacaguaauacucagguuuuaaaauuauucaugguuuuagugguugacucggcuuaggagacacuuuuuacucaaggucauaaugauugugaucaauguggcuagggcuggagcauggcaaaagcuuccccacucagauaucuggugguugauuccuggcugucaucuggaaccucagcugggauuauuagccagaaccuccgcaggcccucaccuuguggccuagacuuucucaccucaugguggagccuaacagcaagugugcaaaagagggcuaggcagaaauuguaucaccuugucuucuuggaagucauacugcauccuuuuggccauagucuuaggucugcccagaucuaaggagugagaacguagacuuucccccuaccucuccuugggagaaaugucagugucacauuucagaagaagaugugggaucaaaaaucuuguugccauccuguuggaaaaauccaguguaccacaaggugauagaugguaaacaucuaaccgaaagcuuuagauagacuucuuucuaguaaaauauaacauaaugaauauuauuucauucuuacuuuguuuuugaucuuucauacaaguaaaaaauguaaaauacuacacagauuuauaagugugcuuaguaaucacuuuuaugaaagacacuugugaggauaaauauaauacagugcacagacuauggcuguauuagucugucugaugcugcuaacaaagauauacccgagacuggguaacuuauaaaggaaagagguuuaauugacucacaguuuggcauggcuagggaggccucaggaaacuuagaauaauggcaaaaggcaccucaucacaggguggugggagagagaaugagugcccagugaagggggaauccccauauaaaaccauuagaucuugugagaacuaacucacuaucaugagaacaguauugggggaacugucccucaugauuuaaaugguuuuucucaugacacguggggauuaugggaacuacaauucaagaugagauuugugugaguacacagccaaaccauauuggcggcuauuagagaacuuggaaaauucugucuuguaacuggaauggcuauuucuuuuuuuauaggcugguuugugaaucccugauaaacucugacacucuugagugggaaagaacacagcuuugggccuuaacauuuaaacugguucggaaaauaauugggggaguggauuacaagguauauuuuucuuauuauaaaaagugauugcuuucagauaugauugauuuuucggugugcaugucuuauuuucaggugagagaaaugauguggaagcauuuacaaaaucugucuauuucuugugguauauuuccugaaaagauuuaaaguuacucaguuguuucccuggcuccgcuacuccccucccaacauucuuauaaauacagguagcugauacauuuuuaugaagagcagggaagucacaaagcagaauccguguuccuucaugcugcaaguauuaugaucccuucaaaugaaagcacagagcagggguguguggaacugagaagggauguaggcaucacugaugaagggagcaagaccuggcuucacuucucuugaacgugggucuuaccucaauuaauaucuucagcacuuugggcucuugaccaaaaacaacauacacuuucuaguuuugucucauaaaacggcuuagggacuccauagcuacaaaagccauucugcaucuucaggagacuuuuguuauuguccuuuucccgggaauuaccagugucugacccugugcuuuauuucugcauuuucucuaaucugaaaugauuuaacagguaaugaccuaacagauaauuauuaguuuaaaucaugauuuaucacacaguuaacucuaagaagcuuuugcuaauuauuuucucuuuacucagacuuaugcaauuuucuuauuuguaugauacuucauaauuguucuuuuagguauauguucugucuuuuacaagcuugguuacguaguucauagucaauaaauaaauguugaaugaaauuucuucuuuauauaucagauaauguaacugguauuggauauguggaaaugauuaacagaauagccuuggauauccuugagagauuaagguaugugauggaugagaagggagaauaggccagucacaguggcuuacaccuauaaucccagcacaaaagggagugagcagaaacaguccucuaccaaaaaguuugauauuguuacucaaguuuucagagugcauugaagucuuguuacaauauauuucugucuauauguauaauuaagguuuuugacccuuguaacaacguaaacccuucuaauguuaugagggccaaaaaagcuugacaaacuguauaaugacuuucuuugcucauuguauuuuaagacagucuuuagaacucuguuuuggaacaugacucuucuguuggguuaauguuagggacuuagauuguaacugauucagaaaauuuaaaggugugaccuugaaggaauauaucacccugaaaccuucggacguuuuagcuaacacaguagacacuacuuaauuuuaacccaugucuuuuuucuuauaucaggguguucgagaucucuuaaaagugauuuuggagaagauuuugacaauuccuaauacagugagcucugcuguuguacagcagcuucuggcagcaagagagguaauuuagacaugucugaaauucgugaucauaaccucaaaaaagucuagcuuuguuuaggucugugcuuuuaauacuuacgguauuuugugagaugcucuauuucuucuaccaaaaaaaaaucacuucuauuuuaaaagaugcuaguucccuuauauuucaaaaggacauuuuaaauuuuaauucaugguuuuaaauuaugaaaacaaugaaauagaaauuaaaauagcuuaaacauuacaagaccuuagcauauggaccacuuaaaagaucuuuguacuuuguaacuaguaucgcaagaauuguuacguuggucuguugcacuccuguuuaagugugccaauauuuaaagcaugugcaagguuauuuacuaaccaugaacaauccauuccauuguuuauuaaucuuuauuuuuagauauuuuuuacauauaaauguauucuuugcuacaguugaaacccaauaaauccauuaaauaauaucucuauauuuuauuuuaauugacaaguagcaauugucuguguguguguauauauauuauauauacuuauuuuuuuauaaugauaacacuuaaaaucuacucucuuagcaauuuugaaguauacacuauaucguuauuaaccauagucaccauaauguccaguaggucucuugaacuuauuccucuugucaaagugaaauuuuguccuuugaccaacaucucuccagaaaguaacaucucuacuuuuuaaugucuuuuuuguugucauugucauuguaguguuuaaaacgcucacaugggccagaugcaguggcgcaugucuguaaucccagugcuuugggaggccaaggcgggaggcucauuuaagcccauuguuagagaccagccaggacauccuggggagacccugucuuuacaaaaaauuaaaaaguuagccgggccugcuggcauacaccuauagucccagcuacucuggaggcugaggugggaacaccacuggagccccagagguugaagauguagugagccaugauuacgccacugcacuccaagccugggcaacagagcaagacccugucucaaaaaaaaaaaaaaauaaugauaauaaauaaaauaaagggcuuauaugugggacuagucaagaaugauguggccuuuuuguuuuucuuagguuauagcauauaucuuggaaagaaaugccugcuuauuaccagccuauuuugcagucacugagaucaggaaacuguauccugaaggcaaacuuccacacuggguaaauuuuauauuuccugaauuuuuaauaaaaauuuucggcugggcuucguggcucacagcacuuugggaggcaaaggugggaagaugauuugaggacaagaguucaagacccaaccuggguaacauaacaagacucugucucugcaaaacauuaaaaaacacacgcacacauauuagccaggcauaguagcacaugccuauagccccagcuacucaggagcugaggugggaggauuacuugaaaccaggaguuugaggcugcagugagcugugaucacaccacuguacucuagcuucggcaaaaggacgagacccugucucacacacaaaaaaggguauuuuauaaaaaacaguuauauuaaucuuauuuuugugugcuuauuuuuuuaaugaugacuuuuauccuuagauaauauguauauuuuuaaucaugauguauuucuuucauuuccauuuccauugagaauuuauaugccauguaauaaaauaugaucagcuucaucaaauagcuaaggauaugguggugugacuugguuuaauuaagggacagaugaacuggcgagugauuuuuuagaaggaagcaaaagggagcuaaccuuuaaacaguuaucaugugcaaucuuuacauauauuaucucauuuuauauaaauguucauauauuucaggggcagucucaauuuuccuuuuguacguauuuauuugacuucccucuuucuuucucucuuuaguuacuuggaaaccuaguaucagacuuuguggauaccuucaggcccacagcaaggauaaacuccauuugugguaggauuauaauuuuaaauaugccaaauaguaccugauuuuuaguaaucuaauuauugaacaaagcugagggauguucucuuaauaugugccuugguggcuugucauuuuggugacucucuaagagcuuaauauaaugccuuucccuuguuuucacuuacucugugugccaaguacagggaggaaaaagaaacucucuggaauggguuuaagcuucauuuaaaaccauucuagaaguggguuucuuggugauuagaaagacauuuuaauacagcuaguaaagcaccauggaauuucuaggcagcuggaagucugaacagaccugucccucuguggcuacagaacgugaaagugucaggcucacucagcccauucuaauucccacuuuugcuuuuccuuucgcauuuucccauguuuuguuagagucucugaacuuucuuuuaaaaauaaccaugugauuuggcaauuuuugcagugcccacauauccucuuuaauuauuucuagaaaucauggugaccucaacuguguggaaauauagaccauuguuuauucagugaucaaauauugaguacuuccuauaagccaggugcuauucuagauacugaaaauacaaauacaaucuaaauagacacuagacagauaauuaucagguuucuagcuuuuguaacugaguggauauugauaucauguagugaauuauggaagcaaaguagguuggagaaggaugaugaauuugagacauguuaagcuugaggugcuuguaggacauccaagugacgauauuuguuaggcaguuggauguaugagcugauagucauaugugacaucuaaggccucuaggaauaucgugcauaaaguuuaaucauguugacacuggacuaguggucuuaaacuuuuuccuguaaagggccauguaguaaauauuuuaagcuucguaggcuacagaaucuguugcagcuacucagcucugccauuggacugcaaaagcagugguguuccaauaaaacuuuacaaaaacaggugccaggcuggauuuggcccauggauuauaguuggcugaucucugcccuagacauuuagacaaaaugcgauauuuucaacuuuggaaagccugugcaaauugaucuucaacuaucugaacuaaaaauaaaauucccaaccuucagucucauugaaacauuuuuauaagccauuuuuaaaccaaaccaaugccuauuucagcauauauguucauuaaauauuugugaagugaaugaaguacugcuguguucacauuuacuuaaaaacauuuuuguaauacauacaggucgcuguagucuucugccaguuguaaauaauucgggugccauuuguaauucauggaaacuggauccugcuacucuucguuuuccuuugaaaggccuuuugccauaugauaagguauguugcuaaauauaauggcacuuuuaguccaucugacagucuucaaccuagauuauaagauaugugaugcuaaauuguugcuucauaaucugaagaaguaaauauuuaaugaaagauaguuuauaguuuaucauguuauucuaguaucuaaauauacccugugguuuaugcuauuguggguguuuaugcuccagugguccaccucuggcaaaguauuuggaggugagaaacugaaauuuuaaauggcaaacugaaauuuuaaauugauuccuugauuaaguccucacauuuuaaaaguaguagagcuuuuuaaaugugaacucagucuaauuccagaaucuacacucuuaacaccugugcuaucaaguuauuugucuuuccaaauuuggaaauaguguuuuuguuuacacuuguaaaacagaauuuagaaacugucuccauucuucuuagauuacauuuccgagcagaaaauuacuuccuuacaaugauacuuaagacuaaugugacuauaucugaagucacauuucugaguuuaacccuaaagggacgaggguaugcuuuuucaaaucacugaaauuuugauauacccuuuaaggggcaccagucccucuaaauuguugcauuagugagcagucuugcugacugaacugauaauuuuuugggccuaguugcucuuuuuacaacuauaucuacauugucaacucuugcuauaagaaugucuuuguaaaacagucacuuugguuauucuguuuuuaaaugccucaggaauucuuuaaaauuagcacauugaagugaaugcuuauguacucagaccccuuucccagacauuuuacuguuaaaaugaagaaaggaacaguaaacaaagacauucugguagauggggugaauagagagggauuacaggcugaugggaaugaauuuaaaagaaaaaaaaaaaaagaaauuuaaugccguaacuguuucuaagguuuuuacaucauaguuacaauagcauagucuuuuaaagauuaucuuaaaaaucgguauaugaaguguuuuuuuuuuucuaucuauccguccauccaccuaaggggacauuuaaaaaaauccagcuaacauuaugcaaauaguacuugagguugauaagaagaaaaacuuucauugacucuaucaaaaugcuauguccccagcgacacagauagaaaugaaaacgaugugcucuagaaagccguaagaugacuuagaaaccaucuagcaucauggaagaguuagaauaaacuaaaaugaaauccuucuaaauuaauauauuuaauaaauauaaauuaaauauaaauuaauauuuuuaaauuaauauauuuuaaguaugggcaggcaaaauuaacaaauauaacuaggcuuaucacuguuucaucuacuucucaaaaaguugauaugcuuuaagcuaaaaagcuguuuuuugaaucuuacuaggaaaauagggaauugauuggucuauauucaagacauugaauaaauauucagccugucauuuggaaaacucugaaaaagauuuuguuuuuaaugucacuuucuagcauuauuuuuuguuugauuguuuguuucuuaagucaggcucucacucugucacccaggcuggaguauaguggcacaaucacagcucaccgcacccucaaccuuuggggcucaggugacccuccccaccucagccuccugaguagccgagacuacaggcauaugccaccaugcccggcuaguuuuuuguguuuuuuguagagaugggguuuugccauauugcccaggcuggccucaaacucaugggcucaagagaucuucccaucuuggccucccaaagugcugggauuacaggcaugagccacuaugccuggccuaguacuauuuauuauaaacugaauuuggcuaucagaaauucuauacuuacaugccuagaaagacuucuagaaaauugacuuguuaaguuuuaacagaaaggaagcaaagauauuauuaaugaugcuucuuuaugucuaggaaacaugagcaccuaggacaaaaucuauauaaauugacauuagugagaugcuaaaauuuaaaaaauuuaaaccuucugcguuuucagggaaaggauaguagaaagugcacuggggaagggggauuggaaggucuggugcuaguguuaucuuuauuguuacccucuguaugaccuuggggcaagccacuucaucucaggugucaaaugaggcaaaugaggggugggaacagaugaacuguaagcacuaaaauccuaugauuuuuuucccacuagauacugccuacucugugaagguaacaagugccuuuagaggauuuuuuaaucucauuucuaauaauuuggauuaauguugacauugaucuugaagcaaugauuuucuuauuuucuuuaaaggaucuguuugaaccacagacugcuuuguugagauauguauuggagcagccuuauuccagggauauggucugcaauaugcuagguuuaaauaagcagguacuguacuaugcuggaaaccuaguaaauucugcauagaaucugcacuauucuuuucucuuuucuuugcuauagcuaacugagcaaaacaguuaagaacuauuuagugacuuuuaaaaauauacaugguuuuuuaaacaauguauuauuccuaucauuuauauauugcuuuaagaauguuuaaauuuaaaaagaaaaauuuuuaaaguugguuuauuuugcauugcuuuuuuuucuauaaggccaguuucaaguauaccuuuugccagagaaaccuacacaugacucaaccauaauuuuugacuuuuuuuguuguuugggugucuauuuuuauauaacccuugguaucuucagcguggccuucuugcugauuuuuuuuuuuuuuuuuuuuuuuuuuuuuuuugguguguguuugcuuguuuuuggugguuuaacaugugggaggguuugugcugacucuggguuccuugaggcuggccucauagucacuguuuugucuuuucuuuuuuucuuccuuuauuuuuguucuguccugucuuguccugcccauccuccaaugcucuagaccuugaacauugcucagguauguucacaaccuuacuguuguauugugacuaacgauacgcuggccgcuuuguagccacugauuccauuuagagaauacguguauggucggggcuugaaauuggcaggaccaugcugagaccaaggccacuaaaaaacgauuucuucuugggauaugagaguuauuuuugguggauuguuuuuguuuuuguuuuuuugguguuuguuauuuuaauauucuuuuuucuuuuuuuuucuuuuuuuuuuuuuuuuuuugguaacaaagagacaacaccuggcacucaaugaagccugucacuuuuugaugguuuauuuuuccuucccacuccauuuacuuuuuccuacuuuagggcuaaagcuagccugguggaauuuucagagauggaaagauuugugguggccuuuaucuuuccagacuacuaaaacaaauaaagaaaaauaacaacaacaaaaauacuuauguugcuuugccuuaaaacaaaaacaaauuaaaaacaacacaaaaaagagaaaaaaggcacuuuaauagagauaugcugcuuuuaaaaguuggagugguaaacuuuauacaggaaaggcuuuuuuggaaacauggggauugacuaagaaaugucagacucuuaggugaccccacaccugcuugacaaacacccuucuuugucagucuuugccagaagugccuuccuccuagagugagcuccucucaacuggagcucaccuguggugggagaaaaacacuauggccaaacuuuauaaaucaaacucuuaacagucccaagucuguuccaggacuuuucaccuuugauauuuuaaacaaaauagugguuccaauuauuuuuguuaaaaauuuuugagcccaacauauuaaaauagaccagcuuuuugauuuuaaaaagacguucuugucuagguuauauaaaauagcguuacuguuugcaauacuauagugaagguugugccagugcuuccauuuauaaagcccuauuuuuaaggacauauagcuuggccauaaaacuugcucaguguugaaacuuugcaugccaaaccucacccuaauagcaguaucucuuuuauuauuuuaaguuuuuucuucugaaaaauuugccaaguuuccuuguuuggacaagcuuuuguacaugugaaacugaaacugcuucacacuagaguaucugacagguaccucauauaaucugucaauuuaacaucuuaaauaccaagucauuaauucugaucaacuuucauugaauuagagguaaguauucaguuaacuuugaaagaaugcuucaugcuauguuuuaaaacuaauuuuuacagugaaccuuaagucauacuggacucaauuuuuuuacaguuugguggauaaauguacccauggucauuugagcugcaaauacccucccccagauauccuuagcuauccuaagcuuuuuucucuugggggcgggcagcucuucucaaacuagaaauugacaaaacaauugagaguauuucugaucugaucauuucgguaacaaguuucaaccuaaaaaaaguuuaugacuaagacauaaauccauaaaaaauaaaguuuauaauggaaaugcugacagaacauuauuaguauugguaccacuguaguguaaacauugucaaaaauucacaauucaucaguaaucguuuucauagaaaacuuuuaguuaggggauguguagacagaagauaauaugcucaguugacuugauauuuuuaccuacuggaaaguagacuagaaaacgagaacacacaguauaagaagcauaugauuaaagauaaccaagucaucuuaucacaucuuuuaucauuacagaacuacauccuacacuauacuuucuuguccuuucucuagcaaugugauaauuuacucacagcuuuugaaaccuuaagagcuguucauauuacauuuuccaguaggaauugaguuauauuuuaugcuaauauugguuacauucagcaagucauaaauagcccaguuucaugaccugcaagguggagcguuagacuucaacucacaauggaaaaaucuuuuuuaugugcuuacacgagaguuuguauucuuucugcugaauaaaagcacuacaaaacagauacacuccucaagcucuuacauaguguggugugugaacccuggcuacuaugagacagugaaguauucaucauucauuugaucuuauguuaaucaguaaguuucucuuugaaauuauucugauuauggguaacuuucuugguuaaagcagagaauaugauuuugaaagagaaaaugacauugaaaagaauuuuucuucccaacuucuccugaauagauauuauuuuaaaauuuauuuacaucacugaaauaauuuaaaauuaagcucaccuaaguacaguauguuaaaauuucacugcaaaagcauuaugagaacuguacaugaaaagcgucaaguaccacucaauauaggauaugagaugcuaagacugaaaagcgacaucauuugccauuugaaauagugcugggaaggaauugggcauaggucgaggguuaauauuaauguuucuauuaaugucuuuugccugauuuuuagcuuuuaucaaagcugaaaauauuaaaugaaguuucaguauaguuugggcuacuagguagaaauagaauuguuaaaauauugaauguaaauauucuuaaaacagguuuuaacuaaauaggcauauaguuaugauguacacuaacaaauuuaacuauauaugucaguauuuugaagacuuaaauucaccaaagcuuucacaaaacaagaugugaacagucauagggauagcauccauuggcuuaugaaauaaucuuagccuagugauugacaguuaacuuuuauucauagauucugaaacugcuuuacaaauguuuguuccacuuuguaaaaccaucugcuauguaguagagagucuuaauuuuaauguaccugucuuuaaauaauugaaaacuaaagcaguuuauuauucugaaguagcaacacagaucauuuuguaucucagacuuuucuuuuuuuuuuuuugauguuaccaaaauuugcagauaaagcaacauauuuaagcugucuuuaaacuugauuugagaaauauccuugguuuuaaccaaaaacaccugggaaauuuguaguuaauccugauagcucuucugcuaccaucagguaccggagcauuagguacuguagauauuccugacuuaauuuuugacagaaaaguuaaggguaaucuugagucauggcauauauugaaagaccaucagcuuuaacuguaaauuuccuaguuguucuugcuuugucaaaaucguacuauuuuugcuuuccuuuuaaaaucauuaacuguaugauaaucacuacaugccuaaaaauauguaggugaaaauccaguuuuuuucuuaaauagcuaauacuaaaaaaggaaacuccaaagugacucaagugcuaaaaacuaguuuuauuuaguuugcucuuuuuuccuaaagcagauugauggaagaccauuauggauggagaaauagaugacaaauuggucaguuuccaaacuggaagcaaauucccaucacuagugaaaaauuccuacuggaaauccuggcuuuacuucuuuucacaauuuuuucugacucuguauacuuugaaugaucucacucuaaauuuguguugucugacacauuucuuagguuguuggugguuggcagaacuagugaauuucaagcccuguacacaguaguuuugcaugcugauuuaagaaauagucuguaguguugucuguugcacuuugcucugcuucauaaugauaauuacauuuggaggaaaaguacuguagucucaacuggugguguuaauauugcuauuuguaaaccuguaaugugauugaacuguggucauggcauuguguuuuuggaaaaaauaugaaacaaccauugaugcuuaucauuuggauagauguuuguuuuauuugcaugcuuuaagaaacuacagcuauauuggagcuuacaaguuuggagcuggcaaagagcaugcaaaagaggggaugcuauucauuaugucuuguuuauuuccaaauuuguccccauuuugcauuuuuuucccuaaauuugaaaaaaucauaucccuuuuucauggcaaaagacugauaaucacaucuaaaguuuagggggaaagaucuguauuaguaauuguauucacuagaagggcuuccaacugccugcuacuaagucauauaacauauuuauaaaggaaauaugaaaauggcuuaaacauggcuuaacauauuucuuuugguaaaaauauauuuuuuaaaucacuuuuaaaagcacagaucuuuuugccucuagaaagggaaguugcauucucauuuuuaguguuuaaacucaauucuuuuucuuguuuuagauuuuaaaguggucuaauuuaaaauuaaagcugcauuauguuuggcuuccaagaaggaagagcagagagaucaauuuuuuuuccucuuguggaagaaguuuccauuucaguaucaggacgaauaccacacauugaaaacagauguugaauaaucugguagcuauuuagauauaccucuguauauaaaguuaguguaaacuuauagggguuacuuuaaaauaaagagauucacauaacugcuuuauuuguucugucacaauguuugaugccuguaaauccaggguuuucaucuuuugacuuagauugcaaaauuaauacugcuaucccuguuucauaugcccuuuaaaauguuaucuuuuuccaaaggauaaauaacaaaauucucuacuaugcauugcccuuugucaaauugaaacaaugauguccauaguggaagucaaaaguuaaugggaagucgguuuuguaggaaaccugaaaacauuuuuucaugaagcuuauccuguauaauaauauaacaugaugcagcuuuaauagacuaaaucuaaccuugacuucuuaaguucaacuucauuccgugcuucucagccucuuguuacaauuaaugcccauuaacugguaacuucugaaacuaaccgagaggcuuuuggaauacuguauuuaaucucugcccuacagcacaagcagcgcugcccugugcuggaggaccaguugguggaucugguuguuuaugccauggagcgaucugagaccgaggagaaguuugacgaugggggaacaagccaacuccuguggcagcaucucucaagucagcucauuuucuuugugcuuuuccaguuugcaaguuuuccacauauggugcuuucucuucaucagaagguauguacuaaaucuuauggucggagugacuucaccuguugauuacuguauuuuagacugcugugggcauucccuagugauuuuagaacugacagaaguucugagcccuaauuucuguccuguuuagugcuuuuauaguuucuuaacuuuuuacuuucuugucacuguaaaaacaggauucagucauucauucuauguauucucagugcaggcaccagcagauacaagaugaaaaggcacuguaauauccucaaggagcaccucacuagaggaggggauacuuuauauauauauauauacauauauauauauguauguguauauauauauagaguacauauauauauguauguauauacauacacacacacacaacaugauuauaucuuaauaguuguuauaaugaaagcacauuucccugcaauacaaauaaaagguaauagucccuaagguugcagugagccaaaaucacacgacugcacuccagccucggcgacagagcgagacucugugucaaaaaaaaaaaaaaaaaaaaaaaaggaauagucucuaucagaaauaucagggauggcuguaucaaagagaucuuuaagcuaacacuugaaggacaaauagaaacuugcugagagaaaaagaaaaguguuuccuagcaauaaaaccaucauuuagaaagggauagagaugugugagaacuggaaauaaaaauauaaaggggaaaucguugaugagauaaggaaggcaggaaagcaagagcagacauggagaacuuugaauggccaugugccuguucuaaggaguuuagauuuuguuuuggaggcaaugcagaggagaauggcaucaucauaugcaaguuggaaaaaugcuaauguccacauggagaaagaaggugguguagcgauggacagguacaaagccagaagcaaggaaauuagugagagauacuacaguggacuaggugaaagaugcugaaggccuaaaccaggacagaaaggaggagccagagaucagguacacugacguggaauaggacuaggugacugacagcgaauacagagaguagcgggagucuaggcuugcugagugguuccuacugugggaaugaauagaagggaggacgaugaauccaaaaaagggagacaaguggaagacuuaaguuugugggaaaagacauuuuuugucaaaaauuuuagacauauugaaugggaauaaaaguuguuuuacauaacaucuccacagcaugaauuaucuuggggaaaauuuuucauaaauauuguuaaaauccuuucaaccaccuucucccagaaaccaccauuaguuucuguuauaauguacagaaaaccagccgggugggguggcucacuccuguaaucccagcacuuugggaggccgaagccgguggauugcuugaguucaggaguucgagaccagccugggaaacauggcaagaccccaucucuauccuuguucuaaaaagauacauauaaauaaacaagaaacaaaguguacagaaaaugaggaagcauguuuuaugacaaccaguccaugacaauuucaaauuaaaaaaaaaaaauccuuuuggugugauagaguauuccccagguuuugaugagauuuuuaaaauaagaauuaucccauauuaaacuugauucucaugcacacaugaucaacuuaaagaggugguguugugcauguuguauaugacuauguucuaaaacauugcauuuuuauaugcauuaguuguuuuggggagcaggaaauaagcauauauauaauauuaaaauaauuuagcagguuuugcauggugugucuugaauugagacuaaguaauuacuaagugccaaaguuagaugcugacuuucucagagcaagaaccagguuucuccuuaaaaacaaaaacaaaaaaacaacaaaaacuuccuguauucaucucuuuaaguagcaguguauacauguguauuuaaacaucuuuuauaguuagcagggcgaggacugauuaaaggcagagaucaucuuauguggguucuccugcaauucauuucuggaaguauucagaaaaaugcacuagcugauuuucucccugugaugaagcucuucgacuugcuauacccagaaaaagaaguaagcuuuacugaguaacuauucauaacaacaugaugaguaaauuaugucuaauuuauguuuaaggauuuuagugugauuuuguguauuucuaaaguuuaugcuaaaucacaauugaauguuaaguguagcaagcucuuucucuacauucuagguaggucuacaguuuuacaaaucacuaaagcuguuuuaaucuauauacaucauugaauggccagauaacagucuuuauuaauagcuauuuuuucuuugacaguugagccucaguauguccccuggguauuuuaucauauaagauauuugaguaaaaugugauguauuuugaugauugccauuuucuagaaguacuuuaucaugaauuguuguuguuguuguuguuguuguuaaggaguuucacuguugucacccaggcuggagugcaguggcgugaucucagcucacugcaaccuccaccuccuggguugaagcaauucuccugccucagccucccgaguagcugagauuacaugcacaugccaacaugcccgacuaauuuuuguauuuuugguagagacaggguuucgccguguuggccaggcuggucuugaacuccugaccuuaggugaucugcccagaaaauuuuaagaugaaacaagaguauuucuugaugauggguauaacaugaugggguuacuguaaccccaccaugcacuagcuguaaccccaccaugcacuagcuguaaccccaccauguuauacccaucaucaagaaauacucuuguuucaucuuuccuccuuauuuuuuuuguuaauguuggacaauuuucaagcaaaucccagacauccauaucauuuuacccauuaauagucaauauguuuaaauguaauuauuuagguugcguauuucuuagauuuuuaucuguucuuaaaaauuauuaugagacuuuuagaaagucuuguuuuuaguuacauuugucacuuuaguaagauuucaugaugauguguuuuaauuuuuuaaaaguaaaaauuaaaaauuuauuuuuauuugagaaugcucugcgauaguaggaaaagcuugaccaagcaccugugaauauguguuacuuaaagcaaguaaaaacauauaccaaauaaagcaucuuguaauaauuucaaaauuuuauggcuguuagaccuucugauuuguauuauugaauuaucggggcuaaaguaagacaugauaugcuaaaaagaguuauauuagaaauugauuacuaaaauacacauaauuauuuaauucuucucuuucuucuauuguguuauuuuucaaauuguuauuuuucaguauaucccaguuccugauauuaacaaaccccagucaacccaugccuuugcaaugaccuguauuuggauucaucucaauagaaaagcucaaaaugacaacuccaagcuacagauuccaauaccucauucccuaagacuucaccaugaguaaguuauuuguugcuugauacuuaauuuucuuguuuaauuaauagcggauuguagacuaauauuggucucgguguuugugugaaauuuggaaaucuccgcauacccacuauagguaagggcaaauacuugauguauaugucauagcaggagaaucugaccaguaccuauaucaggaaacagcuacaagguuagucuugcuuauauguauagauuuuuuuuuuuaauuuuuaaggcugaucuucaguuguauauguuauacuuuaaaguuauuaauauaaugaaagcauaucaauuuuuauaaauguaaaaauguuucagaauuucccaagugcuuggaacuucagcauaagcugacugagauaucauucaucucugggcugccaggauugauugagcugaucuggcuggcaugccccuuaauaucucuuccaaaguugugaugacucaaugaagauaccauucuuagauaguauuguauuguagucaagggugcuaggaguagccuaacuucccaccuagaacuucugagaaggacugccacuucucuucacaggagauggcaggauugucagacuugauacuucauuugguuuucauuuuaugagacagcccuuaaccaccuuuucauagugguaucuguaaugaagacauuguuguguuuauacagacagauaauaaauagaaaccugguucauagacuugugaguuauuucuucauucucugaaacuuagccuaauaugguggucauauauguagugcauacuuaacaguacccauuaauuguuuauuuaaaauuauuuuucuucugaaaugcuacucaaacuucuauguguauucccacuguacauuucacacagaaacuauaauaccuauaggaacaaagauagcauuaauaaauaauugcauaaaauugaacuuuuaaaaaaauacaaauuaacauuauggaaguuauuuucauuuuuucuuuuuaauggaacgugaauauuuagguuccugcagcagagucuaagaaauaaaaguuuacagaugaaugacuauaagauugcucuauuguguaaugcauacucuacaaauucagaauguuuuacauuacccaugggagcucugguagaaacuauuuauggaaauggaauuaugaggauaccucucccuggaacaaacuguauggcuucaggaucuauuacccccuuaccuaugaaccuccuggauucacugacaguucaugccaaaaugagguauguucuuuuuauuaauuugguuccaugucagggaauugauacgaguauaguauaaaccuuuauuucaugauuuuaugugcguauuauuucauagucagguacauuugagaaaaaaaaguuagcuuuauuuuauuacaaaaguaaauauuuuuuauuauaggaauucuaggauaaacaaacccaaagaaaguaauuguuguaaucucuacaugagagauaagcauuauaaaaauuuuuugcacauuuuuuuucauuuuuuauagauaguuaagaaugaggacuaguguagcuagagcuuccaacauuuuuggaaagggcuagaaauccagauuuuuuauuaguagucuuucagcuuuuaaguauuggcucaaauuugaaacaaccacuguauaggccaaagagaauuugucugugggccuccaaguggagcaucaguccugguagagcuaugcucuuuuucaaaugguaaccauugugauagaauuacacaugugcuucacuugcauauauaacagauuugagcaaagccccauuagaacguaacauuugggucuuagcagugauuuauuaaaguaaaucugugacaaaaguuauuuaauuucccaaauguauuuugaugcaucauuugagugaccaaaaucccucaagcaugcucuuaugaguugaauccaaaguuuguuuuuccaugagcagggggauccguaugcauauugaaagcgccacagaaacggaaugagucucagauugugcagugcauccuuaccaaguguccugcacagcuuaaacacauuaaaugaaucaacuucauuugaaucauuuaaguucagauuuauacuaaguuacuucuaaguagaguagccccuauguuuaugucaaaaauauggauuuuuauuuucuucccuuuuuuucuccucagccuuauucacagcauugcaaccagggugauaaaacuugcucaugcaaaguccaguguggccuuggcuccagcccuaguggaaacuuacagucguuuauuggucuauauggaaauagagucuuugggcaucaaaggauuuaucaguaagacaggacuuucugguguuuauaacuauuaacccauucauuaacucuaaaguuacuuuucuagguccuggggacacagcagagaacaagucaccaccaugauggagcuuauggaggaggacauuaaauaaaugaaauauacaauaugucagaugauacauguuauagagaaaaauaaagcaaaaaggaauaggaagugugaggguugggggguuuguugcauuuuuaaguaaagugguaagaaaagguuaaugugcuaggugccugggaugcagugagcaggauagaccuggucccuguccucaugcaaauggauucugccugaggcagcaaugcuguccuccagugcauacgaagucugacuggaaauaaagaaggaauuuuccuaccuugcagaagauacauuauaaugucucauuuauuauauaguucuaaaauaauagauacuuucugauauagaaguguuuuucugauucaugguaauuccagcuuuucacgaauacagcauagucuuaauuuuaaccacaauaacucuucuuagauaacugauuguugaacaaaacuuucuuggggguaggaggaaacaagggcagguauaauacaauuuuuuguauuaaaaagugaaccucauacuucaaaagguauggaacauuaauugucuaaaaauaaaagauaucagaauugagaagauuaauguuuuuucauaucuugucucauuuuauuuuuccagauaaacaugauuaucaauugccaaaucccaggaaaaaagcaaacuugauauuauaguuaggaucugaauuuuuccuuacuguuaaaguagaaaauaagaaaauauggagaauauauaugugugugggcguguguauuuucacaaucaaaucuuuauauuuuacucaaugugacuuucuucaaauaucuuuucaugcauagccuuuaauaauugguaccuuaaauugucuuuuuccuccaggucagcuuuugccaacuguuuucaaaucacaugcaugggggaucuuacacacacuccuugagauguuuagcuaccggaugcaucauauucagccucauuacagaguucagcuccugagucaucuucauacuuuggcugcaguugcacaaacaaaccagaaccagcuccaucuuuggugagcucauugaagaccaucuuuccuuaagauuuauuagaaacuuucuuggagaugagguucuuaauccuuuaccuuuaccuuauaguuuuuuuuuuuauuauuauucaucugucauaaaacuucucugcuucuaaaguauuuuguuuccaguauaggagcagaguccagcuuuuuaaauagaaacugauuaagauaguugaguccuuccuucaggaucuuuggacugagaauuaguacuuccaggguauuuauuauuauguuguaacuuagcccuuuagaaugcugguuuuaaguauacuucagauuaugguuaaaguaucaugucacauugauuuugcuuuacauuaaaauauauuuuagauagaaaaauauaauuuuugaaaugcaguaucuccaggugaaauuuuuuaguccuauaggcgacaagccaucuuuuucaaauguguaaaaagucacgauuuucacuauaaaauuggacacauuagguuuuuuaaacaaauuaagcaacauuuauucucacacaaaaguguuuuuuuaaagaagggauagucauagauugcauguuuuuccauuguaauuaaccuuagauuuaauuccauaauucugaaauuuuuuuacauuucuuuuuauucucccaauuuucagugucgagagcacugcucucaggcuuauaacagcauuagguagcucagagguacaaccgcaguuuacacgcuuccuuagugaucccaaaacagugcucucagcagaaucugaagaacugaaccgagccuugauauugaccuuggcuagagcaacucauguaacagguacggugaauaugugacuacaaacaacaacagaugaauuaaagugugccaugauucuacuaauuacuauaguuguaacauacuaaaaagauacuuuucauuuguuugaaaaaagccuguuguuuugauaucuucacuauuucacucauuuauggaagcucuuuuguguaccaucauucuauuaauaacugcguugagcaucguuuucagcuauccauaauuuuaaaguaguaauacuuuaagcuuuuuggucucaggacugcuuuacacucuuaaaaacaaaauugaaauucccaaagaguuucuguuuauauggauuauaucuauggauauuuauuauauuagauauuaaaauuaagaaguuuaaaaauauuuauuaauuuguuuuuaaauagcaauaauaaacauuacauguuaauauaugauguuauaaaaaaaguauauuuucuaaagcaaaacuuuagugagaagaggugccauuguuugacauuuuugcuucucuaauaucugguguaaaggaagacauaguuuggauucucaucugcuuagacauuuaauccauugaaguuuuaguugaaguaagugaaaaauguggccucacacagaugagguuggaaagagaggaguauuuuaauagcuuuuucagauaauugggaauguucuuugacaucacauggaaaaaugauaguugcuuaaagguuagcugcaauauggaauccaaaacccccaguaaacuucauguacuuuguuacauuauaaucuguacaucuguuuuauacauuuaguggauuuuuaaauccaugcauguuuuguaacuucaugaauuauucauuuugaaaauacugguucacugaguuacguagaucuagcaaacguugacauuuuguuuauacaguaucagaaaauuacauuuguuaauaucacugcaaaguuuauuagaaaaaucuaaguuuuggaaugcuaucaugucgugguagauacagguuuuccaaaauuucaauuuuuacuugaaaggucaaauuuuaucauuggaaaaaguuacuaucauuuguuuuccuuaaagugacaagcucauuuuguuaauuuucaagaaaaugucugcuaaauacguaagucuagcuagcuauaguuuucugucagacguucuuucaaguaaaauuggaauucaaaaaaaaaaaagcagcugauuuaacucagugcucagucagucacacaagugcacaaguguuuuuccucaagacacccaucaaacuuggaacacuaggcauaugcuuccccuuuuguuacauaugauguuaaaaauaggugucgagauugacacuggcacuuuucuuucacugagugcaugugcuggagaauacaaagccuuuucaucuagucuggcaccacuguuugauuugugcuuaggaccagcaguuuuaccaccauugcuuuuguaccgucagugcucauaccaagugaaaaagccugauaucuuuuuauuauuauuugaccucauugaaucuuugaagggcuauuggggaauccccaagaggucuacagaccacacuugagaacugauguuuuaaagagauaguuauugguuuuagcaaccucaaauacguuuauguaaauuauuuuguuuuacauaaagaacccucuucaauucugagauuuauacaugcauuauguaauuauuucacucaccaaaaaagauaucuuucuuuauucuguucccuuggccgaauaaaguacuacuaaaucagugucaaaguaaaugaacaguagugaugggcuuguauuacuguuaucgcugguacucuguaaccucaaaaaaagagauuucaaaugucuuuugucaucuuuucauaaacuguucucauauuuucuaaugugaucauccagaucauucauaaacuaagcaaauuuagguucuaagcugaauauaacuaguuaagcagugaaugcacugcagugaaauucucaguguacauaauuauuauuuucgcuauaaucuuuuaugaauuguggauauaaucauuuauaucuggauuacaucuauuuguuuauguuuagauuuuuuuacaggcucugauucaauucagggaacuugguguaaagacauacuucagaccaucaugaguuucacuccucauaauugggcuucacacacccugagcuguuuuccaggcccacuacagguaauuuggucuugaauuacuuauugaaugcacaugaaauccuucuucccauucacaaugguguucuagagugagucuuggugacuucugaauaaaauuagcuuuuauuuauuuuaaaaaauauuuaggggcugggcaugguggcacaagccucuagucuuaacugcuugagaggcugaggcaagggggauggcuugagcccaggaauucagguucacaaggaacuauggucacaccacuguaccacagccugggugacagagccagacccugucuguagaaaaaaaaaaaaaagucauuacuuacaaaaucucucaaguuguucuguguccuacucugguacuggacauguuucuaaaaauuuaauuauuaugguuucaucuuaguuaacaguuuuaaggggaggaagaguagaaagaggaaaaaaauaaaagugaaaaaaauugaaaaagagaaaaaaauaguuaaugguuuuagaaucucaugaaaauuaacauaguaccugaaaacuuuuuucucucucauagaacugaaauggggagaaguauaacguaauggagcuucacagagugugcguaauaugacacuucacugaauuuuuuucuuaaucacagaaaaacuguaaaccuggcuuuucuaauaaggagaaaggcaaaccucaucugucuucuccuuuucagaaaaaauguuaggcaugaugaacauccauuuuucauaacuccugguagggcuagagcauuugguuuuuaaacuuaccaaaucaccuggagggcuugcuaagcugcaguuggcugggcccccagccacagagcuucugauucaguaaaucugggauaaggucugagaauuuugcauuucuuguaagacccagaugaugcugauaccgcugguguugggaccacacucugagaaucacugggcuagugcaauggauuuuccucaaagacacuaacauauguagccaaaggguagagacacuucauucuuuuuuuucuuuuuaagauuggcggaaguaucaacagaugauugaagaagcuuugaauucaggcuuacuuagaauuuccauuuaggaaaucuaggaaaaggaaucuuggagauaaucuagucaagcuuauguauuuuccagacacagaaauucaggccuuaauugcugaguugcucaaggugaccuagaguuuauuagugucagaaucaagucuagaacugguuuauuaacuccauauccagugcucuuucuacuauaaccaaugaaauaaacuucuaauccucuuuuuaggcauucuucaaacaaaauaaugugccucaggaaagccguuuuaaucugaaaaaaaauguggaggaggaguauaggaaguggaagucaaugagcaacgaaaacgacauuauuacccacuucucuaugcagggcuccccuccucucuuucuuugucuucucuggaaaaugcucuuggaaacagaucauauuaaucagauuggcuauagguaagucaaaaaccuaauuugcauuccauuuggcaaauuguuguauccauacaacaauggaguuuauguuuuacucucugccuuccagaguauuagagagaauuggagccagggccuugguagcccaugugaggacauuugcagauuuccugguauaugaguuuucuacaucagcagggggucagcaacucaauaaaugcauugaaauucuuaaugacaugguauggaaguauaacauuguuacacuggacagauuaauucucugccugguaagaauaaauacauuucuaagcuuauucucuuagaucaagauguaugacuaauauauguuaugccaaucugcucuauauugcuuugaaggauuuaaugaauuuauacuauaucaagcauugcugucacuucccuaaagagccggaaauuuuccaauuucuguuuuuguuuguuuuuguuuuuuuguuuguuuuuugagacagggucucgcucugucgcccagugcaguggcgugaucauggcucacugcagccucaaccuccuggucucaagcaaucuccuccugccucagccuccugaguagcugggaguacaggcauaugcuaccauacccagcuaguuuuuuuucuuuuuaacuuuuuuauagagaugggguuucuccauguugcccaggcuggucucgaacuccugggcugaagcaauccucccucuucagcuucccaaagugcugggauuacaggcgugagcuacugcuuccagccccaauuuccuuauucauucauuuaauaaguacauauugaauaucaacuguguucuauguauagaagguacagaaguaaauaaaauagaugugguccuagccuugugauacuuugaaaauaugagcaauuagacccugaguugauucuccaaaacucccacuagagggaggaaguagcaguaagucacuguguuucuuuacagagugcgaauauaaccauuucuguacacuuugguaacaaacauuccccaaauguuuuuuucuucuccugacuuugaugucuauuuccagcagaauuuuuuuuuucuuuuuuuuuuuuuuuuuuuuuugauauggagucuuucucugucgcccaggcuggagugcaguggcgugauguuggcucacugcaagcucugccuuccggguucacgccauuauccugccucagccucccaaguagcugggacuacaggugcccaccaccacacccggcuaauuuuuuguauuuuuaguagagaugggguuucaccguguuagccaggaugggcucaaucuccugaccucguguucugcccgccucggccuccgaaaguucugggauuacaagugugagccaccgcgccuggccuucggguagauuucuuuaaaaagauauugaaguaggcuggaaaaugcuacauugaaaaaaauucuauggcggugacauuuggaguggcauaguuuaacguuaaccccuuagcuguggagcauagauauaaaaguaguuauuauauuuuagggggaauaauguaagucuauaaaucaauaagaugucaggauaagauggagguguagaaaaaauauuucuaggaaacagugagaaaucuuaucugcuuaggugauagcugugaaagauagauuaaauuuuuaaaaguaaagauggacaucccaggcagaaggaaugguaagccagaaauaggcaagaaaggucauauauguuuggggaauacugaacaguugguuugggauagacuagacgucuaaggaaauuauaauagugagauuuuacuuuguuaaaaucuaggcuuucagauggcccucaugauuuuacacagguugaacauuuucauauaauuuuucuguuguuuuucaaaggccaugcguagucacgaaggaaaugaagcccagguuuguuauuucauaauucaguugcuguuacucaaaccaaacgauuuuagaaaucgaguaagugacuuugugaaggaaaauuccccagagcacugguuacagaaugacuggcacaccaagcacaugaauuaucacaagguacuaguccuaauugguauuucaaauaguccuuuuaaagccauacuugaguauuugaugaagugauuuggccguuuucucucugguucuaauguuuuuucucuugucuauauagaaguaaguuagcucucugaacuucuucaagguuugagaguuucuauaauguugagaauaaauugaaacugcaguuuuaguggacauaaggacuucuauaaaaagaaguaaaguauaaucaaguauaauuuuaaauguuuccuugcaaaaaaaaaucuaaacaauguuuucacauuuagcucuuuuaagagaauuuuuuaaaaaaugcucuaaccauuuaucaucuucucaauuccacagaaauauccagagaaguuguauuuugagggccucgcggaacagguggauccuccuguacagauccagucucccuaucugcccaucuauuuugggaaugugugucuucgauuccuuccaguauuugauauaguaauccacagauuuuuagaguugcuuccgguauccaaaucacuggagacucuacuggaucaucuaggaggcuuauauaaauuucauggugagcuuuuuccaauuuuaauuucgucuaauaccuccauuaucaaaaguaggaugggcaggaccacaugguaauaguggcucuaaagguuuuauuuuaaauauuuuaaaaaugaaguguuuugaggauaaguacuauggauggugccaugaaguauaaaauauacaacauaaaaauauaaacaaaaguaugaguucagaacagggugauguuacuguaaacuaaacagaucuuggcggccuucuuggauggguaggauuuggacuugaugcauccaauuuauagcagcagcagggaaaauauagcacacgaggcagaagggaucauuugggggaaaucauggaggagauaaaguauauuugaagaaaaauugcuacauuggguugaauugaaaauucuuaccagagaguucuagaaauaagauuggaaagacagauuguaccuaacuguagaucaccuugaaugcuaggcugauuuuguaauugcagauaauaaucaacuggaaguuauugaguaugaucauggcauaggaaacauuauuucagaaagauacauccaguuauaguuggcagcagucuuaggaugaagccauuacaaggacaugucaaaaagcucaguugugugauuaguaucuaagcaacagugguugcauugaaaaugagagaaaagggacaaauggucacaaaagaaggaacaggacuugauuggcugguuauaaggagaauauugaaagaaaaagacaacuaaaauuuuaagcauaguuacuggagaguggcagggucagugacagaaaugugaagguccuggagcagccacucugggaacaaaguguuugucuggcaggcaguccugcuucaucuuuaagauaccuucccucagagcagaaguaugaauuguguguuaacaugguagaauaggcauaaaguucaagugagcguucuuuuaaaaacauuuuucuuuuggauuagguaauauacauacuugaugggguggaguauacagugaaagguaauuagucccauccuggccuccagcuacccaguuucuuucguaggcagccaguguuaccagucucuugccauccccucuuagauauccuggcugguuuuguuuguuuguuuguuuguuuguuuguuuguuuuaacacaaguguucuguacccuguuuguuucaacuuuaucauguauuaggguuggucauuuguauuaguacguaaagagcugccucauacaugccagauuuacuuuaucaguccccuguuuuugaccuuuuaggcuguuuuucaucuuucgcuaguauaaacagggcugcaaugacaucccuuguuguaugucaagggauuaaaauuuaugcaggauaaauuuucagaaauggaauugcuuccacuuaaauaaaaacaaauauaaauacaaacuguauauuacuagaaacauucugagccuucugccucuccucagauuaaaauauucauaguauacaauugcccagcaugugaaguuguuucauaaaucuucugagcuguuuuucaguuaucuggaaagcaguugaucaguuuuucacaguuauuaguaaccaguuaaacauuguggugguauguuuuuuucuuggcagaucguccagugacuuaucuguauaacacucugcacuauuaugaaaugcaccugagagaccgcgcauuucucaaacgaaaacucguccaugcgaucauuggcucucugaaggauaaucgaccgcagggcuggugucuaagugacacuuaccugaaaugcgcuaugaaugcacgagaggaaaauccuuggguuccagaugacaccuacuauugcagauugauuggcagacuagucgauaauauccuuuuuauugugauuuuagacucccagaaauaacaguauuuugauuuaugagaauauauuuuuucuuuuaaaguaauuuuuuauguauuucaagguuuuaauuuuuuuuaagaucacuuccauuuucaucucuguaaagauuugaaaucuuaaauuaacagcaucaugccaauuaggcugaaauucuguuaaaauuuuuauuuuagaacuugaggauaagcgguaaaaaaauuauauuuaaaaauagacuuuauggagauuuguuucaaagaaaaaaucuuauucuuacauacuauauuuuguagcacaugcaucugugugcuacuggagaacguaggaucuuguuacuuuaaaaaaauuaauguuuguaguaaauaauaaaugauaaaauauauuuuucuuuauugaaaagguauauuuuagugaaaauauacuuggauguuuauuucuucauuuugauuuuauauuuucaguuauuagcacucuauacuuaaugucuauaaccauaccacuauuuuacuagguaagaaauucuacauaaaugagcaugacuuauuuuccuacacaaaggaauuuauuuucugaagcaaaagaaugacucauuagaaaauaauuuucauauuaaugucuuauaacuauuaaaagaaauaggcucaugaaaccuagguaaaccuugguugcaucuguggcuauuauaugucauauuuauaagaacccaccugaaagaccaaccauuuauaccugugguuaaucaaaugguugcuuuuaauacauuucaaucaugucaaacucauuuguauuugguuugcauuugccucuuaaucucucuaagcguagacaaaucacuucuuggcagcucauaaucagauaaauugacaaucagaugagauaguccaauuguuauugcuuuaacugugugcaccgauggcuggcaaaucuccuggucccuuuccaaacugugacuggagauucaaugaguuucccaacccagcugcccaugcucuccauguuacuuguguggagcucauggccuuggcaguuucaggcaaagaaguugggaaugcccuucuaaauguuguccuaaaaagguauguauucugguucaugcaguaagauuuguuguuuauuuguaaauagaaugguauucuauuucaaacuuuuaagacaaaccuguugccgcaaggcugaugcacauuggaugaugacuguuuucugguuccagaucuugucuuugugauauaggaguuauggaaugagcccuggacaggauccuaagauccggguuuguuccuacuucuacucauuaauagcaguuugacauuuaauauaggaauaauguuaacuugucacuuaaaacaagauucucuucaucuuguuuucaagauuucaagauucuuuuaaaaauuagcaugaaguaugggauaaugauuggggaggaaguauuuuuaaaaagccuucuugaguuuuuaugcauauuacauuuuuauucaauaaaaaauuccccauuguuuuauugaaauggauuaguugucgauccucugaauuagacauauucuuuaaaaauaagauccguugucagccaucuaaaauguuuuuauaaauucauacuuacauucuuuuuugccgguugcagucagccuuuagugccaagagagaacauuacagcauggaugaaugcaauugguuugaucaucacugcccuaccagugaguuaauaauugugauuuguacuuagugaugaaauacagccagcuguuccaugucagcaaaaagaaaaagaugcauauaggaugcccuuguacgggacgucaugcaaauuaaugaaguauuuuauguuuuuaaaguuuuuucauauuauuacugcuuuaaaaaucuacagugacuaguuuuugcuuuucuguauuagaucuaaauauaucuaugugacuuacgggucucugcauuuucugguaccaccuuaccuauccaacuuuaguuuuuacauaauagcuugaucuacucuuggccacuuaacguguuguauaucuacagccuuuguuccuucagauagugcuuaagacauguuuuagguacuucugaaugugagggaauaagacauuuuucuuauuccagaagcuucuucuuuccaucaccuucucuaaagccuauucauucuuugcuagcuuagagccuccuuucucagugaaugaagccuucccugacuuuuccagcucacaugaagacuccuuucucugaccuccacacauauuuuuuuaaaguuuauuauuuuuaaauaaguaauaaagcuauagauuuauuguuugauaaauuaauugauuuacugcauaguguauaucagguaccuaaaugagcuggacagauacauguauggagccccuuaacucacaguuacuucucccagguuguuacugacuuaauuugaccaguuacaaagccacccagcuguauugugcagaagcuggaaaaauagaaaacuuuaaagaaugagaaaacacuauuacuuuagacuuugggguggaaugcuggauaagugauauuuuucacuagcuuuccuccgauuuuaaaggagccauauuggauuguucuucaugaucgaauugugagugucaucagcagccccagcuugacgucugaaacagaguggguuggcuauccauuccgccucuuugauuucacugccugucaucaguccuacucugagaugaguuguagcuauacguuagcucuugcacaugcuguguggcaccauucuagcaucggacaacuuucucucauuccaaaguaaguauaauaauuucuuaaagaaauuugacguaggcugggugcggugguucaugccuguaaucccagcacuuugggaggccgaggugggcagaucacaaggucaggcgauugagaccauccuggccaacauugugaaaccccaucucuacuaaaaauacaaaaauuagcugggcauguggugugugccuguaaccccagcuacucgggaggcuaaggcaggagaaucacuugaaccagggagcuggaaauugcagugaaccaagaucgcgccacugcacuccagccuggugacagagugagacuccaucugaaaaaaaaaaaaaaauuguauuucauuuuguucuaaucucauuaacagaugagguauauacuucauucauuagaacaacuugcggcugggcgcggugacucaugccuguaaucccagcaauuugggaggccgagauggguggaucacaaggucaggagauugagaccauccuggccaacauggugaaaccccgucucuacuaaaaauaaaagaauuagccaggcgugguggugugcaccuguaaucccagcuagucagcaggagaaucacuugaacccaggaggcggagguugcagugagccaagaucacgccacugcacuccagcccaggcaacagugugagacuccgucucaaaaaaauaaauaaauaaaaauaaucaagugaaaguaauagccagugagagaugugagauuaauuagaaauauuauuguuaccaaauuaaaaggaacuuuaaaaaauuauauuuuauuguaauacuuuguauauacuguaugaacaaaauucaaacaauuuaaauaauuucaagucacaggagauuuuuaucuucaaauuuuagguuucuuacugaaguacuucuuccuauagugaagaccgaauuccaguugcuuuauguauaccaucuuguuggaccauuuuuacaaagauuucagcaagagagaacucguuguaugauagagguaaaauauaaucuggguuuccugugacaugauuaaauucugaaguaucuauuuaaguuucuuuaccaguguuauugaaacugcaggucacaaccauuaguagugaaacuaguuuaacaggauccaagagcaauuuuagaggacuuaguuugccaguaaugaauuuagggugggauguauugaauuggagaugcagaggaaacgcccaucaugaagguugagaagagguuaaggauggagaaguacauuugagaucuuacagugcagaggagcuaauuaaaaucaugagaauggaugaagucagucacuucuaacaaaaugucgcaaacaaggaaaggacccaggaguagaaccuuaaagcaagagcuaccaaauggaacuaagaaaguauaauccaaaggaucccuaggaguggaguuaucccagacaucgagagauggugucuagaaaggggauuguuuaucucuugauuuuaagagaaauuacuuaacuaugaagagaaauuuuauuuaagccuugucaggggcauuuuguagcacuauagauucuuuuauaaaugcaagccauaucauaucucaugugcauagagguguauaugguauaugacaguucuacagcaaagacaguaucccccggugcuaguguuguaauggagcccagcugcaucaugcugaauuacugaaucacuugaucacuuaaauaauuuuacauuauuuguuaaauagauugguguggcguuuuaugacaugcugcugaauguugaccaguguagcacccauuuaaauuacauggaucccaucugugacuuccucuaucacaugaaguauauguuuacuggugacagcgugaaagagcaaguaaguugaauuuguuuaauuauuuuuaaugauguuuaauuuagaaaacuugaacauauaguaauagacuuuuuugguuugggugauuauuuuuauuuugucuaauuuuuucuuuuaaggaaaaaggguggguaugagaccuuuuuaggcaucagaggcauauuauucuagauguaguauuaaaggaaauacauguuauaauuucuuguacuuuucccccuugauauuugcaacagaaaaucugaaaaagaccuagaggguuaauuaauaguaaucucauuagggagaaacagugggauauggcugcugaaauaugagcagagagguuguuguguuaugaguaaaggagguccugcuucuccugacacucauggugacaguagacaaaccgcggcauaacuagaagacuaaagucaggauucuagacuaauccugacuagagacuaacucaugaaaagcauuuagagaauaugggaaugcuuauccugaagaaaaaaguccuagggaauuauuuaugaccucagcauuuuggaggguuuucauuuggaauagguauuagauucguucugugucacuuuagaggguguaugaauucugguaaaguuaaagggaggccacccugacuuagcauaugaagaggaacuuccuaauggggaugucugaaaguagaaaaagaccuugaaucauaacugaguuuccuacguguaggaaacagaaucugggccauuuuaaaggaguggagguaggacagauagggaaaguuaaguccauccuccuaccccucccaguacuuuagguugagaugccaaggagguugacuccuuuaugucucagcagcagugucaaagagaguugaccuguucucucucauguaagaaagagagaaauuguaucugcuuuuguuacaacacagaacaugcagagaaacuguaaaagaaauuguuuauuuguuuguuuuuuuaaaaaaaguauucuuuacauuuaggccuaagaaacuuuaacacaagggaguacagaaaggaaaaggucaaagagcauuugaguaaagcuaagaaagcugugaaacgacuugauguguuugucuccuuaguguuuuucaaaagaguagaucuaauauuauuuaguuaauuccaaguguaaaucaaaaccaaaauaguuuuauagauaaauguugcaaacaugaguuauucaaagaacuuuauaauuaugcuucaugcuucuguaaagauggcauuuuaaaagaaugaucaacuuguuggauguauaaaauuuccaguguaaacucugcuagcuuuugguagugggaugacuggcuagcuagaugaguggauacgccuuuguaaguauaugcauauauaugaauauacauaugguacauguacagacaugcacauauaauauauaaggggugugugugagggagaacguauuguuucucaugcaagaaagaaaucauuguaucugcuuuucuuaaaacacagaacauguuaagaaacuucucaucuaccccacgacacuccuuaguuuauugucuccggauauguguaaauccugcuuuaaaugugagaaguugaaauucucugauuaaaguacguuuuaauguguuuuuauuucuuagguagagaagauuaucuguaacuuaaaaccagcuuuaaaacuucgucuucgauucaucacacacauuagcaagauggagccagcugcagugccuccacaagccaugaacagugggucuccagcaccucagucuaaucaggugcccgugucuuuaccaguaacucagugaagccagacuguacuguggagaaaguagaaauauauccgucuuugagaguggacucaaaccuuuuaaaucugaaugcgaucacacuguagugauauaguagaagcagugaugauauucagauuguuuuauuuugauucaaaugaugaaucuguugacaccuuauaacucccaucucccuaucuauauuuuugucucuaagagaucaaguaagauacauguuguucauauucauaacaacuuauuagagcuauguaggaacauagagguaucugugaucaaaugacuugucauuggcacuuucagucuuuccuauucuagccguuguuuuuguuuguauuuuuuauuauuaaugacauauuuagucuucagauauauuauuuuaaaggcaccacacauguaaaacaguuauuacaaauauuuuauacauaaaucucuugguagauuuucagaauaauagagauuuauaucaagaaaaggaaucuagauuuuguugcauuguaggagcaaacaaggcuucauauucuuuuuaaaaugacuugaaauuuuauuauaaauuuccauaguuucuaucaaggucaacuggcaguuuuauuaccuuugcuauggacuugaacuuacuguauaaaauuaguuggaagccauguaagaaaauaacaucugaaaauucuugaacuuaaaaucaugcuuaaaugguugauucuccaauuucuuuuuuuaaaaauaaguuaauugcuuuugcagguugacacucucaccugacagaugauguaauucuucaauuuuuauaaucuuaaaauuuuuaaauuuuauauuuguaaauacaguacacauuuuauuucuuggauuuugagagacauuguuaauuuugggggaauuggcauugcgaaagacuugaaaacuaaugaguaaagucugcugaaugaauaaaccgu

SEQ ID NO: 16220 - RNA, 223973 nt, Homo sapiens
cgggaggggcuuccgccgcgagggggcggggccggcccucagaguccucugacggccccagucagggaauuucaauuugaaaccuagcggagggaggaggcaggcgcggcugccggcggcugggacugaagagggacgggucccgcggcgagcgagcuccugagguacggcgucgggguaaggaggcgugcggggcugcacgggccgggcgacuggucagugugggguugcaggggcggcucagauuuuuccucuggcugcagcugggaagcugauuccgggcaggaagcgguggcgggacggucccaccgggauggggggcggggagagggggcccggcuuugggauuuucugcggcucccucucuccuuuccuucccggucucugcccgacccgauucuugcccggggguccggguccuguugcuccgggccggaucccggcuucgcugcuccccgcggucccccucuucccucuuccgggggaccggggccgcgucccggcggagccaggaaaggcgggggcacggggaggacgccgucccccccggggugccgugggcucaggucacgcguccgggccccguggagcaacagcgggaaaaauccggcuccaucccccccgcggggagggggucggccgcggcgucgcccuucaggaggaagguuuuaggaggggaagcgcgggccggccgcgcgcguggggacugcgggaagccgggcgagggcggcgcgccagccccacgcgcggugcgggucgggcccgcuguaggcucgcguccgcgcccccagcugccgccugcgccgucugggagcugcggagagggacgcguguuucgugcuccgauccuuacaauucccacacccaggccaucucaccacagauggcuuguuuuuucuccuccugcgccugggggccgaggguugggagcauuuuuaggugagcagcggggaagggcgaggagaaccuaaaggagcgcgacaggguugaagucggcgucuggggacgccauccccaggcgcagacgcugcccccagcagccugaggucuguggugggacaucaguuaugcuucucuagaucgcucaccuccccugaggucaaguuuuuuuuuuuauauauauguauaaauaaaaugagguuuggugagaagaacuacugccuagagucuauuauuuuggggaggggucugcguauggagcccucccuacggacccggguagucuuucauugaauugccccaucaacaccacagcugcccuuaauuuuaagaucccuggguggaugggagagaagguggaaucuagaggagcuguggcuauauuuucgcuuuucugaaucacaucuuuccccaguuucuugaacuucuugccucugaaauggcaugugugugccaggcgucuuguuccucuuguuacuguuauuuaagcuguuuuaaaaaaacgacuuucgcgguuuuccccucaguuuuucagucuuuauuuccucccccacccuacguuuuuauuguuuuuuucaacggaauacauuauuuaucuggucucuuuauaacgcuguugagaauuagcauuucaguugguguucugucagauuucaccuuggacuuagcaguugagggaaacugagucaguuucuaugcugcaggggcuaggauuuagaauucucaagcuuugaacagguuucagugggggaacgaauagugcuuaauccuauucaguuucccuuugcaggcucauugcugugagaaaucacuggguggcuguugcagccacugaugggggcugcauugcaaugcaaucuugaauugugauaagggccaacuggcuccauccguuaggcugugaguuugacacaacuuuugaagagcuaugcugugucaccugucagagcucgaguggucauucuuuuaauucaauuuaagaaccaccaucaaacuucagauaucuauucuuuggagguuauuggagaacuguacaagugguaauggcuuggaacaaugguguggauuuagcgcuaauuuaauccuauccugucuuccucacuucuugggcagaauucccacugaagucaguaguggucuugugugcagacagacugccgagaacaagaggcugcucauuuagaguaacgggaagggacgguuucuuuccuuuuaaaacaucccucuguaagaaagacuuagucauaacaguucuuuaaucuuuaaccacuaguccaaguaguugagagcacuuuuugcaaaaaccuucgaaagaaaauucguggaugaauugagccacgucccucgaacucuucauauaucuacguugcauggugauccuuaaaaaagauuaaaagugauuuuaaaaaaucaguuaaagcuauaauuucaguaaaauuuuuccuaacuuuuguaaaaaauguaaacugccagggagcauuuuguagcaacuaaguguguauauuucaaaucugaaauuuaaguccaaguagaaagaagcaaauuuaauuuaggggaugaaucugaagagaggccaccaaaaaaauaaccaucuaaauauaaaagaaggaaguucagauaucucuugcuguuuuucaggagauagcuuuagggcaguuugcucacuuucauaccuguucuuaacgauuuacugacugccuggguccaucauuagauaaugcuagcacuuggagguuuccaaaugaguuuugugcugaucugaguugcugagcuaguuagauccuuggcuucuuaacguaacauucuuguggcuuacccuuuccaaauuacuaguucuaaggaauugaguuuagaaaaccuaaccagugaccagaauguaaaaauagguauuuaaaaaucagaaccauguccacguguacuacccaaccacuugcuuucaacuaaaaauacuugcaaagaugacaaagcaguccacaaccaaaauauuuauugguacaauuucucuguaauuaguaauauuguacaguuauguuuaacaucagguucugcccugaaucaccccucucauauuacuguggcuggugaacuacaaagguuguaucuuugccauuucauuuaggaauauaggguuuauauuuuauauagcagaaugcuaaauauuuuugaagguuuuguuuuguuucuguuucuacucugucucuacuaaaaauacaaaaauuagccgggcaugguggcgcacgccuguaaucccagcugaagacaugggccuuuuucuuucuuuuuugaacugaaguagccuguuuaaaagcuaugugugggcuuuuuauugaaaagugugaauugcuacuaguuuuauaaggcaaauaaacaguuuauagggaucaauaccacugagucacauuuugcauuucuaaaaucugugcuguuuacuuggagaaaacaaaagaaaugugccuaccuccuccaucccaccuuuauuuagaaacauuuccagugggcuuguuuuuuucagauucagaauuacuguaccuaaccacuggguacccuuacagauuucaaagccugaaguaaauguuuaugcuggcuuucguagucagcaaauaauagccaaacccuaauucacugcucuuuuauagaaucuuggaaucucagggcugaaccguuaggagucagcagauccacucuuagcccuagucucuuccucucaacaugcaaacaguucuaaugucuuuggaaugucugagcaaauagaagauuuguaugcgauucugucaccaauucuagacagaacauccuuugggaugccauguuuuggcauaaaccagcaacuugauauuaugagauuuguaucauuucucugcgugggcagugcccuagacuaaaaucuaaaauggagucaaugccugaugucauuaacuauagggaaauggccuccaaguuagcuauuagaguuguuuaggaauuauagcugggcgcgauggcucacgccuguaaucccaccucuuugggaggcugaggcggguggaucaugaggucaggagaucgagaccauccuggcuaacacggugaaaccccgucucuacuaaaaauacagaaaauuagccaggcgugguggcaggcaucuguagucccagcuacucgggaggcugaggcaggagaauggcgugaacccgggaggcagagcuugcugugagcggagauugcgccacugcacgccagccugggugacagagccagacuccaucucaaaaaaaaaaaaaaaaaaguuauagguaagccaagaaggaaagaaauaaauaaucucaguuaucaucuagaaaugauuuauaguuuuuguugcuguuguuguuuuuauuuuguuuuugagacacaguuucacucugucguucaggcuggagugcagugacgugaucuuggcucacugcaaccuccgucuucccaguucaaguaauucucgugcuucagccuuccaaguagcuggaauuacaggcgugugccaccaugcccggcuaauuuuuguauuuuuaguagagacaggguuucaccauguugaccaggcuguucuugaacuccugaccucaagugauccacccgacuuggccucccaaaguguugggauuacaggugugagccaccgcacccagccgguuuauaguuauagcuaauagauuuugguagcuuuuucuauaaaguauguguauguguguguauuucauaugagagagggaauauuauagguauuugugaugugaagcaccuacucauuguauuuaauaaauauuugaugaauuaauucauugaaccuuuaauauauuagaggugaagaaucuuuagugaagauucuuugauagaguugacauagaaauggguaauguuucauguagaaauaucaugucgguaauguuuauuugcuuuucuaaccacugauauuguuucuccugguuuugugguuggcuugggaucuguguuguaaguuucuuagaggcauguuuuucaugucuaggagaguagauaggcuauauauuuccaugguguugggauaguauuaauuuuaauuagaauuucagaggcuuucugaauuuucuuauuuuaaagugaugucucuuacuucuuggcauuggaauagauuucaugugaucuaugagugcauucauacugcuucuggauauuuuuucuucaaagauugcaauugagcuaauuucauauucucaguuaucuuuaaaauggaaacauguuuucacuucacagauaccucucugaauuuugcauauuuucacucuaccuuauuagagccauaaagucaaaaaguacauagauugucucccaaauaaucuggaauaaauugaaggauaagaacaaucuuuccugagaucugaccuguaucuuaaauaagguuuugcuuuagauagccaaguugaaauuuugcauagauaacuaaguucggcaucauggggaucauuuuaguucuuuccagguuaggaggcauggaaaggcucccaaagugguuuugucacuguucaucuaucggaccuuauugccuaggucagguaggguaguucaugcauuuaaaucaaaucuuucugaagagaccaguuuccucuugcuuugcucuuagggccucaccaucaaccuucaugaaagaauuuucaaauacuuaaaaacuuauguuacccuucaguugccuuuuuccaggauaauugugguuuuaaaaagcuugucauauaguucugauuaccaacucugaagucaccuuuuccaagcccuuguauuuacguuuccagaccugcugaugagcuucagggcugggccauuauaacaacagugcugaauucacucauauuuuucagaguuuccuacauucuacugauauauguacauaucccaguagcuugaagacauaaaauuaaaaugugauuuacacucugccauaauucuuuguuucuuucucuuuuuguccagaagcuacuuguuuuucacccuagauucauuuaccuugagggagauuauuugguucagacuccugaccugggguggagagugggguucuugggccucaugggugcauaaacugccugagacuguaagugagguauuguguucccaugugcaugcacuccugugugugugcagcaucucugugugugugugcacaaguggaugagagagacagguuaagggagaaagagaacuuuaggagugguuuuugaaaggguuuugggaaacagaaaagauugagaacugauguuucaguucuuauuuucgagauuagaagauggaaguuuuaagaguauuuuguuuuucucuuuuuuuuuaauuuuuucacccuauugcacuuuucaucauuuauucuccccuaucucccauuguacuucuuuccauucaauugaauucauuuaguugacccccauuuaccuaacugucaagguuaaacugaauucugauauaauccuggccacucauauucuuaccugugaacuuaaugaaugugcauuuauuuccuuacaaauuucuuugauggaauauugauuagaaggaaucaguaacauguccacucuauuugaugcugguuagacugccacauaugccauugugaccuugggcaaauuauuucucaaagccucguuugcuguaguaagggguuaaaaaucauaccuaccucagaguuacaugaggauuaaaugaacuaaugcuuauaaaaugcuucauagagugccuggcaucuguaaaaauuguuagguuaagaagagaccuaguggguugguuacuggugaauaugugguaagcagauuuuuugcaguggucaggaauaauuaucuguguggaaguacagucuuugaaaugaaacaguaauuuccuauggugaucacaaguuaaaaccacuuuuuaacaauuucaguccaguaucuauaauguuugagcuuuuagaaacucuugucuuaacuucauucuuuuuguuaauuuacaaaagagcauauauaugggaaaacaguugggaucuaguuucaacagcacagggauaauguagucuuuuuuguuauguugccagagguaacugauuauaaauguaaaauugugugcauauguucuaacuucuucucucuauaaccacaguaaacuuguugaaaaaagccuauuagugaguagaauuuuuguugacaauguuuaaaccucugcauauggcauuaaaauguaaccuuuauaaaucuuugugugaaauauaccugcacacauauuuuccagcaacaucguguuuuaacuuguuaguugccaacauuaagaaaucagguuucauauaaauauccuuauuuuaggcuagaaaaauuagaugaugguguagcacuugguccacuggguccacugggucuauugugucuauugcuucuggugcugucacgcaucagcugcuuugcuuaaccugucccugacgcacgcauuuuaugcucaguucuagcuuuguucuagguuccauuguaaguaauccuguaaggccugaagcuuugauaaucaauaaccauguaaaaaaaaaauaaggaagcuaaugguuuugcagcacagacuacacaccaggugcuauaauugguacuuuacauauguuaauaacccugcuucuuuuuugcagcaccaucuuggaguagcuggugugcuuauuuuacggaugagaaacugaggcuuaaaaauugaauaaauggcucaagggcacccagcuuguguauggcuaaaacccuuguuuuuucugugaguuccaguuauugcuuuuaauuguucgauguuauuacucaguagaaguugaaguuuuuugcaauuuguuggcaucugcaguaucuaacuuuuauaaaagacaggauugcuuuccugacuggguucgcccauguaguuuuuuguguaaagguaugauuaugaagcagaccugaguacuacuuuuaguugugugauucuugaaucaugcuggaacagggaguacccuucaucuuguuuuucagacuagagacauuuaaaguaauguuucuagccugauuuuucaauauuagaaaaauauaccagaggauaaaacacaucagaauaaaauguggcucucccccgaccuuuaguuucugccuuuccugugguuuugcacuuuuugcuuucauuuaaagugcaaauggcauucuccagggugcuuuauaugauuuagaaagucagguaguacugcagggauuaugaaaaaaagcagcagaccagugcccuagcucccuucuugacagauuucugcuccccugaggcaacuacuuguuggaggccaaaagaaugagggucaugaucaacucaguauaccacuggagguuauaugaguaagcagcaaacuguuuuucauaaaugcagaauguuggcaaacugacagacugcguaugccacccagaaggaaugcugaaggcagucaugcccaaagcacaguguuucuugugauuagguacaucugaagccuguuaguaacaauaugaaccugugaucaauuaagcagcugaccaauccuuaccuccuucucccugcucuuguuacccaauaaauaugaagggcuguggaagcucaggggcugccuuugcucacuagaagcagggagcucuuuucuucuuccccuggcccuuccuuuaaaacaguuccuuuuguuuuuuuguuauuuccauguuugucccuuccuucagucucguaaugacggucucaaguaguaacaguaguaacuguuguagugaaggucucaaguaguaacuguggcaaugugccacaaguggcgcccgaacagggacuaucagugacaaacagagaccugaagagaccugaagggaccugaggaggccuacagggacacauagagauaaguagggauaaauagagauagagacagauagggaaagauagggacuugcaccaacuuggaggaacuaacagggaccguagagacagacagggacagacagggauagauaaagacuagcaaauacuagcagagacuagcaaagacuagcagagaccagcagaagcuagcagaaacuugcagggacagacagggacagauagagacaggguccuauagggacuugaaugaggaaguucugcuggaacagaaaaaacuaaaaccaaccagacaaaugagaaaccccguuacaagucugcuugacaacauaaggagaugaacaaacugugugggugcccucaaggugugugcgaccauggaauggaagacuggagagauccauggauucuagcuacaggccuuguuccccuaauacgagccaugagccaguugaaucugaaugcgaagauggaaugaggaccgaccggagucacacugacaucaacccucaugacauggggauagaucaagaaaaccacacaggaagcugagacacuguuagugucagggucaggcaaagaccccugacuccauguuuguggccaugcuggccaugguuuccugugccucccguuguaagaucagcuggaccaccaacuggcaauuaagggcugcacagccuguaguugccuuucucaauuaauuaaaaaacaaaaagggagaaacguuggaggucgaaagaaugaggguuaugaucaacucaguauaccacuggaggcuauaugaguaagcaacaaaauguuucucauaaauguagaauguuggcaaacugacaaacuguguaugccacccagaaggaaugcugaaggcagucacgccccaagugcaguguuucuugugauuagguacaucugaagccuguuaguaacaauaugaaccugcgaucaguuaagcagcugaccaguugcuaccuccuccucccuguucuuguuacccaauaaauacgaagggcuguggagcucaggggggcugccuuugcugacuagaagcagggagcuuuucuuccccuggccuuuccuuuaaaacaguuucuuuuuuuuuuuuuuuuuuuuuuuuuaucauuuccauguucgucccuucgucccgucuccuaaugagggucucaaguaguaacaguaguaacuguuguagugauggucucaaguaguaaccgugacagucugccacaacuacuuucacuaguuuugguuuuauuuucugguguuuugucucuaaauaacaugauuuucuuguuucuugauuuuuuuuuuaaaguuucagaauauuuuuauguuuuauuauuuguuaaaauuuacuugcugggcacggugauucaugccuguaaucccagcacuuugggaggccgaggcgggcagaucaccugaggucaggaguuugagaccagccuagccaacauggugaaaccccaucucuacuaaaaauacaaaauuagccaggcgugguggugcaugccuguaaucccagcugcucaggaggcggagacaaggagaaucgcuugaacccaggagguggaaguuucagugagccaagaucgcaccauagcacuccagccugggcaacaagagcgaaacuccucaaaaaaaaaaauuuauauuuuuguguguagauaguuguucaaauugauguuucuguagggggugagguuagcagggcgaguggggcagagaagcacuagaaaagccuauucugccaccuugcugaggucugcuuacuccuguuucuugauuuuuacauuuuaaauguaauaccuguuugacuuucuaccucuaguuagcuuccuuacuaacucccucuucccauuuucuccucucuuccaauuuccaacuuauauauacaaaagcuaagucauguaaagugcuuugauuacauguacuuucuuuuacaacuuuauguuuuauccugaaguuauccugauccuuauccuuuuccuuauucguuuucuuugcacccauccuugguucagcuuuaaacuauguuagaaacugugaaauucuugccaguaggaucaaacaugauauaaucuuuugguuccguuuucuuuuuuuguuaaagcuauccuuccuggcugggcccuccaucauccuggacugguuuuauuucuagaauugcuauauaacugugugcagggaauuccuucgccucuuuuucugggcucuauauuucuaucuugguucauugacaaaaaguuaggaguuuauccaugaacuuguaaccagaacuguuuuuggaucuuggccauuaaaaucaacaucaguggcugggugcaguggcucaugccuguaaucuuagcacuucgggaggcugaggcaguuggauugccugaggucaggaguuugagaccagccuggccaacauggcaaaaccccaucuguacuaaaaauauaaaaaucagcugggugugguggugggcgccuguagucccagcuacuuggcaggcugaggcaggagaauugcuugaacccaggagguggagguugcagugagccgagaucaugccacugcacuccagccugggugacagaguaagacuccgucucaaaaaaaaaaagaaaaaaaaaaucaacacagcacaggcuacauccuaauuuccuuaaugaagacuucuaguauuugcccaaaaaaguguaaauggcaggugaguuucuugaggcuugcaugucuuaaaaugucuuucuccacucucaguuugguugcucuuauaguuugguuguauauagaauucuguuagugauuaccuucccuucaaauuuugaaggcaucuuuugaagccauuugaaggaugcucuuucucucaccucaguccucaaagauaucuggaaccuccaauucuucaggcucucagggcuuuuccaacaaucaacuuguuucucguaggccccccaccaaaacaguaacaguuuucugcuuccucugcucugcuaagucaguuacuuuguacaucugcuuuccaucuucuaaaauuuuguugacauaucugcuggccugaccccucccauuguugcuguuguguguguguguguguguguuuuuuuuuuuuuugcuuuacuuuugugaauuuguuccuuguaagaaaacuuuucucacuucauuuuagugugguugugggaggaaacagaaauuagcucauguuaaauauauuggauuuuggaauuuaaauugauuaaaaacaaaauuccacaagauugccacgguacucacauuugguaaggacugcagccauaauaaaauuauacuuguuuccccaugccagcugcuggguugaacuucauuuauauagagggagguagaaaagucaggugauugagugaacaucuagggugccugggaguggaugacugauauguuauuggucaagaagcuacuuccuaggaaaaguucaguaaauguauuauauuuuuuuccuguggucuuucaaggaguucauuauaaacucuuagaaauauuauauacuugaacuagacuuaacaauacauacucaccaaauuuguuuuuguuauguaucagaggugacagcauuaguuuagauuuauugaguaucuugguuugucugucuuuagacagacauauuguugucacacauauacuugaauauucuuuggaccaggcacgauggcucaugccuguaaucccagcacuuugggaggccaaggcggacagaucauuuaagcucaggaauucaagaccagccugggcaacauggggaaaccccaucucuauuaaauaaauaaaagaauauuguuugaauaugauuuggggauuagaguaaguuuugaacauaugcagguucuguuaaauauuguaagggugaaaauuucauuacuaggugggacauaauuagggauuuacauuaaugugaagguauggauguuagggauuuucgaguguggguuuuagggaugguaaaacaaaaaggaagguucugaauauuguagugagucaguagugacugugaggucugaggaaaugacaggaugaucuaaugccuguuaugugaucaguguuaguuaaguugguugcccaguggguuuuagagauuuagacauucaaaucuauuaugcauuaauauagaagauguugcagggaauaaauaaggaaaguauuuccccagaguauguugguauacuaaaugauuugagucuuucauuuuuuuuuggagacagagucucgcucuguugcccaggcuggggugcaauggcgcaaucuuggcucacugcaaccucugccucccggguucaagcgauuuuccugccuuagccuccugaguagcugagauuacaggugcccgccaccacgcccagcuaauuuuuguguuuuuaguagagaugggguuuugccauguuggccaggcuggucucaaacuccugaccucaggugaucugcccuccuugaccucccaaagugcugggauuacaggugugagccaccgcacccgguccccauuugauuuuuaaaacaauuuuguaccacgggucugacaaguaagaagagcgaagaguuuaaacuuaaccaaaguccuggagcaguuacuaauggagcuucaggcacagccaaggucucuuguguccagaguuguucccucuauacugugcacuuuugccaguugaaguuuucuuggaaaacucaggaagucugccaaguuuuguagcuaaagagauguccuguagcuuuuauauauuugugucuugagcccugaagguagacagagcucagucuuccaaaaauaguucaauaaaugugucaacauuuugaaauacuacugaaaaaacaaguaaaaguccuaugggauuauuggaaaaugaugccaaaugccuccacaaguauuugaaaagcaaauguggcagugguuauacgcuagacaaugguucauauucagccuucgcuuuuggggaccauuuuuauuaugauaaucuuuuacuguuucccaguacucuguuuaguugcuucuagacucugguagaaaagcuacuaagugucuacacucugguagaaaagcuacuaaaugaacaucuucuuuggaaaauuuucuuuaauccacuucucuuaaagagaaaaaggaaaacuuuuuuuccuuaauaaagugggugaaaguuguguaugggaaaggucagaaugucaaguacugaguugggucuguccacugcaaagaaaucaaauuuauccaugaacuuguaacuagaacuguuucuggaucuuggccauugaaaucaacaucaguaaagccuacaucuuaauuuccuuaaugccaagauugucuguuuuaaauuauacacauaugggaaugugaauacauucgucuucccccaccucccucugcccgaaaacaggaggaaaauaaagguacguugaagauauucuaaacuuuugcagcucugcaaugaagagcuguggaugugggcugcauauguggugcagauguggcuccuaccaauugaggucauuuuaccuucaucuucagugcugcaagcuuaaaucgaaagaggguagauucuagaauagucuauagaucuaugauuuauguguuacuugcucuguguagaacacauaauagcagugaaggauaauguggcauuuuuuuaaggacuuuuuuuuuucugguuagguuuuuuaaagccauguuugguuagguuuuuuuaaagccauguaguaucugauuaucgaaguguuuuuggaagaaagaauguaccauuaucaguuacagaaaaguguucuucuuuuuuaaacuuuuuacuauggaaaauuuucaauauauucagaaguagagaauaguaguauaaugaaccucgcguauccucgccuggcuucaacaguuaccagucacaugaccagucuuguuucaucuguauuucccuuugacucccugacccacucucaucuuuauuuugaagcaaacuccagacaucauauaauuuuauuugugaauaagugagauuccccugcuccccuuuucuuggcauguacuucuuggucucccaaauaaagcucauauuuauuacggauuuuguggaauaacagaaaauagaucauuugugacauacuguugugauguuuuuggaauaaauaucugaauauuguuuuagucaguaaaagcaguuucaccuaaauguagcauuguggacauagagaaugcuuuaaccagugcuaaaaacaaggaacauaaaacaaaaaauacaacaaaaaccccaacaauuucuaaaccaaaucugaacugauauucaaauucuaguauguucucaagguaauguuaaaguugauguuguauaauuuuuuuuccuaugaauccugcuuauguuuauguuagauuuuauuguuuuuagauuuuucuuuucuuuuuuucuuuuuuuuuuuuuuuuuuugagacagagucuugcucugucgcccaggccugagguacaguggcgcgaucucggcucacugcaaccucugccccacagauucaagcaguucucugccucagccuccugaguagcugggauuacauguacccgccacuaugccuggcuuauuuuuguauuuuuaguagagacaggguuucaccaucuuggccaggcugauuuugaacuccugaccucgugauccaccugccuuggccucccaagugcugggauuacaggcaugagccaccgcgcccagccgauuuuucuuuuuucuuuucuuccucccacccugccuucuuucuucccuucuuuugccuaacguaguuuagaggcaauauguuggaacuagaccaagcaaaauauucuuuuuuagcugacugaauuuuaaugggacuauacaguuauaaaaaucaaagcaaccuguuuguauaugguucugucuggcaguaucgaggggaagguacaugccuuaaacauugaugauacacuaauuuagaaaucguuguguaaauuguuggcauuauagcuguagcugacaaucacuuaauggucgaagugcuuuuccuaaauaacaggcaggauuuuuauguuggagauaguuuauuuuauauauuaauuuguacuuucaauuaagauguaauuauuuaauauaauuuccuugcaaagacauugaauuauaaaauauugauaacaauaagcaccauguuuugaguacuuaauauaugucagacacuguucuauaggcacuuuuauuuuuaaauauuuuuuuuagagauggggucuugcuguguugucugggccggaguacacuggguacucacagaugugaucauugcauacuacagccuugaacuccugggcucaagugauccuucugucucaguuuccugaguaccugggacuagaggugugugccaccaugcugguuaucuauaagcacuuuuacauuuauuuauuuauuuaauucuuguaguaacucuuugugguagguacuauuauccuaaguauccuauaagaaaacugaggcacugcaguuugaaguaacuugcucagggucacucagccaauuaaugguggagcagcgguuugaacccaggcugucuaguuccagagccuauagccauaacuacugucuuauauuaucccuaagaauauguaaacgacgucaaaccccgauccuauuugcauuccccuccccacggguaacuaucuugaaucagagccaauacuacacuauugcauuaggguauaauuuaaucauuaggggauaguuuucaugcagaaacuagaaagcacugaugagauucuacucauguuccuuuaccagcuuuaguuauaaaggggaagcgggaaaauggaagcacguagaggauaaggugauaaccuccaccuuaccaucuuccuucuucccccuuaaaaaagaaauggaauguugagucuaucuggaauguugacagguuaaaaaggagcuguugaagccugucguucacaguagcaucgaaaggugaaaauuugucuccacuugaguaccuugaaauggcagguguguuauuggaauauugggcuauuguuggucaguacugcugaguauagacuuuuguagguguuuauccugaaucuguagugaccggaauuucaacaaaugagguauuuaauacuguuuuuucccuuuuguuucugaaaggagcagaggauagaaagacaauuguucuagccucaagucccaguacacucauuaguuaagugugacgguggucaagugauguugcuuugugugucuguuuucucuuaggugguucagguacccugaaauaaauccuaacuuauaugucuguugcucauucaucucuguguguggagaaagugauuuaaaguguccuuucuuuaagaaggaaagagccagggcauaguggcucguaucuguaauccuagcacuuugggaggcugaggcaggaggauugcuucagucaggagguugagacuggccugggcaacauagugaaaccaugucucuacuaaaaaaaaaaaaaaaaaaaaaauuagcuucggagacugaggcgggaggaucccuugaacuccagagauggaggcuacagugagcuaugaucuugccacugcacuccagccuuggugacagagucacacacuaucucaaaaaaaaaaaaaaaagagagaaagaaaaauauaggcguagaucuuggcaaaacauuugauaaaguuuucaugguaucuuuauaucuuuauaaacaacuuuggaaaaaaucucuugugguuuuuguuacugaaauuuuaaccuuggucaucuccuaugcaagauauuuuugccagugauuuuuaaugguaacaaacaaggauugcuuaucagauauacagauuucacagaaguuuauagggaaaccgaguaagcuguuccuagauugucuuauuagcuacaaaaugggcugaaauaaauaacaugaaauuuguugggaugucauugaaagucuuugagucucuccugacauguuuuggcucuuuguucuccuuuuccuucuguucuuugcagacuucuuuuccucugacuauccuuucaauuuuccuguuucccaggguucuguccuuagccuuugauucguagcccuaauuuuuaucacccaagacuuuaccuauuuuaaucuguuaacucauaucucucuccaggcuaagucuuucucuugaguucugcauuucagugacuuagaagaaucucugccagcaucucaucauuuuuaaaugaauauuuaaauauuaaauauucauauuaaaugaauauuuaaauaugaaauauuuuguguaaaaugugggcuguaauggauuauuuugcauugacuuagaauauuuagauaccucauuuuaagggguacauaguaugcacuaauagauauuuguucaauaaagacgaguggaaaccauguccaugaaggguuacugggauguugagaugaggagaaacuauagcaccugaagaacuagccguagaaauaacugaagggauaaaacuuacuggggggcaacuuguugagagcugguguuugagcacugccuuucugauuuuguuuuugacaaaaucugcuggaagaaauauauuuuacaucuugacccuuuauucaguauggauguguguauauguauauauauguaugaauaacagaaacaaguuucacaaauuaguucuuaaccuuacuguguauugugcucugagauuuucuuuucuacuuaauaauaauaaaauuccagucaauaguccacaaacuuaauuucacaacucaccaguggacugucacugcaacuugaaaaauucuuuuuccauggauaaaacuaagaaauuuggagaagggaaguuuucugccugguagcagaggaacuuuuuaacaguuggagaaggcugaugauggaauggggcugccuuggaauggagugcuuucccaaggcuugaaggacccaggcaacaggcuguuggaaggugggaggaagauucacugggugggagauggagcuuugugaccaccgggguaucuuccaagcuaaagauuuuaugauucccauuuuaugacuugcugaaauuuuaagaugauuaaaguuauuugaagaugaaaaagauucugaauuuuguuuaccacgauucuacuuuuuugucaaaaaugucucaauuguuuuagaaauuaauuuuuaaauuaaaaaguuuuaagaauuuuguaugcuaacuguauuuccauuauuaacuuacuuccauuuccauuauuucaauuuuuuuuuaaacaaaaaagcauuauuggcugggugcuguggcucaugccugugaucccagcgcuuugggaggcugaugccagaggaucacuucggcccaggaguuugagaccagccggggcaacauggugaaacuccaucucuacaaaaaauacaaaguaaacuuaguuaggcauggugaccagugccuguggucccagcuacuugggaggcuaaggugggagaaucuccugagcucaggaggucaaggcugcagugaguggugauuucacuacugcacuccaaccuggacagcagagugagacccugucucaaaaaaaaaaaaaaaaaaaagcauuauuuagaaaguuuuaaauauauacaaaacuaaacugaauagcauauugauuccccguuccuuucccaccauucagcuuuaacaucugucagcucauggcuggcuuucuuuuaucugucucucuauucacuucacuucuuacuauauuauuuggaagcaauucccaggcaugucaucauuccaucuacauauacuucacuacguaucuauaaaagaugagacucuuuagaauaccauuauaauaacuaaauaaauuaacagcaaauccuuaaugucaucacauauucacuguguucagauuuccauuugucuuuguuucuuucauagucucuuauuugaaucaggauccaaguuagguacauacauugcgauugugauaggucucuucaaaucucuuuaaucuauugguucugucccuuucuuucuuuuauauuuccuugcaauuuuuguuguuguugaagaaauuggguuguccuauauccuuccugcaauuucuguuuuucugauuccaucccuauguaguuuaaccugugccuucauccuaugaauugguaguacaugcagaggcuuuucaucaucuucugguucaguuuuuuuuguuguuguuaauacuucauugguuuuguuauuucuuaaaaccacucaaagaguauaccuaaauacuaaauguaaggauguuuggauuuauuuauuuauuuauuuaucuuuauuuuuuaagacagagucuuacucugucacccaggcuggagugcagcggcgagauuuuggcucacugcaaccucugcaucccggguucaagcgauucugcugccucagccuccuaaguagcuggaauuacaggagugugccacuacacccagcuaauuuuuuuguauucuuaguagagacaggguuuugccauguuuaccaggcuggucuugaacuccugaccucaaguaaucugccugccucggccucucaaacuguugggauuacaggccugagccaccuugcccagccucggauuucuuacuugguucuucauuuuuaaaaucagccuaagccaaauuccccauaaaaacagauggaaccacuuagaaauuugggaagauaauaauccucugcaaacaccacauccaaauacagauuacacaagaauuucuacuccagcuucauuuccaaaaaagaaagggagaaagcagcugucuuaguaauuuccauguaccacaaaccagguuuuccguucaagugagacauuuuacaguaaaaucagucuugauuuuucuagcacaaugauggaaacuuuuugguuuugcuaguuagauuucuuacccaguaagcaaguauccuuagugacucuuuuuuucccccucuucuuccuugacaguuagaaguagaaggauaaaagugagaagaugugaaaucagaaagcaaccaauuuaugugggaaauuaaauaaauguguucuauagugauccuuugaaggauuuuguaaucauuuguuuuuacuacuuauuguggaaauuuuucuauguauaaauaaagagggcagaauaauaccauccauuuccucaccaccuuguuuuuccccuaauguuuagugcauuaagagauggggaugaagucacacugcuauucacuggaaucuucuuuauuauuucauuuguuguaucaggcuuguaguguagguuuuacaucuuuuucuuucuuuuguuaaugcuaguaaaucuuuugcuaguuuuuauuuuaaggucuuuuggcugguacucauuuugcuagguauuagaugaagauucuaugaugaggugaagaugcugggauuaggggucauucccugcauucuuacugaguuucuuuuuaaaaaaauacuuuuuauaauggagguguaugcaaacauagaguagaauaaugaauccccacguacccgccuuccaacuaauuacucccauauggccaguuuucaucuguggaccuuccaaacccauguuccccauuccaugcuggauugucuuaaagcacaguuuaucacuucauucacucuuuuuaaaauaggucugugaugaguaagcauuaaacaaaaugaaaaccacaauacuguuguuacaucuaaaaaacuuacuuucuuaaauuaucaaauauucaauguguguucauauuuauccaguuguuucauaaaugcuucuauaguuaaaguuagaauccagauaagaucuauauuauguuugguuuauaugucucuugaacacaguaucuuaauauguacuuuguuucucuucuuuuucuuucaguuuauuuguugaaacuguguuguuuuuucuauauucaauugauuuguugaaacucuauuguuugcucuauagaguuucccacauucuggaauuuguugauugcaucccugccuguggugcuguuuaguauguuucucccuucugaauuuccuauaaauugguaguagaucuggggcuuacucagauucaagauuaauugggaguuaggaguauagaauccuuccuaguuaucaguguauauuucuuacugcuuccuaucaagugauacaauauaggauuaguuuucuuuuuggcaugaagauugaucagugagcucagguguuucuagcuggacugauccauccaucagucugaugggaaaagcuugauuucccauuaagcuuuuuugccuaaugguuuuuaacagccaucggugauuauugccuagauacauuauuuccuuacauuaacuuuuucccauauguuuuuuccugaaguaauuuaaauuaugaaacaucacauuucagcccuaacuuuuuuguuauguauuuguaaaaaacauggacaguuucccguuuaaccagcacacuauuauaucaguugacaguaguucucuaauauuuucuaauaucugugcuauguuaaagucucuccagucauucccgugaugucuuguauaguguguuuggcaaacugggauccugccaaggauugcauuuaauuaugguuaugucacuuaagucacuuacaaucuaaaauaguucuucuccuuccuuuuucauucccuuuucaugacggugaacuguuggagagaugcaagauguuacaggucuuggagaaucuuuguuuuucuugguuggcuuaauuguuucuaugugaggguauuuaauucauucgucuaaacucuguauuuucuguaaguagaauuuagaucuaaauucuugauuagauucagaacaaacauuuuugguaaggguauuuucauagccaauuuuguaugguuuacauugcuucauaucaggcaccacauaaugcaguuaucucacuauuagugaagcuaagauugaguaaggugaugacagaucucccuguuguaaaauuauaguuuucccuuugauacuggcauauaaucugggaggagugagauguugguaccauacaaauaguuaguuccuugacgucuuugacauaauaguguuaguauccauuggugauuuuaccugaaucaguuaucucuuugggaauagcaaaauggugauaaaaugggauuuuuaaagaauugugguaaaauacacauaccuaaaauuaaccauuuuagccuuuuuuauguggagacagagucucguucuguugcccaggcuggagugcaguggcgcaaucccggcucacugcaaccucugccuucugguuucaagcgauucucaugccucagccucccaagcagcugggauuacaggugcgcaccuccacgccugacuaauucauuguauuuuuaguagagaugggguuucgccauguuggccaggcuggucucgaaucccuggccucaggugaucugccugccuuggccacccaaagugcuggaauugcaggugugagccacugcacccggccaccaucuuggccauuuuuaaguauauaguuuaguagggguaaacccauucacauuguugugcaaccagucucuagaacucuugcaacguuaacacucuauacccuaaaauggaauuuuuaaguuuuauuauuucuucaauuucauuagguugcaauuuucugagcaaaauagcuuucccucauuaaugugggcuauuugauuacugugaaauacagccuuuuauuugaaaugcaggauaaauacuuaauuuuccccuuuaucaaauuucagaauaagcucuugguauaauaguuaccucaaguuuuuuuuuuuugguuguguuucucuuuuugaguaucauuuuugacuuaaggauuuuuauauauucaguguuucagucaauuacaggcauucuuuuugauguucagauugucccaacuuuggccauccucuucaaacuggcuccuguauccuuuugacacaaccuugucaggccuuggaagcaaggaguauguuuauuuaaaggcaauaauauuucuuuuggggaauaacaucaaaucuccauugaccguggcacagaaagcauuuacauuauaggaaagugcuacagagcacggugaaaccuugauacugaggcccuaauucagcaaauggaaaaacaggguaaaguuagaugaucucuaaggccucuggucugugaucuuuuacuaccuauaaaacuguuucgcuauuugguuauuuuuggaacaaaauauuucaaggguuugcguguuguuaaauuuuguguuaaacagcaucuucauuacuuucuuccuauucugauaguuuccugggccauggauuaaaggauuggaaauuuggaaauguaggaguucccacguauuuuacaguuacaaaguccauacccagaggaagugagaagggguuugcguccuaaccuuugccuuuuauuccaacauaacauagcuaaacauucuguugagagaaggucaaccuuguaaugcuggaucaauaagcugcugucuuguuuccugcagacagcuuuauuuccucugguuuggguaaacagaugagguuucaucgagaguuuaaauguauaacugaauuugugaagaaccguuuucuaauggaauaacauaauacuuauaucauguuucuaagccucugggaagucacugucugacacuuaaaaaaaaauguugguuuuguaaauugacuuuucuuuucuuaauguagaguuuaauguggaaaauggucacucuuuucaguuuuguaaguuuuuuccccagaauaaauguggcucaguuuuauccuuaugcucccaguagucacuaucaugacucuuuuguuaggcauuaaauacgaauugccaguuugaaauacuuugaacacuuacugaauguugggcagcaguacaaauaauacagcugcauaccauauuaauaaaaacaaaaugcugugccuugaaaaaccauuucuucucuaagaaugaaagaaguauuauggaauucuguguuuauuuaccagugacuuacauuuuggaguaaauaaaagguuauacuguauuuuaguuaaaaguauuccuuuucaguguuaggaggcaugguugauuugugaaauaacuuuacaagauuauuuuuauaacuauaaguagaccauuacuuauuuuuaaagaaccagcauuuaaaaaaugugugaaauugcuuuaacugugaauacuguuauaucuaguaaauaaaguuauucuaugaauuuuccagauggugauagcaacuagaauaauuugauucaucauuucugucucauucaugauauuaaugaauugugaauaaguacaauuaaaaucugcacuggauugucccauauaagacucuacaggcuugguguuucuuaaaugagaaauaucaguauauauuuuuagagaaguaguuauuuucugcaucacuguaugaaggauuuaaggcauugaauagggaauaacuaugauaaauugcuuaaaauuuuauuauauugcuuaaauugcuuauauuucuuuuuuauuuugaagguaccuggccuucaaaacaaaucaagcugaaauacauuaaaaauaaaaagaaauauaaaaaugaagauccacauacguguuuauugauacuguuuauguguauuuuuguauguauauacacaagaaacauuuuuaaaggacauaaugcuugauaaaucucucuuuucugaaaugucuacuguaaauuuuugcagauuuuuuccaccuugaauauaauccuuaaauguuuuagguuuuuagggcugggugcgauggcucaugccuguaauccuagcaguuuuggaggcugagcugugcaaaucacuugagcucaagaguuugagaccagcuuggccaagauggugaaacccugucacuacaaaaaugagaaaaacuagucaggcguggugacgcaugccuguugucccagcuacucuggaggcugaggcaggagaaucgcuugagcccaggaaguggagguugcagugagccaagguugcaccagugcacaccagccugugcaacagagugagacuucaucuuaaaaaaaaaaaaaaaaaaaaauuuuagguuuucaaaguauaaagaugaauaacauuuuugaaaaaaaaauuaccauaauuauagcugagacuaauuuuuucaguuuuauuuucuuaaagcauuuuauaagcauuuauaugcuuuagagccacuuuuuuucaaacccugggcccuguguaagugagucauaucaucuaaggcacagcucauaugucagcuuuucuaagucuuuucuaacucccacaaguagcguuaauaccucugucuuuuguggcacuuaccagguuggauuuugaaauccuuaaaaugucaguuuucuccgcuuauauaaauuuuuccagggcagcagcccuaauuuauucauguauucccaaugaucggcauauacuaagcuuagcguucuguagaugcuuguggaaugaugaaaaccgguaaaugaaaugaaaguuguaauaaaguucagauuguuuaauaguuugcuuguuuuggaauaagcaaauacauuagcugccuuuggcaauauuuuuauuguacagaaauuucugaagugcuaaucguaaugugaauuggcuuauaguugaauuugagacagauucuucaauggagaagguggaggagaucagcucacaacuucugcuuugcaaccuaagagcgacuuacccaaccauaccucuuuccugccccucucaguggaaaagauggccuuguuucagucugugcauaaguacgcuuauccuggcugugcccuagaauucugucucaucacuucuggccuauucucagauguccuauuaguuaacccauaacuguuuuuuucuccuuuguuuaggcaaugguauucaacccuggcuuguacaauagaaacauuuggggaucuuaaaaaaaaccugggccucaauccagauaaauuguaucagaaucuuagaaucauaguuggaggagauaaaaguuauuuuaugaaggaauugagaccuagagacuuuaggggacuuuucuaagcuaaugcuucuaauuaguuuaaaaacuugaggcaagaacugugguugccauucccaucccauugucccagaaucauugaaucccauucguuugauuucuccuugguuuucauccucuuacucuuccuuuucccaguuuauucuacucuuuaugcuguuuuuuuauuacauccgucuucugcucuuuaagaugcuauuauuguuuuauuaugccacucucuugcucaguaaccucuaguagcuccuuucuaccuaugguggagguaaaaaugagcaguucauguuuucuccucccuuuucccccauuggaucuuaugcuguagcuaggggaucguuuccugacuucuauacagcuauauauuuuugagaauuuuacaacauuccauaaacuguaccuggaauuccuuccuccuuucacuuugccuaccugguuccuacaccaaauaacagaauguuagcucuggaagauuauaaucauccuuuaagucaguuuuugaaauuacaaauagaaaaauugagacccugaaauuuuaaaugauuccccacugcccaucacccaggucacaaagcaaauuagccucagauccagguuauaacuaaugucucucuguucacuuuucacuuugaagauguaacugagauuugaccguuucucucaaaccuucucuaaucaacuuagagggucuauucuggccuccaaacuuuggugccauuuuuuaaaucaugggagcauuugugcuuucucuuguaguaauaauuagcagugacauugcuaaccucucacuucugaacucuggacuguuaagcauauugcuuaucucauuuaaccucacaagcacacauagauauuguuauccacauuauagaaguaaggaagcugaaauuuagagagguaaagucuuaaagggucaaaguuuacauuugaauccaggucuaucuggucacagaacuggacucaauacccuguauuguaaucuuuuacacagaaaguuugaaauguaaggcucuggauaacaauaaauaggucacuaaaugucuuuaaauuuucuacuacaucaucccagaagagcucaguaaauauuuauugacuucaguuggaaagaucauaacuuuugacugcaucuugaagguaaagguguugguguaugucagggaaggaagcagaagaggagaugggaaguacaagaguaggacuacauuuaggcucuagaucuaggaagaaggcaaagguguggaggugauugaaguuucuuuggaaugauauggacagcagagguucauaacuguucucauuugcuggugguaacccaauauuacauauugauucaccuguaagaguuugcgauagcaucucaguugccauugucauugcuggcuuugcucacuguuguauuuggcauuuccuuccuuaaguaguccugaaacugucucacaacaagaguauuaacaaauaccuuuccguguaagauugguuguuuuagccaacagaggucucggaugcuuuucuuagguaggaucuugaacuuugucuucuuaacuaagagcucccaaacugguagcaugcuuaagcugugcaagucauuuucuuguggaugugggaugugugaaugauuguccuuuuguagucaggcaguuaggugugaagaaucuuuucucccuucuucugcguguuaggaaagugaaacccuuaagcuguuuaaguauauugauuuugcauuuuucuaggauuuaaguuuagucuuguuuguucuuuugaacuaaccccuguaggauauugugccagcuuaauucuuuagugaucacaggaauaugggaaugaacccaaccuucagauagauucaggaguuguagggugaucuuucaaguauaguuuucaggacauuucaauaaccuuuuuuaaaaugaaugccauuacuugaaagcgaggauaagugacauguucaagccaaacuaaguguaggaagagcaccagucuagggauaagagaccugaguuguucuaguccuuauuuuguuauaaccaguuguaugauuuuggaaaaguaauuuugaguuuaauuuucuucauuucuuuuuuugacacagggucucaauuuguugcccaggcuggaguggaguggcgccaucuuggcucacuguagccccggcuaauuuucgcacuuuuuguagauacgagguuucaccaugcugcccagacugaucucgaauuccugggcucaggcaaugugcuugccuuggcuucccaaauuucugggauuacaggcguaugacacuacaccugaccaauuuuugucauuucuaaacuuuuaaugaguuggauuauauuauacugucccccccaacccccaauauguuuauuggucucagaccccaaauucaguuuguuucucguagauaggaaaccauaguuaacauucccuuugugugguuaagaaaauaggucucuagugucaacuugcaguaguauuacaccuuguaguauguucagaaacuggcaugcugacuuuaugguucuccauauucauuagauguuuuaacagucauaagcucuuucuaugcuuaugucuucaaguaauuguuggugaugauagauuuagcccuucaguuucauuuuuuauugugguaaaauacauauaaagauauauuaaaaacuauacaaaaauauguaaaaaauuugccauuuuaaccauuuguaaaugugcagcucagaagcaugaaguauguucacaaugcugugcaaccaucaccacugucuauuuccagaacuuuuucaucaucacaaacacagacucuguacccguuaaacaguaacuccucuuccuuuuuccuugcagccccagguaacuuuuauuuuacuuucuguuuauaugaauuugccuauucucaguacuucauaaaaguggaaucauacaauauuugucuuucuuuaucuggcuuauuucacuuagcauaguguuuucaaaauucauucauguuguagcaugugucagaauuuuauuccuuuuuaaggcugaaugauauuucauuguauguauaugucuuacuuauccauucaucuauuguuggacauuuuuguuucuaccuuuugucuauugugaauaaugcuguuaugaacauuggugcacaaauaucuauuugggucccugcuuucacuucuuuugagugcauaccuauguguggaauugcuaggucauaugguaauucuuaaauuuguggggaacaaacagacaauucuacaagggaugugccauucauucuauauuccugccagcaacucauaaggguuuuauuuccucuaccuccuugccuauacuuguuuugcuccuuccuuccuuccuucuuuccuucucccucccucccuucuuucuuucucucucuccugucuuucuuugucuuucucugucucuuuuuuucuuuuuuaaaucauagccauccuggccaggcacaguggcucacgcauguaauccuagcacuuugggaggccgaggcagaugaaucacgaggucaggaguucaagaccagccuugccaagauggugaaacccugucucuacuaaaacuacaaaaauuagccaggugugguggcaagcgccuguaaucccagcuacucgggaggcugaggcaggagaauugcuugaauccgggugacagagguugcaguaagcugagauugugccacugcacucccaaagugcugggauuucccagagugcugggauuucaagcgugagccaccgugcccagccuuaaauuuuuuuuuguuauuguuagucuuugauuuuuaaauguaacauugaauaaagagguaccauuaugagguuaguacacuuaacuucagcauugguauauauaaaauuguuaccuuaugguuauuauuuuggcaggacugguagauaagaauacauccucuuucauacaguuuuuaacaaauaauaauucuuuugugacuugagagauuaagagcuguaguaaacagaauuuuuuucuguuacuuuucuguaaaguuccaggcucgaguccuugggcaagcuaaccuagcaagugagcauacguuguaauauccugggaugauggucacucugccucacuacugguucuugagauuaaaguauaaaucugaaagugcuuugugaacugaauaaugccaauuuuuauuuuuuacuuuggcccacugagauacugugaccuucugugcaagcgaguuuuuaaucaugagggaaaaaagugaagguuuauguagcacuugucuuuaaaagaaccaaaauuauuucauuuauucccuuuacauucucgggagcugaaagaagauaaaugcuacugcauuuuagggaugaaaaaacugaaggaaggaugaaacccuuguauuuuuccauagcuuuguaaaccacuauaccagucccucuucaagcaagacuuuauugugcuggcuagggcugucucugugguucuugacaugguaauauauaggaauauuauauaugauauaugagacuauaugggacuauaacugauguaagcuugguuuaugagcuuaucugauaagcauuucuuugaguaguuuucucuucaaauguguuuuuagggauauuuucucaggguugaagccauuuugaaauuugcuguauaguuuaaacaaaugccuugcuuccucucccuuuuauacccucuucacuuuggaguaaguguagcuaugcucucuucaagaaagaguuucauggcauuuaaagaggaaaauauuaucuucugccaauguuaacauuaacauagcauuucuuuuucuaauuuuuuucuaguucucauuuguguacaucgauaaaugccgccuucagaauuggagaaagguugagauagaaaacauauauuaucagagcuucauggucaaaagauucauuuuauagugacaauuacuaucucacagguuggauuauuuguuucuuuugguuguaaauguuuacaauucuacugaauuuucagcuagugugcuuauaaguuauuuucuuuuuuguguggcaauucauaugacagaagaauugaaugaggaaauuaggaaguuuugaacugucacauuugcuaggaguuggauuuaauuuauuauuaguaaaauuuccaguuaaauaagauaauucuaauauuuauagguuacuguguauucuuucagcaugcuccuugguacaaaacuauucaauugaauuuacuaacuauauaugauuaucuuggagccuuuuuugguacucuaucagcuguuucuaugguaauuuuuuguucauuguuaucacuuauagcuuacucuauuauggcuuuuuaaaaaaaaaaucucuguauauuuucuuauccuuacuuguuugcuuacuuuucuaaccauuagucuaaauugacauuuagguaaauuugcuuuuaaguugaauacuuaagccaaugauucagucauuuugucuuuucugggguggguagugccuacuagacauuuaauugugcugcauuuuaauauuucuuaccauucauuauaaacuuuuuuuuuuuagacaggcucucccuccguugcccagacuggagugcaguggcaccauuuuggcucauugcauccuuaaccucuugggcucaggcgauccccccaccuuagccuccugaguagcugggacuacuggugcgugccacugccaugccuugcuaauuuuuguaccuuuuuuuuuuuuuucuguagagaugggauuuugccauguugcucgggcugguccucgagcuccugagcucaagcgaucugccugccuuggccucccaaagugcugggauuacaggcgugagacacaccaugcccugccucucaauacacuauuuaauacaucagacccuuugguaccucuaggcagaggaccgcaauuaauuuaugagcagcuguugcuguauacauguaauuauguuugacuacaaaugcaucuuuacaaaaugggccuaguggaaucauaauauaaaugguucagauuaacuuaauucagauuaagaaaauuguuucauacugagguaagcgauugaaaaauugucuauuuaaaaaugcagugcauuuuaaagaguuacuauuugaggaucuaaaauauacagagaaggcugcauauuuuacuuugaucuuauuaccauccaaaagaaagcuuacauagaaaugauuugucacuuucugcuuucugaagaagauauaugagucuuuuagccagguccuggcuauuuagucaguugagaaauacuuucauuaaaaaccuauugguagaaauuugccaguuuauugagcacuugcucaaguaguugcuuuucugagaggcaguggugagaccaggauguuccagccccaaggagggcccuguagcccaucucagccuggccaugucgugcuaugagagguuccucuauccauuggucaaggaagggaucaggcccugcagucacacugccuuugccucuugccgacuuuauucuugagcgagucacuuggcagagccucugguuucucuuaggguugcuguaagcauagagcacgggguccugguagggagcagauaacaguagggcccugaaccauuuguuaaagucauugaggaacugcgaacagugguucugaauaguuuuuagugugugugaaacugugauugaaacuguacauguguggaaagccacaauccaauugugcaggcuggggugcugcauaaaaaaaaaaaaaagaaaaaaagagaaaaauccucccuugaggauuccauuguuggauaaagggcucagaacaaucagaucuugcuuugggcuuucagguauuguggcaccaacagcuguauucuguuaaagaucaacuuucaacuguuugauagcaguuaaaugucacuggaauguuuaggcaauugcuuuguaauuugacaggcaucucuaaguuuuuccgaaguaaauguauuaaaucugagucagccuuugacauguaaaucacauucaggauuccaugggcguugaggugggagaaugaacuuuuaauuucuggaauuaauuuggcaguuuaaaaauagagcugugauaguucuaauguugaauccuuucugcguguuuaaaaaauuauuucuauagaaugaaauuguagaauguaaguauagcuucugaaaggacaguuauuaaugugcuauuuagccaggugguuuucagaauuugacuaguggaauuaagcaugcuuuuuuuuuuuuuuuuuuuuuuuaaacaaaugcugaaguagggugggugugauauuuucagguuuuugcaaaacccuaaacuguuaugcuuuucaguccuaagcaaaacagaaaaaaacaucaguauucccuugaugcuuuucccaaguauagcccacuaaaggaggaaguuguaaggagacaaagucuuguauuuccuuaccagaauuuugggaaguagagagauguuagggaggaaaauacccaugcaaauaugaaauauucaagauuuuuuucccuuuagcauucucuguccauuguuaccacugaugaguuauacugaguggaagaugggaagguugaaacguuugcuauuugauagaagcaauugaucuccuagagagaauugugguagcuuugcagaauucuuuguaacccucuaaagccaaguugaucagucauuuugguguacccuuaguaaucuggcuauucaaaaaugcaacaaggguuuuauagcauuuguauguauacauggagauaaaaggaaugaagacauggcaaguguagauuauuuuagagugagaaauguugcuuuagauaauuauuacuuagagcauuugagucaccuaguuacccaaguaugauuggaggucaauaaugaagugaaaaacauguauauauaaauacauacuuaucugugguagguaauguacccugaagaauuuuccaugaaacugguuuuaugcgauauuaauacauauuuagauaauuugguauaugauuuagagacuguaugaucuuuuuuucuugugaugaugggaacaaaaaucuuguguuguuugagggcuacuucagugagguauguguacuuagacaauguaguauuauaguguucaaaguauggaaucagauuuaaugauuuaucauauauguaauuaacauuuucucuuuuaaaauaauaaaacagcuagagucaacuuuucauauagucuaguaugucccgagcaccagacauugggauauuuuuaguucauugcuuuauuccuuggagagcaaaauuguugcacuaagggaugacccaauccauucgugacaaauaaauagaacauggccagguaggcucagaaggggaaaugaguucuguaccagccuagaaaacugcuuugugcccaucaugaaaggcuuguuuggcauauacucuucuaaguggccuaauaaucauuuuguccacuccagaaauaguauuuuaaaacacguuaauucuuagaaggugucgguaauccugauguugcucuagauugguaguguuaguuggugaauugacaucaucuuuuuacugauagugguaaugagggguagauugacuucauguauuauaacugcuaacuuuuaaacucagauaucuaauuuuaaaacauguugaaaccuugcuuucuguuuacugguauuugcuuuuugucaggucuuuugaaaugaucucggcagacaccaaauaaguauauuauauguuggauauuugaauuuugcuuaggcacuuaugagagaaguuauaauguaaaauuuucauuuugccuuccuugggaauaguucaaguccuugcaguuugguuuuaauuuuuaaaauuuuuaaaaacuuuaaauuuuuguggguauguaguugguguauauguuuaugggguacaugagauguuuuuauaggcaugcaaugugaaauaaucacaucauggagaaugggguauccauuccuucaagcauuuauucucuguguuauaaaaguuucauauaaacuuuucagaaugaugccagcccuauugcuaugacgguuggcuccuggugccacuauuaaucauuggcugcauuaagcauuggccuuguaucuuuuuggcaaacauuugagucucugcagguuugugagguaauggauaauuguuggacuugcuaggcaacagcccgcugagacccaaucuguuguguuccagggggagcuauaacagcuauguuggggccugucccuguggaaaggagcuuauuugccuuauugucagcuuuuauuguauuaaaauacacacuuggaugugggugaugcacauuuagaugugagucuaacuuguaaggcuugcuguuaugacuugaguauauuucagauuuaauagaaucaguuauaccugaugguucuggcuugcagaaagaaaagacaaaaaaacaaacaaaaaaaccaauaacuccaaacccagcccugauacagauagaaaauuuaacuuuuuaaauauuuaguuaucaaauaauuuccauuuauuaggaaaaauguguuuuuuccaauguauuuugccugcucaaucucuuacguaguaaguauuuggaaugagggcuguaaaagucauaagcauucuuguacuugagcuuauuuaguaagucagacaaaugaguuauguagauaaaacaaugacagaguaaguuuuagaccaguaacauguauuacaugcauugagguaccuaaaggaauauguaguaagggaagaagucugggaaacauugaugaauggggcuagaaaaggcgagggaagagaagaguggaggugagaugaaugcagaggggccaucuugcacauaccguagagggcuguauggcuuuccauacagacuagaggaguuaaaauuucaucugcaggccagagggauuccguuguagcuguuaaggugugguauggugaaaguagcauugaaacaaaugaauagcauuugcagagauguccaguaugguuugugcgaaaggccuaaacuggugguguauaccaggaaagauggguuuauugguacaaagugacuacccucauaaagugacauuuacuuuguucaguucucuuuagcccagaguuugagccucugcuuuagauacacagauucagucuugucagcgucuuguuaauagggcuuaggaaagcugaaccauuccuuuccugcucucccccaagcaagaaaaacaaaaacugaaaacccaacucccacaaacaaauaaugagccuuuagaggagaugggaggguaugaauuagaaugccaauaaauacacacaucaucuugucuacuguguguguucugcuuguuggccacauggcacauugucagaugguguauuauggggguugaaucagaacuggaagguugguuauaaugauaaagcuuaugagcaauuccuuguuauuucuuguaucuguuaucuguuuguuccugggcuaggugcuuccucuuguucauacagcuucaauaaaaugaaucuagucccugcccuugccuguccacucaauaaggcuauucuugcuagaagggacuaaguuccuaaauuccuucugucuuuccucauugcuggcuggccacucuucagauuuacaaauguauaaaaagucuuuuuaauaauuucaaucauaguaucuuuagccucagugaccugggggcuguuugguauuuuuuuuaggugacuuugaacggcuuugcuuugauccacuuugugaugacuuuuguauacucuuaaaggauaaucuuacauuuagauuucauuuugccccuguguacugcauacaauuugaaguggaccaagauugcuggcagggaaguaaaucaggaagucagcucauggguucagcuucugacugugagcuugcuuugcugcuuguacgguauuuccauacuuuaggggguuuggaguagagaguuugcuauaggaacaaagacagggaucaaucuaccaaccuuugcaaggaauagaugacagacacuaaugaggacaaauguguuuuaaagaaaggauggagucagaggcaacucuggagugaaagcccaagggggagucaguuuugugggaagaugauuaauuuuugacagagccacaguagaucauccaaguggagaugacuauaggccagugguuuggugugguuugauacugugacuuugccgauugaucaaggccagaaauguacauuugggcaguguaauaugaaauaaucgcugucugaucucgaucaaaucuguuauuuuuucugagcaucuuuaaaacaagucuauaaaaaaggcaacaauucaugccguaaguuccuuaggauguugguuucaugauuaauaauaaaauagcuagcacuauugugguauuaugcuaaguacuuuuggauguaguaucucauuuagccuucaaaacaaguuaggaauuggauucauuugucccagucauaccgggggggaaacaggccuuagaaaggcaccuacagucaccauuaccaagaguggucuuggaacuuguggguaucuggcugcuauucuuaacuacuacacugcauuuccccucagauaauuuauauaaaagcaaucuaaaaagcauaggcuuaaaaaaaaaacccugaaauaagcagaguagagugaggccuccaaugagaagauggugggcugaacugaguuuuggaaugauacccauagaaugaagaauagagaggaagaagacuguucuuaggagaauaaagggaauuaagggaagaauggcuuugaauccaaauaaaaguguauuaaagagaagauuuaauguuaaacaucagcugaggauauaaggagaggguaggaaccaaaaauucuagaagcuaaccuuuuuuuauucucagguaucaguuccucagagaaggcucuaagguuaguugggacaggguagucuacgaucugugacuacccaguguuuaguauaacaccuagugcgucguaugugcuuggcauuuguuaaguaagggaauuauguuaguagacaucugggagauaacuugaguaagacacggucgguccuugcgcucaaagagcucuuggugcagucagggaauuugauuguuaaagcauaaauaaauuacugugugcuggugaauagcucuugugguugauauggugcuuuggcuugugcuccucauuucugucauagaauggcuuaugacaugccauucuacgacagagaugcuuaguuuugggaaccucuugcagcuggaaggcuuagccgugccacaccucuuccuuggccuggauacaagaccccuuauacugaacacaccucuuuccuggcagcucugccacacucuuaaccauaaacccaacacacgagugauaucaaaugacucauuuacuucuucagcaugccauauuguuucaucacacaugggcuuuuguauauuuguuccucccucugccugcuuucucuucuccucaccugucaaccuucugcugaucuucagaguuuaguuaaaaaaaaaaguguucauucugcugaguuuuuggccugcccucacccuuacagcauuuggcuucuccuuccuuugugauucugccucuguuguagaccuagagcucuguaaaauuauguguuuccauguccaucuuucacagugacugcagggcuuuguccacuuuccuccuuuuuuuuccaguguucagccuaaugccugagucauagggggaguauccaauacacagauccugaaugagugaaauaauaauggcugacugucucucagaaaaugacaguuuucuccaauauuuguuuuaaaaaagguuuauuuauuugauaugggaaaaaagaguuaaauacuccuauagacauagaguucuuuucaggaaagggauauaucuauauaucuauauaucuauauaucuauauaucuauauauagauauauagauauauauacacacacacacacacgcacacauuuuuuuuucuucuucuguuuuugagacgaagucucacucuguugcccaggcuggagugcaguggcacgaucuuggcucacugcaaccucugccuccugaguucaagcgauucuccugccucagccuccugaauagcugggauuacaggugugugcaccaccaugcccggcuaauuuuuguauuuuuaguagagacaggguuuccccauguuggucaggcuggucucgaacuucugaccuugugauccacccgccucggccucccaaagugcugggauuacaggcgugagccaccgugcccagccuauauuuuuaucuacugaaaucuuuggcuuacuaaauaguagauggaauuaauuuuggagggaagaugaaggacaacacaggaaaauaaauaagaaauaauaggaaauaaauuaggccguugacauccuaagaagucuuuauaaacguuuaggguagcagaugaaauaauaaagucuuuaaauauugcauuuauuacauaguagucacauacacaugugaaaauagcaauauaucauuauauggaaggaauacuuugcauuauuuuaugaaacuuuauguaaaauuguguaaaacuuaucuaacguaguuuuuuaggacauacuauauucauuuucuuuuauauuguuugagauucaauacuuuuuacuaauuuauucaacaaacauauauugaugccaagcaauauuguagguaacggaaauaaggugguuuacaaaacagacaaaaauuccugcccuuguggaaaucgucuucuagaguugagucugguaugaugaugucacaagaauuuuauccagaaacauguuugauuacuuaauaucuacgaugucuccaagagguuaguguuacagaauuccauuuaaaaaauauuuuuaaaaggcuuauauacaaugguauuauuuacaguuugaaaggaaauaauaaccuaggagcacuagcacuggaugaugaugaugaugacacuguuuuuaugauagcagcgagcacaguuuacuuaccuggcacagugauauaacuagagugcuuugauucauuugaaccccacacuuaauuuugacauaggugcuaucaguuauuuuccuuuuacaguugaggaaaccaaggcaaggagauuaaaugacuuggacagcagauaaauauggagccaggauuugaacucaagccuguuaguaauuuauuauucaaaauaaagcaauggagagauuuuucccuuuaauaagagacuuugugaagauuugaauauaaagcugguggaggguuaucuauauauaggagauagauagcuccuauagauaacuaggaguagaaagaauguaguagaaagaaugcagugucacguuaccaugugacaggaguagcagggcuucccaaucuccaggccauggacugcacagcaggagguaagggguagguggccauuaccuccugaacucugccucuugucaguggcauuagagucucauaggagcaugaacccuauugugaacugcacaugugagggaucuagguugcguacuccuuaugaaaaucuaaugccugaugaucaguaacggucucccaucacccccgugaugggacugccuaguuguaggaaaacaaguccaggggucccacugauucuacauuauggugaguuguguaauuauuucauuauauauuacaauguaauaauaauagaauuaaagugcacaauaaauguaaugcacuugaagcaucccaaaaccaucccccggcccuggucugugaaaaaauuaucuuccacgaaaccagucccugguaccaaaaagguugggacugccggcuuauagugugguaauuaugagcacuacuggagcuugacugucuggguucguccuuaccaacuaggugccuuaguuucaucuauaaaaugggaguaagaauaguuuuuacuucauaggguuuuuguaaggauuaaauuaguauauacaacagaauggugcaugggaaguguuagcuaaugcucuugcuauuauuguuuguauuacuuuuuuuuuuucccagacggaaucucacucuuguugcccaggcaggagugcaauggugcgaucuuggcucacugcaaccucugccucccggguucaagggauucuccugccucaggcuccugaguagcugggauuacaggcaccugccaccacgccugccuaauuuuuuguuuauugccauuuuuaaauaggauucccuuuuuccugaggguuuuuauuuugaaaaaguugccauauuuugggguguauaccuugcuugcuucccugauucauuuuuuuguuuuguaucaacugggagguuuuggccagcauuuuguucagaggguaguggugugcaguucuuuaaguuuauguggguuuuuaaauguuuuccauuaauucucguuugcuauaccugcuaauaguuagagccaucaguagguguuguaaccuaggaaguccggcagucuugaaaugauguuuguugaaaugauauucuucugcaugagcuccuucuguggaaagaucacagcacuaacuaaacucccaugaagugauaagaaagggagaggucagagugaacuuaagaauuguuccaagccuagugugguggcucaugccuguaaucccagugcugugggaggccaaggcagaaggaucacuugaggcuaggaguuugagaccagcuugggaaauaaaacaagacccugucucuacaaaaaaaguuaaaaaaaaaaaauuagccuggugggguggcacaugccuguaguuccagcuccuugggaggcugaggcgggaggaucgcuugagcccaggaauucaaggcuuuaguaagcuauaaucaugcuacugcauuccagccugggugacagaacaagacucugucucuuaacaacaaaaaauuguuccaagagcauuacuggcacaaugagugcugaagagcugaagagccgaagacucaugggaaaccccccucagugaacugagcaacuuugauggaaaucaucaguaauggcuugguugaccccaucuaaagaaugagccaaaauuauugauuggcaucucucaccaaauaaacuuuagauaucuagcaugaaaaaucaauccaucagucuuuucacugucauuucauucaacugugaauaacuccagugaugggaauaucuugaaauguguggaagcaguagauagagggaaucacuuugggucaaggaggauguaaaagguagacuugcagaugauuuagaacauauuaacagugagaacacuacauagcaaaacuugagagaggcugcagaaacugauaugagaugcuuagcuuuaaauuacagacauauuaaaugaaaaaaauguaaaggagcucagccuuauauuuaagacaauagaaaaaacaccaauaauuuauguacauaaauaugagggaguuaaugauaugaacaaauauuguaugaaaaaaagcgaaaaugcaaagugcuaauucuugggcagggugggagaaggcaaaucacccaauaaaggauaacccuuuaacauuuuaucuaagaaaaaagaaggaagagaaaaauauuuaccaucucagauuagaagacaauauaaauauauacaucuauguuaauacuuuugaaaauaccagcaaaauagaaacauauguuuuccuccagaaaaacagaaaaccuuggaaauuaguaaccauguuuccaugguuauuagacuaaaaaauagugguuguuggaccuagacuaugggaaaguguuuucauacugccauggaggagaaacucccacacuguuccagaaaauagaaauauauuaaagcauucuugaauuuuuaagcuaacauaacccugguaacaguacugaccagaacagugaaaacaggaaaacuacagguaaaugucacccauaaauauauguaaugccccaguaaaacagaaaaaaaaucuauuauacauaguauauuaacuguaauucauuuuagaaaugaagaaauaauauacaauuucacacuucuuuaaagaauugauuguuaacuaaaaggaaaacauaaaauaguuuugcuagauaaagcauuuuaugaaauuccaauauucauucaggaaaaugcuaacuaauuuaggaaugcaguauaauucucuaccaugcuaaauaaugucuuugaaaauaaaauccaacauuauacuuagcaauaugauaauagcacagauuucuuaaguucaagauacaaaauuacuacuuuuagucauuuauauaguuguugaaauuuggcaguacaauaugacaagaauagaaaugaucauaaauauuggaaaggaggaaucaaaauuauucuuugcaguuuauauaauauacugugugcaaaacuuaagugagucuagggauaaccaacuagaaaauuuauguaaagaagaucaagaucauauuuccaguuucuaaaaaugcaaaacucuguuuccuaggaacaaaucuaacaaaauauguaaaaucuuuauggauaaaucuugaaacauugaaggaugugaaagaagggcuggauaaauggagaaauguucauuguccacaaaugggaaugcuugauauuguaaagauaacaguuuuccccaaauaaauggguaauuucagugaaaauucacgcauaucccaaguaggguuuuuaugggucagccaguccuaaaguuaauaugcaaaugagcauguguugaagaauagucaaaauaauuuugaagaacaaguugggaagauuuugucccuaccacauaucaaggcuguugaaacuauuguggcaaggauagagaauuacaccaguaaaccugauuugaacggauacaagccuagaaacuuaauauaaacgaauauaacgaagcuuguuacacuauaggagcaguguuauaaaucaguagggaaagguaaacuauuaaauaaaugggguaaacauccacugauuggucuauauaaaaaaaauucauucccuacuucauaccauauacaaaaugcauuauagauguauuuauggaugcauuacauuuagacuuaaaggcaagaagccaaucuuuaaaauauuuagcaguaaauauaagcauuguugaugaguuggcggggaggggacacacagaacaucauaaagaaaaggauucagaaauuugauucuauuaaaauaaacuuccauacgaaaaaauuaccacagugaaaagaaaagguucacauuggugucauacauuuguaaggcauguuugaaaaacauugcuagcugccuaccucgccuguuccccuuucuuuaccaacacaacccugauuuugugcccauuuagaaauagcugucucaucugauguccuuuagaggucucagugguggccaaugagaugugagcuuaggauuucugagaaaguuuuacuccuugaauaugggguccggucuuucuucccccacccuugaaguggacauaauguuuagagcugcggcagcugucuugcagaggugaaaaugaggcuaguguuaaagacggcagagcaggagggcaaaaggaggcuaguuucuugaugacauccuugacuguguacaacagccauggcuugcuuacuccuguacuuguagucagaauguacuugggucuguucuagcuaggccuuuagguagccuuggccaaguggcaauccuguugaaaauagccuauaugcuacaaggauuaaaaaucuagauuauaugaaaaacuguuacaaauuaauaagaaaaaggcagauaaccuaguagcaaaauagagcauaauuguacacaaugcagagaaauggaaacucaaauggccaauaacccugagucucacuaguaguuaggcaaauguaaguuaaaauggagauguuuuaauaaccaucauaauaugaguauaaaaauaccaguguuggggaagauucauuguuggugagagccuaaguuggcauaaccaucuuggagaacaguuuggcaguguaaaacugaccauaccauacuagcuagcaauugcacuagguaugaacucuugagauuccuguaccuguaggugaagggaaacucagaaggcaugcuuauugacacauugauaauagcaaaacuuuggaaccaaccuauccuucaauuaggaaaaauaaaguauauuuuauaaugaaguacuguauaggaguuaaaaugagugagcugcauaugaacuacauagagcuacauauauuaacauaauguacuaaaauacaaaaaaacugugaauauggugagaauuuauauaaaauaugaaaacaauaaugaaacuaugugaaguacuguuaucauccauugagagaugugcaaacucugauaaaugauuucuacucaucagugaauuuucuggaagccuaaaaauugauuuuuaaaauccagccaauguuaguuuguuuuauucccaacaagguuuuacuugcugggauacugaaaccacugagcugcuccuaguccagugguauaauguuaaaauguaaaacacuuugcaaaacauguuuauguauauuuuuauuuaaguauucuaauaacuuuaugagauaauaugacagguaggauuuuuauuguaacucaaauuaagugaugguaguuggacuugaacuuaccauuuccgaugccuaguuuaguucuuuuuauaauaguuucauaguguuuuuccaacacacaauuuaaugucuagguauacuucauuuaugcagcagauuuauugcugaaaaagucaugugcaaauaaguguuuagaacaaguguuauuuuaaauguaacuauaguggcuuucuaauuuaagagacccaguggugagucucuuaaaguaaauaauggcuuacuaauuuauugccagguuuuuuuuuugugugcgaauauaguagugcuuuuuuuuuuucuuuuagagacagagagucucccuaugucacccaggcuggaguucaguggcaugaucucagcucacugcaaccucugccucccgggcuccagugauucucgugccucagccucccgaguagcugggauuacaggcacaugccaucaccuuaguauguacaggaaucauccugggaauuuaugaaaaacacagauuuucugacccccuuguuucucucuguuauuauguugguuuguuaagggcugugaguuuuucccauucauuuugguauucucuacagugaccagccugguggaguguguguguguguguguguguguguguguguguguguguguguuuccuuauuaaaugcuuaauaaauauuugcaggaugauuucaggaagagcuuuccagaagcgaauaccugaacaaaaugaauacuguguuaauuguggauggagaauacuagaaauaauucaaugcuguuucuagugugugcugaaauugguuuucaguuaagcuguuaagcauuauuuuugaaacauucuuuuuacuggaaagaucauuuaaaaacaugauuauuuuaaaauuccacagaauaauuuugcuggaaaagguauaacagaaaauaacugaauggaaaaaaaucacguuguuucaaacaauuaucccaagccagcuuggaaguuacaguucucuucucauagaagauuucuuuagccacaagcuacugggaauuguucagcccauuggcagcuacacagaacauugcccuuuucacccuguccagcacacaaaccuagacgauucauagcuggaaccuaucuucaagaaagugauggcuuuauugaagccaaauguccagacuuuuucauuuagacacaugaaggaccuucagugcuuuugccauauaaaagugaaccacagagacauucuuaaaaacaacacccggaagcaaauaaaacaccugaacuuacugugugcaaauuacagaugcagacauagccuauuuggcaguaaguacaucucucugucuagcucacucuaucccucuucaguacuagcugugugcuuuuuaauauaguaacuguacaauaaauauuaguugaauguagguggaaguaggaugagaaugaacagaaaucagugaccaauucuguauuuuucaucucuuuuguuuuuuagaagaguccaguuuuguuuuaagaugaguguucuaauagggugaauuuaaaaauguaacaguaguaaagagauuccuuaauugcucauuuaguuugauuugaaguaaaucuuccccaggcugaaguuuucuacugugggccaggaaacccauguuuaaacugugaacucgagugcuuuaucuucuuaugccagaccucuggauaacguuggccuaguuguucuguuguuguuuacuuauucgaaaguuauucuugugaagauguggaccauuaacucaagaaaucucuguuuuuacuuuuuggugauugucuuacaggcuauuuuaugauaguggugaacagcacacaaaacuccuucagacccucccaagugaguuuccaacacagacucuuucuucuugcucuuuccacagaugcuuucucauaaguaguaucgauuacagauguacuuugaugaugcugauaagcugauaaacaauaaugugaaaucucuuugauauucuguuuuguuuauggagaugaaagauagccugguuuaccaacauuuucuuaaggcaagcagggaaugaaagcauguuuacaguugguuccugcuccacugugcaguuuauuuaaguuggaaaaauuaccuaaaauaacaagaugugccuuuuguaccuagauauaggcaagcaggucucuuuaccuaccagacacccaaacauuuuccuuugaauuucuauuuugaauuccuugguuugcuuuccggauuucuucccuguguaaucuauaggauuuauuaugcuggaauaauuuaaauucagaaaagaaguucugaauuugagcauauuuuacauuaguguuuauguuggacucugacugaaaaauacucuuuuaucuucucuugaaucaaaguguaaugggucuuguguaauugaaucgagguuccuuugcuuauuguuuuuguguaugggguuuuuggacaguuucugaaauuguacccuuuuggagagguugccuuugcgucauuguuggaacuuguuugcaguugcaagucauuuuuggagacagaaaacgucccuuggaaaauauugugcugauuuuucuuuuuacacaaucuaugaauuguggagcuugggucacagauugaauuuuggcauucaacucucccaggacaggguaguauccagcuucauuuugugagugauuacagaugccuuuuuaccauuuggacuuccuuguguucuaaauaaaugaccagucugugaaauuuuaagccaaaugggauacaaagggauuccugguuuuuaaagggucaucuuuaauuuugcauuuaaaaggcagcauuggcuucauuuuuagaaauuaaauacguuauagcuguugcauaauuuaccaccuccuacccucaccuccccuuaaauaacugaaggagaaaaauguggguugauuuuguauacuugaauaagaaaugugagaagaacuucggcuucauccugugacuugcucagaugucuuuaugugauccauaguauuguagaaaaaccucagauucaaaugaaagauauggugagugagugggcugccugaguuuuuuuuuuuuuuuuaaucacaccuauuuuaacuauuuauuugaaacauggcaaguugagaauagugggacaccaaggcacaauuaagcaucaggaaauagcuucacguguugcccauugcauccuggacgauuuggauauaaaacagaaacagcugugauuccgaauguccuauaaauuucaaauguugguguggcacacuuuaugagcugauuuaauaaauaacuuugcccguaugucuuuggugacuugcuuucaauuuucuuuacaaaaaugcaaaauauauggggcccuuucuuaaugcuaaaugaaaaauugugugcauuuggcucuauaaagcaaaguagccuugagauaugggcuugccuagaaauugacuacauuuuugugggagaacgggugaaaagggcaguuuccuguguugcugccaaaaggucugaacaaucuguaguagcuuguggcuggaaaacaacuucugugaggcaaaaacagcaacucuaaacuggcucuggauaugugugagaaaauacucuuuuuucuacuugauuauuaggcuucauagaaaauuucuuuuauaaagugaauuuuuaaucucaaccccuugaaaaugguauuuuagcugauuuggauaaaagucuggggaaauauauuuggagugagugcaagugggaaauaaugugauacuuaaaaaaaaaguagcauuuauauuuugcuuuuauuauagccaugugcuugguugguaauccauguuuuucuccugccuuuagagugaaguaaauuuuggcaucuuaggcauguauuuuacaggauugggucuuauauauauauauuuuuuuuuuucuuuaguuaacugauuagaaguguguuuucuucuuaguuccucuugggcaaugucuuccauuuuguaguaaaaacauguuuacaaaauaauauguguaacuacugguaauugccauuuauuaguacuuacagugugccaggcacugugcucauguucuuacauugguuacaccuuuuacuucucuggauaggggaaauagcuuagagagggugucauguaguuagaagauaguuggaaccgggauuuggaguccugucuauguguugcuaauuauuauuaauacaaaauaguuacuauuacaaauguucauuuuguagaaucaaaucaguuaaagaagauucuuguagaaugggcuuggauauguggaaugaagauagaguugguuugacuugguuuuaauguuuuuacuaaacucuuucuuuguugcacuuccgccaugccugagcaccuguguaccuaaucauuuaauguaauuuuguggucucaguuagcaauuagcaucacauacacucaaucauguuuuuauuuaaaugcugcagacuuugcuuugcuuuacuuuguuggacuuaauuuucauuuuuuuucccucuucuauuggggauaucuauuggcuuuucauuaaaaugcaggcaguagaccaauauggcauaaucuuuuucucaucucaauauuuuguccuauucaucaacaucaguuucuucuucauuguauaguuaauaaguagccugauguucaucaucuaguauggugguucccagcccaggugauguuccguaggggacauuuuuuauuuccacaacuugaaggugugcuagugguaucuaguaugugguagcccgccaugcugcuaaacauccuacaguucacagggacagcuccucacaauaaaauguugguagugcggagguugagaaacccugacuuagcuaacacagggcccaggcuaaaucuaauccguuagaagcucugacuucaugagauuuuuuuucauaacaaaacaacucaguaguaacuagggaagcuccccccgcccccaucuagagucucccucaguugcccagccuggagugcagugacucagucucggcucacugcagacucugccuccuggguuaaagugauucucaugccucagccucccgaguagcugggacuacaggugcgugccaccacgcccagcuaauuuuuguauuuuuaguagagaugggguauugccauguuggccaggcuggucuugaacuccugaccucaagugagccaccugccuuggucucccaaagugcuggauuauaggcuugagccacugugcuuggccuggaaaguuguucucuucuagagguggaggaagaggauauccaucuguuuucucacccaguccuaacuuagcacccauuuacuguacacuggauucucuuucacuugcuuccugucuucaccccuacuuaggggaggucacccuuuaaacuguuaccugccauucuauuagccacgguagucgacugccuauuaagagugguaccugaacuaccuuggcuuggggugggagagaagccaaagaaugaaaggaauacccaucaaagauauauuucacuuaagacaguuuuggcuugaaugaagguccuagucugccucucagaauuauacugaguaccagagaaugcaguugugauuaagacauaaguuugaaguacaugucuauagagucaaguguugauuuguaaauagaaagccgaaauacaaugguuacauggaauuuucagaagaucuugaagaaacuucucaguuaauaucuacaaaauauccaccuuguuaguggaaaaauggacugauuuauuaccucagaaguucuugggccuaccguuuguaauuuugacuaaauuugaaaaguugaaaagagcaacuuguaguggucuuuuaugcuugaugccuuugcagguacuugggaaucuguaccuccuuucuucccuccauccuuuaugaauggcuccaguuuuauccuacuucauccucuauucuuaugcuacuuugcauauggcuuucuguagauaguucucagaauggauugugauuaugcacuuacucccugugucccuuacuaggcuaugagguccuggcacagugcugauuacauaauagccagucgcuaaauuuugagugaaugaaugguagaggagaaaaagaagcaaacaucuuagcagucuuaacacuggaucagggaaaauggucuguaggcugaugaaaagucagggugcugaggaggcucuugaguaagugaagguaggaauuguugccuuagcuugaucaucuuggugcugugcacguuccuuuuugaugcuggaggucuggaugagugaggcuaggaggcuggcaggcuaguguguggucuuggcuauaucugcagguccaggagguguuaauguuuuucaccugagguugcuccaagcugaagaaugaucugccuauuugcugguauauggauuuacacacucaaaucugauguuuuuaaaaaauugaugauuuaauucuggccaggugcaguggcucacgccuguaauuccagcacauugggaggcugaggugggaggaucacuugaggucaggaguucgagaccagccuggccaacauggugaaaccccgucucuacuaaaaauacaaaaauuagcugggcauggugguguguacccauaaucccagcuacuugggaggcugagacacgagaauuaccugaacccaggaggcagagguugcagugagccgagauugcaccacuguacuccagccugggugacagugugaaacugcguuucaaaaaaaaaaaaaaaauuaauuaauucuuuauuucuaucaggaagaaaggaguugcaaagcaauagaaauggcccuugauguccagcagugauuguacaaugacagcacucuuguagcaccuggaauucugggcagugcuucuuacucugucuuugggcagacaugcuuccuuagccuucacuucuacuggcccuugaauuugaagaaacacagcuccauuuuacucugggguuuauaugcuuaugugcauuaguguuaccauuagugacuuggguuagaauaaauaguaacucuauaauguaaauguuuuguuuuuguugaauuacaugaaagcauuaauuagacacuugaauucaaucuagagauaauugugggaaaagcuguuucuuucagcgaaaggcccacuaacagagcauuggugcuuaucacuuguggccaugucacuggacuugucccuggcaaauugaacaugccugauugcacagauguuugcaugguugaacaaauuauauuuggacaauaaacuguuaggcccaucagugauuacgguggcagaacauaguugcauauggacugauuugguaagagaauuaagagagaauauuaccaaacauuuucauaaaaggggagaaaacaaaagcacucucugaaaguaaauuuuccuguauuuaaugguuauguggccuucaacuuauuaauauuacuggggcagauuuaccuuuuuuuucuaaaugacuaguuugguuuuuuuuuuuuggugggggugggugacaguuuguuaaacagaguuuagauuuuuccuauuggaggauagcugugguuggauuauggcugggaauaugggaacauccaguuaccaguguuacaucuuuuuaagucuauaauuuuuuuuugcuuuauguacaggugugaaauauguacagguacgaaauaaguuucuaagagccugggaguguggauugaguagggaauucucauaggauuucugagaauugcuaagggucuguguauuagucuguucucaugcugcuaugaacaaauacccgagacuggguaauuuauaaggaaaagagguuuaauugacucacaauuccacauggcuggggaggccucaggaagcuuacaaucaugguggaaggcagcucuucacagggcagcaggagagugaaugagugccgacugaagggggaaagccccuuauaaaaccaucagaccucgugagaacucacuaucacaagaacagcuuggggaacugccccugugauucacuuaacuccaccuggccccacccuugacacauagggauuauuacaauucaaggugagauuggaguggggacacagaggcaaaccauauaauuccaaccuggucccucccaaaucucauauccucacauuucaaaacacagucauguccuuccaacaaucccccaaagucuuaacucauuccagcauuaauuucaaaguccaaguccaaagucuuaucugagacaaggcaaaucccuucggccuaugagccuguaaaaucaaaagcaaguuaguuaauccuagauaaaauggggguacaggcauuggguauuuaccauuccaaacgggagaaaugaccaaaacaaaggggcuacaggccccaccuaaguuugaaauccaauagggcaguaauuaaacuuuaaaguuccaaaacgaucuccuuugacuccaugucucacauccagaucaugaugcaagaguugggcucccauggccuugggaaguuccaccccuguggcuuugcaggguacagccccacucccggcugcuuucaugggcuugcauugagugucuguggcuuuuccagggacaaggugcaagcuguuggugaaucuaccguucuggggucuggaggacaguggcugucuucucacagcuucaccaugcagugccccagaggggacucugugugggguuccaacccuauauuucccuuccgcacugcccuagcagagguucuuucugagagcucgacuucugcagcaaacuucugccuagacauccagguguuuccauacauccucugaaaucuagguggaaguucccaaaccucaauuuuuaacuucugcgcgcccgcagggucaacaccacguggaugccaccaaggcuuggggcuugcaccucugaagcaauggccugagcuguaccuuggccccuuuuagccaccacagcuggagcugaagcagcugggaugcagggcacauguccagaggcugcacagagcaggggacccugggcccagcccacaaaaccauuuuucccuccuaggccucugggccugugacgggaagcaccugcugugaaggucucucacauacccuggagacauuuuucccauugucuugggauuaacauuuggcuccuuguugcucaugcaaauuucugcagccagcuugaauuucuccccagaaaauugguuuuucuuuuuuauugcauugucaggcugcaaauuuuccaaacuuuaaugcucugcuucccuuuuaaacauaaauucaaauuuuaaaccaccucuuugugaacacauacaacugaaugcuuucagaauaauccaggucacaucuugaaugcuuugcugccuggaaauuucuuccaccagauacccuaaauaaucucucuuaaguucaaaguuccacagaucucuagggcaggggcaaaaugucaccagucucuuugcuaaagcauagaaacagugaccuuuacuucaguucccaacacauuccucaucuccaucugagaccaccucagcuuggacuucauugucccauauuacuaucagcauuuuggucuaagccauucaacaagucucuaggagguuccagacuuucucacauuuuccuaucuucuucugaguccuccuaacuguuccaaccucugccuguuacccauuuccaaaguuccuuccacauuuucgguuaucuuuacagcggcaccccacucccgguaccaauuuacuguauuaguucauuugcaugcugcuauaaagagauacccaagacuggguaauuuuuaaaaaaaagaaguuuaauugacucacaguuccauuuggcuggggaagccucaggaaacaaaguuacgguggaagacaccuccucacagggcggcaggagagagaaugagugcugagcgaagggggaagccccuuauaaaacuacaauaucuuaugagaacucacugucacgagaacagaaucggggaaacugcccaccugguccuacccuugacacauggggauuauuacuauucaaggugagaucugaguggggacacagagccaaaccauauccgucugcuuaaaguuuguggcuguggauuuaaauugagaaaaguuacuguggcuauuuucauuuggcugcuugggugcacaucugaaguaaggccaagguaaauguaaccauaaauagggcgaguguguuggagguagggaggggcaaaggaguuaagaugugauuggggcccaugggauccaagcugcuuaaggaagggagugaagacuggggcacugggaaggugguaugggcacaggauccucaggguuagagaauuguuggagaagagggauugagcuggaaagauagauauucagaggucggggugcaugaaauugagauaauuguagaguaauaggucuagggcaggauuuuucaaaaccuaguauuagagagucaugaccagcauuuuuaaaaaaugcuaaaaaaucuaacucauggaacuuguaaugaaucuuuuuuuuuuuuuugagauagagucucaguccgucacccagucggguucaguggugcgaucucggcucacugcaaccucugccuccuggguucaagcgauucuccugccuuagccuccugaguagcuggaaauacaggcgcgcaccaccacacuuggcuaaauuuuuuguuuguuuguuuuuaguagagacgggguuuugucguguugacuaggcucgucucgagcuccugaccucaaaugaucugccugccucggccucccaaaguguugggauuacaggcgugagccaccgugcccagccuuaagugaacuuaaaaagaaguucgucgggugcgguggcucaugccuguaaucccagcacuuugggaggcagaggcaggcagaucauuugaggucaggaguucgagaccagccuggccaaccuggugaaaccuugucucuacuaaaaaauacaaaauuacccuagugugguggugggugccuguaaucccagcuacucaggaggcugaggcaugagaaucgcuugaaccugggaggcagagguugcagugagccgagaucgagccagugcacuucagcgugguugacagagcgaaacuccaucucaaaaaaaagaacaaacaaaagaaaaccuaacacacaacaagaaggacuucuuuuugggaaaggaaagaaauaaggaaggagaggaaagagaugcaccuuuuuuuucuggcugaggcuaucugcugucagggagaaggcuuuuugaguggaaggguuggggcuggauuuagcaugaacuccuccccaagcuuagccuugagucuugaucagagugaucacauagucauuuaaaaauguuguuuucauuaaaacuggguguguuuacuguguauuugugaacugcguugggauguaaauauuucccucugggucacaguuggaaaaaauugaaagccaguucuuggugcaugaccgugggaauggguaacugagauagugagaaaaaacaggauuacugagauuugccuuuuaaguaggaaugcauacacacucgcauagucuucugcccugugccuuauagaagggagcaggaauauggguaauaacuaagaaauguuuacauuuggaauacauuauacaugugaaggcuuggcuuuagauucuggcuccccccaacacuccccuuuccacugacuuuaaacauucuagagugguggggaaaagcauggcccagagguauugguugaacuucuggcuccacacagauagcuccagcuucauugucagacugggaaaaauagauuagacaaaugucagguucuagggcaucucuaagaucuugugagucuguaaaagcugugcaaugaggagaggggacuuuggaugugcuuugggucacagggagagagcuuucugggacauagcuauguuguugccuauaaaccacaucaccagcaguagauaauugaaaacugacuacuuuuuagagguuuuugaagguuaaaaaaaaaaaaaaacucuguaaaagaucaaguaagcaccgucuugggaauugcaagauagaaguugcagcuucuuccuuuuucuguugucuugacuacuuuaaauguaucuauauuagcauugacgucugaguguguuuuugccuuugccuuuggaauguaaguaaaaacagacaaacauauuuaggcuuuucuuauccauuucuugauuguuaugaauaguaaaaucuugauagaaaguugcaaagcuuuauguugcuuucuugacugaauuuggaaggugaagagucuaguuccuguuuguacaugaccguccuggacagaugcuggcagugggaagcaggagggcuacauucgguggcuacuaaaaaggaagggaaaggugaccagggaguuguguaguggggaguugggugauuugggcagaggcuuaaauuucuguagcccuucaccccuagucuguuggaguucagaguucacaccccaucuccuuuacaggcaccucauuucugggugggcuucuugcuggaggagugguggggguaaggauucugcauugcacugucuggugugaauggagggugcacuucuuccucuggagagcacaugugugcuagucggaacuccuuacugcaugcuuuccuuagaaguguuguuaggauuugugguuuucaaguacuuucagguguguuaauagguuaauugaccuuccuuugguaggccuagggaauuaauacucccuuuaaugacuguuucugugaagagagaaaaugauaacaguagcuaacauauauugguguuuacuuuaugucaagaaacuguuauucuaccugcuuuguuuuagauuuccuuaaccucauuuuacagauugaggauuggagcuuacacccccagguucacuuuugucauucccugucggucuuacucccccacugugcccaccccuucuucaaucaagccuucacuccaucuguuguugggaguauguauaguucuuuuuucaagcuggugacucaaaaucaggcuuuuggaauacaaccuaucaugaagcagggacugucuauagauaggcaggcagaacaagucguucacaggccugccagauauuaaauaaagguuuagagcuguaaaguuuggccuuccaaggaugauccuugacaauauuugaugcuauguucuauaaaaaguuuaaagcugauaaguuguaaguacagggcuuccuaagcagagccagucaaauaugaguguguuuuauguucaacagcguugggugggcucagagauucaagcugcaagcugcauuccagggacaguucagacccauggcugguaaugacaucaccuccacaggugccaaauuauucuccucuuuuuuuccgauauaaccugcccaugcuuuugaaaaaaggaaaaagaaaauguuuaaguacuacugggagauuuuguugugaaaauaaguaugaaauccaauucugggcauguguguagaaguagggagaugacaauaugaugguuuuugaaaaccauacaguuccagaaauuccaguuuuagguuacuugcguucagucacucccaagagguuuuugugaggagggguggggauggagaaagggauuuuagacuagaugagaaaaguaguaguggaaaaacaaaacugugguuuugcccuuucucuuuucccccuaauugaagacugggcuuacaguguuucuaagacaacucugauuggcaguguauuucgaagaggcugaagagcucugauugaaaaugucaagcuuggauucaaaggauuggaucuuuuuauauguuuauugacuacaauuggaaauagagaucauaaauaauaaaaugagaccuggccucauuuccaccuucacuguuaaaauuauaucguuuuuaucuuuguaugcuacauucauggcuuauggaauaaaucuuuaaguaaacacauauuuuuguacauuucacaaagugaggcucguauucugguuuuguugucauuuuucacucaguguuauuuuguguacucuuugcagugccaagugauuuuuuuuuaaauguagaauuuuauaacuaagugacacuuaaaaagagauaacuaaucccuccugcuuuaauuuuacugauuaggaaauuuaguaaagugaaaucaaauaacuugcuuaaaacuacuauuauuuucauagcuggaauuagaauugguuccaccuauuccagaacauuuuucacuauaccauucugccuguuuuacuuuaucuacugggaaaaguuuauaaaguauuguuuuccuguaggaugacuuaaaagaucauugaccccgaggguuaaauccaucuaacuguaacguugagugaaaaauugagaccacccaaacacagcuguuuaguuaauuuggcccaagcgauuggaagaaguuugaaaaccauuaugauguggcuggauuguugccauuuuaggguuguuugaugugaaccugaaagaaauagagguuaaaaacacacagucauaucugaaguauuucucuuccaccauauuaaaacuaauaaauccauuaaccuuuuaaaaugauuuugccaaaguaacuaucaucucacaugccagauuccuuuuacucuggaauguauucacuucauuuugcugaauuccuguaggaauucguagcuguguaauuccuuuagcaauugcucauacacagacuuacggcauuuauucuaaugucaccuugaaauuugaccuguuuauuaauguuaacuuuccaugagguugucuguguuagcggucuagguuaucagcuccucagggacaaggcuguuguauugccauuccccuucuuucuucucucuccccuccacuuucccucgacuccauagugcuagcagagggccuuguacguucucaguauuauugcuaggacuggugaaaaacguucugagugcauuuggggcuaauuugaggacaaggucucuucucugugugaguuuauaguugugcuggcacuggugaucgaaggaaugccucugaaaaaaaagcaagucuggcaugauuggcacacuuugaaucaacagguaguuaaaguucuuuuugaggcaguaaucauggcuucagacucaccuuuauuugcauuugacuuuagucuaaaucuagacaaaucuauaugugacggcucaggugaauuuggugagaugagaaggaaugucugaaaaauagaugauugagaaucauuaguuuuuguuuugcuuggaaauauucuuccacagaaaucuuuagaauauuaaauuuggcauccuaaagacuuauggacaauuuugugcauuucucggcuuucuuuaucuugagggaagaauugaagcuggcaugggggcaauggagaaauuuaguuuugaaagucuaaggagagcagggaaaaaaggaaguaacuuucguugcuaggaucuacuuauagguagggaaagaaggacaggaagaaagaauggaaagagaucaagaaauaagggggauaaacagccaaauauuagggugggauuaauucugaaugucauuuugcaaaguugguuauacuuuucguucuuuuccaggagguuuucaaacgcaugggguggguggggaaacuccgguagagaugacagcuuaaguguuggagaaagaugacggaaacuguccugagugacuagauagaguaggaagaaacagaacuaaaaaaauaaauucuuuuuuuucuggcagcacucugcgcuucuuauaaugcuguacuuaacuuguucucuaguguuguaccaaaaaguuuguuccauguaauauaaagaaucucuguuuugacugacugcuugccugcacaugcuuguucgcgcucacgugcucucuuucucuuucccuugcccucucucuugcucucucucagcugcuugucucagaguaggcauuggagcucucccugucccucaacuuguucaccauggaagugucaggacguagacgugacugauucuaugagcuucauggagaagcagccacaucacuuuauagucuaagcacacuugagugauagcauguacgcacucauuuacgcucucuucucuuaaaauaaaagagaagugucuaguuguauaguuggaauauacuuggcagaaaguuucuuguguugcuagagcgggaucucauuucucuuuagucuuuguuuauuauucauuauauuuaaguaauaauggagcugcacuccagaucauuuggaauuauuuuucaucuguuuuuguuuggcucuggaaaaaaagaagugaaauaauuugggaauucauuucaugauuggaaaagcaaugcugcuuccuaaggauauuuauguuuaccuuugggcucuauuaucagucucauuaucuccugacccagggcugggccccucugacuuaagcacuaggacuggauugugucagcacuguacuuaaggcguuuauccuaauccaggcguccuuggauugcacggugccagcaagcaaggugguaacagugaucacagccugggcugcaggugugaguucugaggagaucuaugguuuacccagcgaauuuauuacugauaaaugugagucgauuuuuccuugggaugcuccguuguggggcaagugguauuucuguuuuuuacuguguuauucuccucaaacggaaggaauaccugugaauuuuguuucauagggugccauuaacccguugauguaugguucagauuuggauuuuugguaguugcguuggucagauuuccugggagacagcuuguauuuuucuuccuaaaaguuauguguaaccauuacaaauuauauuugagggggugcagaagaaaacaauaagagcggauuucuuguuuuaugccucaguugugagcuuuccuggauaggcacccuucgcuuuuccaggcauucuguguuccuauuuucugcugugauuuuaacaccaacuugaacagugaaggaagaagauccucccuacccagucuaguaaagguuauacacagaugagagauuauagugaugccuguauuuuuuuuuuuuaaaaagccacuauuccacaucuuuauacgguauuuacaucuauaggaaauuggaaggucaacagugagaugugcauugggaaaacaaagauaacaagaggaaaguauauuuggcaaaagugagcuccauuugagaaaacacugagggguaaauucauucagaaaugugagcuuaucaccuaauuaauuucagcucauugccugguugauuuaacauguuuaugcaaaugagaaauaccuggcaacuauuuuuugccaggagguuagguuucugccuuugcucaggauauucuaaaaagcugaucuuucagucaguuagcucagucuaaaauuucuuugauucucuaauaucugcauaauaaaggguuggcuaaguuauuuucuugggucccuuccagaucuaaaauuaauaugauucaggaggauuguauaccccucccaaauuaauuuuagcauguuuucuggagacauuucuaguuucuucuugcuuuucuuagaauuugauaccuuuuugaagcuagugacccaguaggccaaucuuaauccaugagaagcaaucaugcagggugaagauaguaaauaccaugcuucccccauuuucuugaaaggaaucuuaaaagacgacaugagauuucuuacuacaaaugugccgaaauaauauuuguuccaguagagugcuguuugacuuaauauuacaauaacuuuauugaaucauuaagaugguuaucuuggauaauagaaaaguaagauuauaaugccuagaaugguuugaaaacuuaggcaugcuggauuuuucuuauuguuucuuucugcccaacauauauuaaguagaacuuugugcaaaaggguaugguugguugcuguggugcauacagaaauaaguaagacagacuugcuugguaagguggauaagaugggcgcauugggccuagaguguagaaaagugcugagcucugaaagagggguaggggacacuaggggaucugggagagagaagaacagcauugagcugggguaggcagggaagucuggcaaagucauagccugguaacuggacucuacgguggugcucgucauuaugggcauucuacuugguuggcugucuuuugagaagaggcuugaggauugagccuggagacaguggcucuuaccuccagaaugauagcuuucauccugggcagaacugaguagaaaggcuggaaaaggagagucaggccagaguguggaggacucuauucgagguagaagaauugcuuucuggguuugcuuuccucucucaguggagucacugagguuuccuguacaggugaaugauaugaucagaacuggaguucaggaagauuaguuggguagcaguguccugggauucaaaguaggauugacaauuuaugaaacaaauagucauagggagaaaaauuuaccuguugcuaacuuauuuacugguuuuauuuacuguaaucagagucuacuguuuguaacuauggcugaaguuguuuuuucacaauauagaaaucaucaaauaguuuuucagaguacuguccacugaagauaacuaagcacauacaccucagauaaagugaggaauaaucaguuuaguauccugauuaucaucuuuccccauccagucuauucagauaugcuauuuauuuuguaauuaauccuaacucucaucauuccuucucuucguuuuuuuccuaaggcauucuuaagcuacucuuuuaacaguguuuugcaaguguuacuugguugaucuuggguggguguaucccaauuuccccuacacccccaauucauuaagcaacuagcuccauuuuuguaugguguuauaggaaaguucuugucccauuuuugaaaagaauuuguccuuaauccaugugaaaauuauuugauuuucauagucuuggaauucaaaagaucuuggaaagaaagucaaagucucauagcuaguaagugaaggaguuggaauugaaacucagaucugucugaugcugagcuauguuauaucucuaagacucaauuuccuuacuuauaaaauggagucauugguaguacauuucucauagaguggucgugagaaauuaaaugaaaugauacacauagauugcuuaucauaauacuguuauugcuuguuuauaaacuaccuuuuaacaggaauuauagaaauacagugcuuaugaaucaaauuaauucaguugauaaguaagguuauuuugugauuuuuuuuaguuauaauuuuauuugcaaacuuaacaguugcaauaacucgauuuuuaaaacauuaggugcucuuauauacaauaaugagugaaacuuguguccaauaguuucuuuuaauucuucccuacagacugucauucuccauguuuagcucuguuuuguguuaauuuucacugccuuuuccccccugaaaugcaauaguccuguaguguccuacuggaaacauuguucucuuuguuagggcuaaagaagugccuuugucacuccuuugagacauucugcagaugccauuuugcaguccugaaaaacacgucccuguccgccuugugcuguguuaaauugugcguguauugugcuugauauuuuaaugaagucguagagaaaauuugacaguaacaguugucauauaacaaagaaaggcucuuucuugaucuaauguagauauguguucccugaucccuucguagcucuguguggucugaaaguagauccccccugcacuuagaugugaccucagaugguugaugcuuuuugacuaccuucauaggaaacuguuaaaacaacuucugagcaggaacucuuaagucuuuuguugaugugcauugcuuuuuaaagaccucuuaauuuacaugaucuuaauagcguuuuaaguggcaaguacacucucuaauuugcuaaguggcuuuaauccuuguaugaagaacugagggaaaaaucuccugggaaauugcugugauaaaauccaggaaauuccuuucauucuuuuaaauccaguucaaaucuaacuuaaagaaaaguccucuaauguaacagugucugaaagcuucucagaguccagugauuucuuguguauagugccaagcucaaagaggaauaguaugaauguaccucuguguuuuugguaaaucuauaccacauggcacaauaccaauuuauuauaacuuugcugggacuuaguuauccuguuuuguacugcccuuaaaacuguuaaggaguauagaguuaaagggagaaaacccuacauuuuuccauuuuaauggacuuuauuuaaauuuuugaaaauuauaacacauguucagugcagaaaacuugguaacagaaaaaugcaaauaaagcaaaauuuccagguacccacauuucaggaauaauuaccguuaccauuuugguugaacauuuccagucucuugucugugaauauguucacauagguuaaagcaacagcauuauccuuuuaaauucacuuguuuucccuuugcaaaauagggugaugcauugccacaaauucuuaagguaguagaacuuaauuuuggaaguguuaaucuauagggcauucauucauucauucauuagauggacucauuugaaaguucacaguuuguagaaaguguguacauuuauugccuacagaagaugugcaucagaaagacauaggcuagucauuuuggauguuuuccaggaucauauaaguguaacaagucuauauuauaacucuuaagaaggcuuugaaacaaguaaagaucagaucacauaagcccugacccguccuggaggggccagcucacugauuuccaacaagagcugaucugugcuggccugacuccugucaucuggggcagagguacacagggguuccaguguuuguuuaugucugggcaucaguugggcuuguuuuauagaaugauuccaagcucuuggucaugccauuccaucugugucuuuuaaagauaaauacacaauugguauaggacagauccuguuacaguaaacuuuauggcagaaaccaacucuuuauauggauguucuuuuguaacuaagggguauaagugagaggaaacccuccaaggagacucagauacuggggccagucccucuccaaagaagagacagaguaucucuggcucccuuauuacucugagguccagugggaagaauauuuacuuaugauauacagauaauagaacaggaaaaacaaguuuccuuaucuauucauaacugugcuauugaauuuauauguuccaauaugguuaaccuggaauuuuaggggacagugggaggagauagaaaaggauugggaaggaggauaugacagcguuccaaaauauggcugaacucaaacugcuugaacagagcuaguguaaaucaugggagugaggcugaccauaggaggaggaaaggaucaggcagaucaugacaaagggaaaguuagcuauggcagcuaaguuaauuuuuaugagugcuacauuucacauuuugguucagauauauacuauguacuaugaaccccgaauaucugagacaggucucagucaauuuagaaagcuuguuuugccaagguugaagaccugcacccaugacgcagccccaggagguccugaagacaugugcccgugguggucagagcacaguuugguuuuauacauuuuauuuuauuauuauuuuugagacagggucucacucugucacccaggcuggagugguuucaccauauuggccaggcuggacucgaauuccugaccucaggugaucugccugccuaggccucccagagugcugggauuacaggcaugagccacugugccuggccuguuuuuuuuguuuguuuuuuugagacggagucucgcuuagucgcccaggcuggagugcuguggugcgaucucggcucacugcaagcuccgccucccagguucaugccauucuccuccucagccucccgaguagcugggacuacaggcgcccaucaccacaccuggcuaauuuuuuguauuuuugguagagaugggguuccaccguguuagccaggauggucuugaucuccugaccucgugauccacccgccuuggccucccaaagugcugggauuacaggugugagccaccacgccuggccggccuguuuuauguauuuuagagagaccuaagacaucagucaacauauguaggaugaauauagguucugucuggaaagguggggugggacaacuugaagcaaaggcgggagaacucagcggggagggggcuuccuggucauagguagauaagagacaaaugguugcauucuuuugaguuucugauuagccucuccaaaggaggcaaucggauacgcuuuuaucucagugagcagaggcgugacuuuaaaaagaacgggagucagguuugcccuaagcaauucccagcuugacuuuuccuuugagcuuacugauuugggggccccaagauuuauguuuuucacaguaccuauacuuuucuauauguuuaaguauaauauauaaacauguauauauccuuucagugaguguagucauagauaugugcuugucugucauacuucagcuuuuauagguacaacugcagacacaguccuuuugucgccuggggcagaccaugcaaaguccaguugaccuguugcaucuggaggcccugucuuuucucauagaaugcagucugcaggggcuguucauuccucugguuccauuucuaucuagccuaugugucaguggugagucccagcguuagguuuuccccaggacacacucugcccugcccucuccuguugcacagccauaucccaauucuguaggucauuaguuguguggcucauggguagaugaucagguaagugagaacagugguuuuucugggucucagcuuguccuugaagugugauuccugaucagaucuaaccgccccugguuccuucaugcacuacguuacagcucagggucaucuuggaaaaggggcuacauuacucuuagcccauuuuagucuuucacauucuuagcauccugcuuacucugccaguggauuuugcuggagugguagacucccugcuggguugguuugccaucuacuagaugucucuuucacagccuugugauuugugaauguguguaccauaaacucacaaauaacuucaugacguuucucccaaccccaaguuuuauucccgguauacuguggcuuaaagucgguaacagagcuauuguuagguuaggucauauacugccuauuuuuaaccuuauaccuggaagcuuggguugguuuuuaaacauuuuucauccgagccaaggguaacccugaugguggcagguaggccaauauauuuuuuaaaauuaauacuggggcaaccuacucugcuuuaccuuuucuauaaccaaauagauaggaaugaaagauucuccccagggccugaaagcuuaagggaaugaauaacuccucccuccucacgcccaguuccaaggagcaaggucacuugcgccagcagccggugucagcaagauagcagaagcaggaagagagcuggccggaagacacauacccccugaagaucgagagggaggccgucuggguacuaccuagcaguuacaucagacugagacacuuccuguuuacagcagacuauaaaaccccugccccauccucuuuggugcugacgccauuuuaagccucagcccaccugcacccaggcgcucauuaaaacaguguguugcuacacaccgccuuguguuguuuguuggcacgcucucaggguuugaaccgauacaagagccuugcagagacaauuauaaguaccuguguuuuagaaauauauguuggguuuccuagaaaauuaccuaauuucccugggacaaggaagccucauuucauauuucucuuaucuauagccacuagaugucauuucuggguccaauaaugaucuuguauuucucucugugcgguaacaccuggugguauauauaccuuuuugggguauuuauuguaaaggugacuaggaucaaauauuuaauuguaauagugaauuuuguuguugccaauuaaauucauuaugcuuaccacuguaaaauaacacaaagauugagaaaacugauuuaaggagcuaucuuugguauuuguuuuuccuuauuaugaaauaaauuugugcccagucuuagugugugccaggcuagggauucaaaggugaguaagaagacugagcugcugaguucacaguaagacagacugauacuaagaauuggaauuggggcugggugcgguggcucaugccuguaaucccagcacuuugggaggcuggaagcugaggcagguguaucaagaggucaagaccguccuggccaauauggugaaaccccaucucuacuaaaaauaacaaaaauuagcugggcgugguggcccuguagugccagcugcuugggaggcugaggcaggagaauugcuugaaccugggaggcguagguugcagugagcugagauggcgccacugcauuccagccuggcgacugagcgaggcucugucucaaaaaaaaaaaaagaauuugaauugguaauuucagcaguagaaauacauacagagaaaggacaacaaagcgaguccccauagagaggaaaggaugaggaaugauggcuguauugaguucauuuucuguuuguuuuacugggauuugguuuguagcuguacaccacuuaaugaauuaggugcaauuauugauuaacucauaaaauguuccauugacuaccuaccacaagccuaaguuauuaggguaugggggguauggauguaagauugcuggcuuuccccuagggauuugauuacuugaguggcagccagucaacagcaauuuagugguaaggagaaggaugcuggugauaggaauuugaccagcaaaacuguagauacauaaauuuuucauacugaaccauuuugcuuaauauuuaacagaaucuuuucauaaucuuaucacacucacacauaucaaaugugugagugugaaucuuuucgcaaaucacccucuuaauaauuacugaagaaacguguugagucaaugaauauaucuuuuguguaagaauagauuuuuacaaauugguauuuacucaacauguguguaauuugcuacuggcuguccuuccauagaaagauuuucuuuuuuuucuuuuuuuucuuccccuaauugaaacuuccaggaaguaucacucuccuaggauuucuauccaaguacuuuucugaagccaacggguggguguauguuuagauccaagagaaacaaauuauaaccauggaugugaacuuuucacagucuucucaaaauaaaagcuugaaaaaauauuuuuuuauauuuuucuucuacaaagaccaaaucuccuucugaagaggaauaaagcaaagacaacauguuaagcacauaugcaucuucauguuguugacaccuucccuaaaauuagcggaacaccucaaaauguuuauuauuuuuggccaugauuuuaaacuuuaaaaaccaguacaaagauguagcuauaucaaguccaacagagcugaacgguaaaaaaauaaaaaaagaaguagauacguaguggaguucaaguaauauuggacauugcuguuuuaacgaauguguuuugagugugaaggaacaaaauacuguaggauuagauuuaugaggguaagccaaguaaaauguggaugcccaguaguaagaccuuucuacuguaucaaacaugaauuagacauguugaaagccucuuaaauuuauuaaauaagaauaugauugggaaagggugaaggcucuguaaacuguaaagccccuguaaaugucuccuugguauacuacacugauugguuucuuaagcuacuuagcacccauaugacuaccauuguguuuuguguguguggaagaggacauagcuguggggguacacauuacuaacauggcagaugggggcaguggaaaucaggguagaaaaggaguaugacagacgcaaaauugacauuuuaaguucagaacuacugguguuuccaagucauggccuugaaccaagauuguacuguuugguaaguggcucaugccuguaaucuuagcacuuugggaggcugaagcuggcggaucacgagguuacgagauugagaccauccuggauaacauggugaaacuccgucucuacuaaaaauacaaaaaaacauuagccaggcuugguggcaugcgccuguagucccagcuacuugggaggcugaggcaggagaauugcuugaacccuggagguggagguugcagugagccaagaucaugccacugcacuccagccugggcggcagagcgagacuccaccucaaaaaaaaaaaaaaaaauuaccuguauaguuaauaagguuauaagcaccuuuagaacauuuaauuauauguccucggcauaguauaccaaccauacucauucguauuauuaugagaucuuugucuagacuuuuacagacuauccuucacucuugcacuaaacaaagcacuuuauuuuugcuguuuaggguuaucucuuuauuuuacaaucaaaguuaauucuguauaucacaauuugcugcuucguaccaucucucuuuucccauauuuuuaucuuuaaaauagguuucuuguacauagacuggaauugauucuuucuuuuuaaaccagccugacaaucucugccuuuuaauuugugucuugagaccauuuacauuuaauuauugauauauuugaguaccaucuugcuauguguuauguauuucucccaucuagucuucguuucuuuuucucuuuuacaggcuuccucuagauauguuuuucucugacuucauuuugucuuuccacuauuggcuuuuuuuuuuugagacagagucuugcuuuguuacccaggcuggagugcaauggugugaucuuggcucacugcaaccucugccucccagguuccagcgauucucuugccucagccuccuguguagcuggaccugcagucauguaccaccacacucggccaauuuuugcauuuucaguagaggcaggguuucgccauuuuagccaggcuggucuuaaacuccugaccucaggugauccaccugccuuggccucccaaagugcagggauuacaggugugagccacugugcccugcugauccacuauuguguuuuauuaguuauaugucuuuauguuguuguuacccagucuaaauugaacucauuagcuugccuccaaaagagccuaguccuuccuuguuaacuauuucagugaauggcuuuacugucccauuucuaauuguucuuucuuuagcuuucccuugcucucuuaauucccaaaugucuuuggccaugugucuuaccauucuacuaacugaauauuucuugaauuuauccacuucguuccacugacacuuucccuauucagauacuguaacuugcauaaagaugagcucacucagggccuaguuuuaauuuugauaacgaagaaaacacagaucccaacauugacaaauaauugacaaaccauuuaaguuuuuagucucuagagaagcagaagguuucguuauaacagcaaaacuuaagaaaaauuaucuucaucaacuuaccuuuuuugauucuucgucacaguauagagcagaccucaaacgcucucccuuaaaccaguuucucucccaccaaauaucaacucucccgcaguucuuuuagcagcuauuuuuuuuuucuacucagcccauuccauaauacaucagucaagcuguguucaaaauugagauuauaaaggcauacuucucuuugagggagagagagcagaggcugugacuaccuauuugucaaccuuauauuuuauuuuaaacauuauacagccuuguggagcuuguaaccugauaggggagaaaggcaaguagagagucaauuggggagaauagagguuguucagaagaguauguauuagguguguguaccuaaggcaguuaucacauguguccacaauugucuggcacuuaaugggcuaucaauaguuauuugcugaaugagugaauguucaaugaaugaucugauauugggcuuccuguccuucauucuuuguuuguuuguuuguuuuugagacagagucucacuuuaucucccaggcuggagugcaguggcgugaucuuggcucacugcaaccucugccuccuggguucaagcaauucucccaccucagccugcugaguagcugggacuacaggcaugcaccaccaugcccagcuuauuuuuggauuuuuaguagagauaggguuucaccauguuggcuaggcuggucuugaacuccugaccucaggugauccgccugccucggccucccaaagugcugggauuacaggcaugagucacugugcccagccuccuuuccuucauucuuagcacuuaucuugccuguugagcugauuuguagcuaguguuguagcagguagauuaguuuaccacugagauuucccuccaaauauuuuuucauuaggcacauggagaugacuguaccuucuuaagaagguagacuuggucuaccauguuuaguucuuagagcaccuugaugcuauucuuguuaugcagacuuuuacauauuuacagccccuucggaugcccugcuguagucucccccgccaccccucaggaaagccuggcuuuaaggugcuuuuccucuauuuuuguauuacuaaaacuuuucaggaauagucacuuguuuggaaaaaaguuuugagauuaauacuaguagcaaaugauaggaucaggguuaaucucucauaccucuggggugaccccuaaguugucaucuuuacucuugauuucuguaaucuuuucuaagaauuuagguguuacaucacuucaaacucaguaugccugaaaguuccagaaucuugcagucuucuugucuucuggccuugaaucuuggcauuauuuuuuaguuauucuucuuuaucugcuauuuagacuucaacuccuauggauuauuuucucuaaaauguguuuaauaccuauucuuuauuuguuauuuugacugguacuuccaccugagccuauuuuuauuuauuuauuuuugagacagggucuugcucugucacuccagcuggagugcaguagcccagucagggcucacugcagcuuccaccuccugggugcaagcaacuuuuccaccucagccuccugaguagcugggaccacaggcauguaccaccaacacucagcuaauuuuuaauuuuuuuuguagagauagggaucucaccauguugcccaggcuggucuugaaccccugggcucaagcaguccuccugcuuagggcucccaaaguauugggauuauaggugugagccacugcaccuagcccaccugagccuauuuaccuugcugucugcauucucccuguuucuacugacuaccuuucccaauuuuagccuccuaaauuuuucuucucagaacaacauucauucauucauucauucauucauucauucauucauuuaugagacagagucuugcucuguugcccaggcuggaguucuguggcacgaucucggcuuacugcagccucugccucccggguucaagugauucuccugccucagccuccggaguagcugggacuacaggugcaugcuaccacacccggcuaauuuuuguauuuuuaguagagacaggguuucaccauguugggcagacuggucuugaacuccagcaaucaagugauccaccugucuuggccucccaaagggcugggauuacaggcaugagccaccacgcuugacccucagaacaacauuuaguguucauccugcuuggccacaguaggcccaggagauuggaacccacguauacuacuggugggaauguaagugcagucauguuggaaaguagucugguguguccucagaaacuuaacauagaguaauuauucgauccagcaguucugcucauaaguauaugcccagcagaaaugaaaacguaugaccacacaauaaauuauacacggauguucauaguggcuauucauacuaaccaaaaggcagacacaacccaaauauccaucaauugaugaauggauaaacacccucugauauagccauagaauuuaauauuauuggggcauacagaugaaggaaguacugauauguuacaacauguaugaaccuugaaaacauaagugaaagaaaccagacacaaaaggccacauacaagaauccauuuauguaaaauguccaggaucgggaaauuuauagaaacagaaaguagauuagugauugcuggggguacuggggugugacagcuggaguaugagguuucuuuuuucuuuaaugagaucaaaaucauauaacauaaaauuuauuauuuuacccauuuuaaaauauacaguucagugguuuuuauuacauuugaaauguucaaccauuacuacuaucucagaacaugagccgggugugguggcacgugccuauaaucucagcuacucgggaggcugaggcaggagaaucgcuugaaccugggagguggagguugcagugagccaagaucgugccacugcacuccagccuccugggcaacagagcaagacuccaucucaaaaaaaaaaaaagaaaaaaauccuauaccucuuaaguugucacuuccuacucuucacuuucccuagaaccuucugaaucugcuacaccauuuuacauuccugccagcaaugcauaaggauucaaauucuccaaauccuugccaacaguucuuuuuuuuuucuuuuuuaaauauugcuauccugguggguuugaagugguauaugaaugugauuuugauuuccacuuucuaaugacuaaugauguuuaauaucuuuucauguuaugauuggccauuuguauaucuuccuuggagaaauguuacuccuaguuuauugaguauuuuuauugugaaaaggaugcuggcuuuugucaaaugcuuuuucugugucuauugaggugaucauguggguuccccugcuugguuucuauuaauaugguuuauugguucauuuucuuuuguuacacuacucuuguauuucuggaauaaaucccacuugcccacgacauaugaucccuuaauauccugcuggauuugguuugccaguauuuugccaaggauuuuugcccguauguuuauagggauguuggucuguaguuuacuuuucuuguggugguuuuuuuuggcuuuuguaucaggcccuauagaauggguuaggaaggguuucuuuucggggugauaaauauggucuaaaauuguuuguggugcugguuguacaccucugugacuauacucaaaacuauuuaauuguacaccuauaaugggugacuuguauaucuccaagcugcuaccaaaaaagcaaaacaaaagaaaaacaucuucaaggagcuucucaccuauauucuuuagcccaagguucuuuuucuguucuucaaagcccucagcacucuuucuagcugucauauuucagcauuaccucugauuuaucuuuguguauaauucugauccagugacaguggucauuucacugcccaggucaccaacuccuacucacaaugacacaggauucuuuuccuggucacuuugcaagcuggggaccuucagcuggcgaugucccaucuggaccucacuuggccaugcuaccugcugcaggagacgucacauucacuuggcccuuccaggucgaaucuagcuuaugcacugguucccgaguucuugucccacgcacugguucccgaguucuugucgcgcacccaagaagaaugaggugcacugacaguugaagagugagcuaggcagggaguuuuacugagugaagaaaacagcuuucaguggagaggagaugcgggaugguccuacuacuugaaggugggaaaguccccccccaaauguggcugaguccagggcuuuuaugggcucagagugggggaggagcaggccaaagguaguauuggaaaagacaacauucaauugguuaaaaagcauuauucagaaagaaucagucaggaaagggugggcaaacaggaacagaagaucucacucuggguugugcguuucauucaggaccagcaguccuggucuuucagcuuucaggcugguuuuuuuggcuugaaggugaggguucacuggggaucugucuaggcauuuggcugccuccugucacuaucaccaagaucuucgagagcauauuguccauucuucaucuucacccugccuuagggcuguucccaucucucuugaagguucuugucccuuuuuccuaccaauggcaauucauucucccuuucagaguuuuauucaaguuucuucuauuuaccauucuagccaauaguaaucucuuggucccaagcccguaaaucuguugauuauguuguuucaguuaaaaaauagaaaggauaagugugaucuagaauguauguauuuucuuaaggagacagugggacagaauauuugaaacuagagcuguucugggaaaccugguauauguguugguaguccuuuaggcaucuuuuuaaaaaugcauuuacaguuaccucgaguuuauagagaaagcuuuucauuuggacuucucugaucuccccaaauacagucaugugauacauaacaacauuuuggucaacaacagaccacauauaggauggaggucccauaagauucuaguggaggugaauaauuccuauuaucuggugacauuguucccaugguaaugucauagcacaaugcauuacucacauguuuguggugauguugguguuaacaaaccuacuguacagccaaucacauaaagaucuagcacauacaguuagguacaguacauaauacuugauaaugauagaugauuauguuacugguuuauguauuuacuauacuuuuuaucauuauuuuaggguauacuucuucuacuuacaaaaaacaaacuuuaacuguaaaauagccucagacauguccuucagcagguauuugagaagaaagcauuguuaucaugggagaugacagcuccauguuauugccccugcggaccuucuaaaagcacaagauauggagguggaagacagugauagugaugauucugacccuguaugggccuaugcuaguauguguguuuuuaucuuaguuuuuaacaaaagaguuuaaaaauagaaaaaggcuuauagaauagggauauaaagaaagaauauuuuuguacagcuguacaauauguuugcauuuuaagcuaaguguuacaagaguaaaaaagcuuuaaaaaaugcaaguuuauaaaguaaaaagacagcuaagguuaauucauugaauaaaaauauuaaaaaaaauuuauguggccuaaguguacaguguuuauaaaaucuguagucaggcugggcaugguaucccaugccaguaaucucagcacuuugagaggccuaggcaggaggauugcuugaacccaggagcuugagaccagccugcacaacauggugcaaucccaucucuacaaaaaauaaaaaaaaucagcagggcagguggugugugccuguagucccagcuacuugggaggcugaggugggaggaucacuggagcccgggaaguugaggcugcagugagccaugaucacaccacuguacugcagccugggugaacuuucaggugaacucaagacucugucucaaaaaaaaaaaaaaaaagucuauaguaguguacaaguguauaguaacaugccguaaaaauuuguaggcuagaaguaauagacuaugccaucuagccuagauguguaguaggcuauaccauguacguuguaaguacacucugugaugcuggcacaaggaugaaaucaccaaucaccuuaaggauacauuucucaaaaacaugauccucauugacacauuacuguaguucucaguguucugaagaaaggcauauacugauauaucuagccaguaacauuaaaugccaggcaagccucuguugauacguauauguguguuuggaagauagaaacaucugcaacuuucauuugcgguuccugguuucucuuaugaaaucuuuuugagaacuuuaugguacuagaguggaaacaguugaauaaaguccugaugauuauaguaaaguccgugggcaaaugugagacaccggaaugugaggcuguuuaccuaaaggcugcuuuuuguaguugaggcuauauaagcaucauggugugaugucaagaauuuaucucacauaaacuagaauuggauuuacacaugguuguuaggcgguugagccagaauccaaauucagguuugucuaacuccaggacuguugauuaaccacuguaugauuuuugcauuuuaugcuuauuaagggaaguuauuuaauuucuccgagccucauuuucuuugacuacaaaaugaacuugauaauaugugccuuacagagauguuucaaagcauaaauauguuuguaaagcauuuagcagaaagcuuucucaccagguagauaggucuuuuauuauuaguaaaauauuuucuucaaaacaaugacuccaacaaaaaaugguuuuugaaagaaagucugaaacuucugcagagaacguugcauaauucuuggaauauugaguucuuuacguuuugacacaaaguuuucauguccguuucucuagaauuuagauaauguuccaaguaagucauuuguuggucauuacuuuauuucccccuauuuuuuuauuuguuauucugaaugaauugcugucaaaaagguaacagaauuauacccugucugucauuaacuucccuuccaaagaauuggagaauaucugacacuugugguuaacugcaacuguuauauauuuaagccuuagguuuugaaguuuauagaaugagguuuagaaaggcugauuuuuuguaguuguuguuggaagccauaauagaaauaaacuagagaagugguuauugguuuucaucuuggcugcagaagaaguauuuguugguguugcuauagaaacauagucaaaacuacaguauugaaagcaucacaaaauaaagcauugauuugguuuccuaaauuguguuucuuguuucggaguuauuccuaauugacuuaaaaaugcuuuuuuuuuuuuuuaauucuuagcugucauaaauauccagauauaaguuuaaaugaaauaaagcucaaaauaaaucaguguucugaauaugaaugcuaaucaucaaaacuuuuaaaaucacuauuauuccuuaguaguuugaaaacauaauucuguuauaauaaauucaaauuuccugcuggugauggugauaaauaguaauuuuaaaaauguauaucuuuauauauuuuagcauaauuuugguucaguuagggauuuugcauaaugaaaaccacauauacuuuuuucuccaaauuuuauuuauauuuuuauuuuacaaauuuaaauggacaugcuauuuuagcuuuuuuaauaaagcuacaauuuggaucaguagaagacaguuccacuaaacaguuuguagggaaaaauagcucugcuucuggcuuuuauagacucucuugcucaaaggaagaacugcuauugagucaguuacaacuucaguggaagaugucuugcagcugugccuuuuugguuuuguuccagagauaguauuugugugcacugucagaaugucuuaaaggcccacccuggaaaggauucaacccuauaaaaggaguuuuguuuuauaaccuuucacauauucuuauggaguucugguggugaugguggucuucauuaucuugucuuuuaaacuggcauuuuauugagacacaggcuucacaguuugagaauaggagcuacaguuguagguauuguaucuaauaaaauaaauuuagucaagcccuuggcacacacuaugaugaaaacaaaacaccccuccccaaacuuugcaauuucagugaauuauuuuuaacaacuuuucugccucuguacugauaaggagauuggcacucauuugauuauucuccuggguaacuuauuuaauagauauugauuuacaaaucaaguuacuauguaagaagaguuuaaaacaccaaugacuucucauauugaaaauuguucggccuguuuuaagccauauguuuauauaaaugcuaggagaauuaucauugaauauauucugggugguugaccauauuuucuccaaaauuucccccuuucuccuuaguuuuuuuccuuuacauuguuaaaauuacaguaaauuuauuuuaaagauuuuaauugguuuuuauuugccauucaagacuggagcaacaccucauucuauaaaauagaaugaauguccgauaagcugaacagaggaaguugcuuuuauagacagaaaagagcugacggaagcagaaacagagaacaaaagcauguugguuguuucaaagugacuuuucuuauaguguuaaaacagaggggacuuccuuaucaugccuaccccuuuggauugguuguugugaauuccuuucuuccuuuuuaaacaacugccccguuucagaguuuaguuugauuaccuagcuccauucuggugugguauggucugcuggagccuagugcaggaggcuaguccaaaacaauggccuccuauaaauuucauuuaacaaaaugcuccaaaguuguuagauccaccccaccccugccccucccccaaucuuucuagcuuccuuaaaccccuuccucucccagccgaugucuauuucccauuacuguucucuuuggccuguggggucaggauguuccuccugcuauugaagguuaaacucuucucugugguuuugauccuuuuccuccaucuuuuuugaacuacaugccauucauuuuccuuucuuucuacuuuguguguugaaccucuccucucuaucucucccaccgaaagacugcaccaaacaaaaacagccuaaacauacaucuccccugaauccuagacuuuuuguaguuauuacuugccuuuucuucauugcuaaacuucagauauuaauuuacacuuaccucuuucccuccccucuucugauauuuuaucuguagccauuagauuuuucuucuccuagccacugaacuugcucuuugagguuaguagccaucuuaugacccuuuuaacccuuauuguucccugaagcaaucugcccuugccccuguuggucaugccuccccguuagacucuucuuucucgucaguaguuucuuguuuuccuuucucuuaaugcugauccuucuuagccuccuugauagguucuuuggucucucugccuggagauuuuugaugagcauuuauccuacugcuuguuuucucuacaguuucaucuaccucugauaccauugauuggcugagcaguuccacauuucagucuggaaaccaggcucugucauucagacacauaccuucaaccaucuucggauuuccaccuggaugucacacauuuucagcccagauguauucaaaguggaagcuuuuccuuccuuccuuucuguuucuuacuuuguuuggaagucucuuucuaacuucaugguaccacuaucuaaccuuugacucacaggaacuugggagcuuuauuuuucauuacucccacaauccaauuaauuaucaagucccauucauuuuauccauuaaauauuuauugauaccaucucuucauuugcauucuuauugcuucuaucuuagucuccuggaucccuggaacaucaucuuaaccaguuuccuuuuuuuuuuuuuuuuuuuuugacagagucucgcuccaucauccaggcuggagugcaguggcacaaucuuggcucacugcagccuccaccuccuggguucaagcaauucucaugucucagccucccaaguagcugggauuacaggcgugugccacuuuuuuuguauuuuuaggcuaauuuuuauauuuuuaggagagaugggguuuugcuauguuggccaggcuggucucaaacuuccgaccucaaguggucaacccaccacagccucccaaagugcuggggugacaggcaugaaacaccacacccggccagucaguuuccuuucauugugucaguuggucucauguggcugccaaagucaucuuccagaaauacaaaguuaauagcauuuucuuauugccugcagaauagaguaaaaacaucugagcuuagcauauugaucaugcauuauuuggguguugcuucccuuguccugucuccuccacuccccaccccuguguuccaggcacuugaaguucucaguguucucuacaaugcauuuaucuuucaugauucuguguccuucacuuacuguucccacggugaagagugugcuucuacccacuuauaauaagcccaguaagcuccuucuuauccuucaaggucaggucaagugucaccucgggaagcauucuuccuucaucaagucuguuaagugcuaaauuguuuaugcuuccauuauagcucuuauucccuuuguaguuagcuauuuaaaugcccugcucucacacugcuggagccacauuuuauacaggucuguguccucagcagcuaucagcaagcacaaagcaauuccucauggaaugaauggaucuuuacaaaacccaaaaguacaguauuaaaaucaagauuucaugggcagagguaauggugaguauaauggcuugauauuagauauuuuuuauuuauuguuuugaguaggugugguuguggauugagaacaucuuggcacuugugguuaggauuuucuaauucaaauuuagagaguuagguuuugaaagugaagcgacagagcuguagucucaaauuauggagagcuaauaaaguuaugaaggacuggaaguacacuggguucucaacaaguggccacaccauugcagaucauguaucaggcagaaggaggauagugagacaggugaagugaggagagggccccagauuggggcuguaccuccccaccacacucuggguuuguagcugggcauugcuuauuacaauacaccuuaauguuuccccagcuugcccugguagaagcagcauucaacuuuauacaacauguuuuuugauaaaagcuuuguguuuacacguuugauguuuauaugguucuagcagagccucuuggaauggugguggcuguuuuaaaguaaaggagagaaaagaaagaagggaaauuauaggggauggguuagguagggauagaauuuuccuucuacaaauugagaaagaaauagauacauuggauugguaggaaauuauuauacauuaauguuugcuuuuuaaaaauaaaguuaaaccauaaugauaccuuccaccacuuuuaggggaaaaggcguagaugaaccuuuugaccauggaaauucuguguuuaacaguaaauugcauucauuuaguguuuugcacuuuaccaguagcuauuaugauucuuuuuugaucuuuaaaacaaucccauuauauagguagguuagcagcugcuacuuuuauguuauacguguagcuaacuggcaacaugggagcauaucucaagcuguuugaggacguuugauguuccuuaagguuaagaagaguagauaauuucuugacaauugcccuuuuauuuuuggagacuuagaauuuugggggaggagggagguuauggcauuuuucaugaguacagaaguuggagcagagcuggggagcauuguagaucucuuggauuccuagucuuagggcuguuuuguuucuucuggcccuuggacaacaaugaagggucucuauucuuuuuuucuuuuuucucuccuuaacagugugucuccccuucucauccaggcaggacaguuugcuacaggaaaaggcauugagauuauuaguaagaaucugacaucuauccuggugagaucuugcuacugauuugcuauguaaauaaucuaacugcugggccuuagauuucccaucuaauuaaaggcaagagguagagguacaugaacauugagauccuuuuagcucugaacuacuuugauucuuuacaaauuccauuuugcucagucauauguagaguauuauacagcugcuagcaagauuguuguuucugcuuuguauguaguggacuuugugguaggugcuuuuguuuuauuucuuucaucccuaaggcaaggugggugucauuaugaccgagugguagcaucugcuccuucaaagugugagagaagaaugaucuuauaauuguaagcuuuauaacgcuuucuuugaccacccaaaggaggugaccauuuccuuugugcccuucuuguaccucucuuacagcccuuaucacauaugguguaaugauuuguuuaugugucugacuugccugcuagacuguaaauguccaguagauucuugugggcaagaacuuucccuaggucuuuagggccuagaccagugucugguguaaagcaggaaugcagcacauauuucuuagacauaaaauagaaugaaaauaauacaguuuaauguaccugcuggauuacuauacuugucugauuguguaauuuaaaaaguggugcuuuugacuuuuguaguuaauuaaaagcagacaagaaggauuuguuaagaguuuuauccuaauacuuuuuagaugcuuccuugguucaaaacaguaacuuuuugauuagagauucucagccaccacucuuuuauucuuuuguccauuuuccuccuucuguaccugcuuccacuuucucucuauaccccuuguaaaaaucuggggucaugcaguaucuuucuuuccuagagucccauaaaucuacaguacuuuucaacauuacaucuuaaaaauguaauuguuuuuaauguaauugaacauaugagucuaacauugcuaagaugucugguagggaagaaacuuugcaggugacgcaugugcaguuguauacauuauucugguuuagagccugagagaaguuaaacugugguauguggucaaagaagaacuugcacauuagagccaaggugcuagugaaaaaaauuaguuuuucugccuacaucagauaugucaguaucaaugauccuaugaaauguggaccauuuuuaaaaacguuaaaaaaauuuuauagaccgacugggaaguucauucauauugaagagucaugaaacuccuguccauguuuguucaggaaguaaucuugcaugacgauugguagaugggaagauuggauucccuguacaaucagaauaaaaaaaaagaguuuuguuuuguuuuguuuuguuuuugagacggagucuugcuuuguugcccaggcuggagugcaauggugcaaucuugguucacugcaaccuccaccucccaggcucaagugauucuccugccucagccucccgacuagcugggauuacaggcacaugccaccgcgcccagcuaauuuuuuuuuguauuuuuaguagagacgggguuuuaccauguuggccaggauggucuugaacuccugaccucaggugauccacccaccuuggccucccaaagugcugggauuacaggcgugagcuaccacgccuggccagagguuuuuuacaaaauuucuucugaguacuuuuuagguuauuuuaguuuuuuuccagaaaauuguguugucugguucuuuucuuaguaggauagaugauaaucacuuuacagaugggggcuagaugagcagaagugagauaaccaaaaggaauucuucuuccucauugucuuuucugugauauugauaacuguacuuucugccuagaguuugugucucuuaagguuuuugagccaugagugacucaucagauuauuggguucucuguaucuuacucauucuuuguccucauaaaguaggagguaggaugauuuuuaaaagucaaauuaugauacuggguuuaagauaaaauucugugucuacacaaacucacauacacaaauguagggaaaguguuccccuccuaaccuuaaccaacuuccuugaauauuuuaaaauuaacuuuuggaggauaaaccuaauuuccuguuuuaaugaaauaaugagacauugucgaaacaugaccuuuuuuggucuucucaaaauacauguaauagauauaaauucauauaauaacaauguuugaauauuaagacauuuguagauguuuccuauauauuuuguguacucaaauguauuuaaaucauauuggaaauaaguaaaugacacuggacgugcuuuguguacuucucugcuaauaacccaucaaguaaccucacauguuauuucaccucucuggguucacuugacuuaucuggaaaacaagaguguuaaaacggcugccuugccagccuggccaauauggugaaaccccgucucuccuaaaaauaacaaaaauuagccaggugugguggcgggcaccuguagucccagguacucgggaggcugaggcaggagaaucgcuugaacucgggagccugaggcagaagaaucacuugaaccugggaggcagagguuguagugaacugagaucgcgccacuguacuccagccugggagucagagcaagacuccaucucaaaaaaaaaaaaaaaaaaaaaaaaaagaaaagaaaagaaaaaagaggcugccuuaguggaaaagucuauuggcuuugagggcagaccaaauugaugugaauuuuggcucuaccacucauaaguggguauaugaguuugagauucaauuucucuagguucuaauagucuaauuuuuaaauucacucuauuaauaguucucuuucaaaaucauagugccacaaaacucauucucucugaauucucccaacguuuuuuugaacaaugagauucacaggucuccugaguaggaucuuuugaagccagggaggagcugagcaguagcauuggguuccauagcuaagaaguaggcaucuuagcucgugcugccauaauaaaauaccauagacugggugacuuacacaacagguacuuauuucucacaguuacucuaaguuguagaauuucugguaagggcucuucuuugcuuacugacaacugccuucuacugugcccuucaugguagagagagaaugagagacugcacaaguucucuggugcuucuuuuuaugaguacacugauuucaucaugagggccccacccucaugaccuuaucuaaaccuaucucccaaagcuccuaccuccaucacauuguggguuagauuuaacauaggaauuuuagggugaugcaauucaguuuauagcaguaggagaguaagagaguaagagaagagagcaggagacacagggguguuaagaaaugcguaggauggaccagaagaucuaccacuguugaauucauagggcccagugcugcuauagguuagaaguuuucacauuucuggauuacauggaguuacaaauuucagaaaaaagguugaaagugugaacccugaauaccugacgacaugugcccaugguggucagagcacaguuugguuuuauacauuuuagggagacaggaaacaucagucaacauauguaagaugaacauugauuugaucuagaaaggcaguggggagggggcuuccuggucacagguagauaagagacaaaugguugcauucuucugaguuucugauuagccucuccaaaagaggcaaucggauaugcauuuaucucagugagcagaggggugacuuugaauagaaaggaaggaggcagguuugcccuaagcaguuccuagcuugacuuuucccuuuagcuuagugacuugggggccucaagauuuauuuuccuuucacaaaggcaauauuuuuccaaguuaaguauauuguaacaaauuuacaguuacacuagcaguauuuauuaaaaaacacauuuaacauaaaaaggugggaagaacuuaaucugcauaagggaugaugcucugaauugaauaaaauuggcucuacuaaaaaacucaccaaauugccccuuugugaaccaaugaaaacuuuaugauggguaguaaaauuuacuuccacuauguagaaugacuuaaaaaaaaaaaaaguuuugugucugcccauuuugacaaagaugaauaucucuucagaggugccauggaaacuuuuaccaaaauaaaauuuuuaaaaaagugaaaaagugaagaagagaagugaagacuuccaucaagucuucccauuaagcaaaccuuacuuuuuaaaauuuuuuauuuuuuuugagauggagccacucaggcuggagugcaauggcacgaucucggcucacugcaaccuccgccucccggguucaagcgauucuucugccucagacucccgaguagcugggauuacaggcgugcgccaccacacccggcuguuuuuuuuuuuuuuuuuuuuuuuuuuguaucuuuaguagagaugggguuucaccaugguggccaggcugguuucgaaucccugaccucgugauccacccaccuuggccucacaaagugcugggauuacauuacaggcgugagccaccacgccuggcugcaaaccuuacuuuuucugcuaguugguacuggugacaucuuguuuaucuguuaauaaauaucuaaagcauuuucuuugcgauuuacaagagacccauuaaagacuuugcuguaggugaaugugaacagauaauuacuacugcuuugcaggagaguaacacaguaguuggguaaagcuguagaaaugcacaagugcacuuauagucuaucugaguccugaauugucaaggcaaauauguguguugggaaaaaaaaaaacccagaauuuaaauuguggaaauguaaagggugguugguacuguagaguuaaggaacauuaguuauuucucagauugugcugagcugaaucuuagaauugacacauuuucuuuuagugacuuuacauuuauguugcuuccauauuucuuuagagucauaugauagguggauguaguauuaucuuauuuuuagucauuucuccuuuuuuuuuuuuuuuuuuuuuuugagauggagucucauucugcugcccaggcuggagugcaauggcgcaaucuuggcuuacugcaaccuccaccuccugaguucaagcaauucuccugccucagccuccugaguagcugggaccacaggcaugcgcuacgacacccugccaauuuuuguauuuuuaguagaaaugggguuuugccauguuggccaggcuggucuagaacucuugaucucaagugauucguccacaucggccucacaaaauucugguguuacaggcaugagcuacuggaccuggccauuuuuagucaugucucaauuuaggauugaaauaugaaacaaggauuuaacagcuuuauagcuacaucacgguaacuauacuaucuagguuaaaaugcaccuccauuuuuauguacagguugaaugaauagacauucuuguauaaaugaguugaaaugaauauuuuauuuuuuaauguugaaauauggaugauauauuugcaguuuuucuauaucugaaaguuugucuauaguaauuuauagauaaaaaugaguaggcuguacaguaggccuccccuuauucauaguuuugcuuucugcaguucaguuaccugcagucaucuguggucugaaaauauuacauggaaaauuccagaaacaagcgauucauaaguuuucaguugcaaaccauuuuuaguagcaugaugaaauaaucacacucucugcuccauccugugcaggaugugaauuauccauuugcccaguggcuccauguuguagaagcagccacuugucaguuacuuaguagccggcuuggugaucagacugacuaucgugauaucacagugcuuguguucaaaucacccuuauucuacguaauaaaaguacaagaauagugauaguggccauuugaauaugucaaagagaagccaucaggugcuuccguuaagugaaaaggggaaaguucuuaaggaaaaggaaaaaaaucgcaugcugagguugcuaagaucuaugguaagaaccuaaucuucaaccugugaaauugugaaaaaagaaaaauaaauuugugcuaguuuggcugucgcaccucaaacugcaaaaguuauggccacagugcauaagugcuuaguuaggauguaacaggguggccggacgcgguggcucacaccuguaaucccaacauuuugggaggccaaggcagaaugaucacuugaguccuggaguuggagaucagccuggucuguaacauagugagacucuaucucuacaaaaacguaaaaaaaucagcugggcguggcagugcaugccuguggucccagcuacuugagaggcuggggugggagugggaggauuguuugagcccaggaggucgaggcugcagugagccaugagugugccacugcacuccagccugggugacagggugagacccugucucugaaaauaaguaagaaaauuuaaaaaguacaaggcauuaaauuuguggguggaagacaugaacagaagaaacacauuccaauugaugaguuggguuugguacugucaaugguuucaggcauuuacugggcuucuuuccccgaggauaagggggacuacuuuauguuguguacauauacuuuuggugucuauucugggaugaauuaaaaugacaaaaauaaaaacaaaguugcaggauggagacucaaagcaaagcaaaagucauaaccaggaaaacuaaaugagaaaaaaucucaggauagaagaauuuuauaaaaauuauagaauuacaguugugucauuaaaacugguuucuaugccgaagguucuucauucaguggguaaaacaggcagcaggaagcugacuuuuuucuuugacccaugugcauuuucuagcugaggaaugaagugacuuggaaccaaacugggcuuuucuacugagcaugucccucuccagcagggucuggcuuggguggagccagucuugcucguuaagcuuuuggacgcuggauuuccaucagcuuuccacaguuuuccaaugacaggaaauagcagacagcgggcuugaugugcuuaaaagcugcguauguauuucaaggggggcgauuauuaggacauuuuuguugcagugguuggguuuugugauacaugcuuguuuguuucugcuuguggaggaaguuugcuauugaaagugugacuagucaggggacugaaaauuaggaaaauacuaauguacagaguagauggaaucuggguacguacacuguuucgcaagggaauauguugugauauuugaacuaagcccugugaaaaauacauuuuuccauugggccgaguuuaguuuuagaugacuuguuugcauuuuucuaggcaaauguugacuuuugucaggcuaucuuuaacaugauagcuuuuucagguuugaccuaugagaauaaugaagcuaguugguuucuuuuauaugcuugucugguuguuucacaauuuuuucagugguaugacauaauacuguacaaaaucaguaugauauuauuucuggaagcacagugaggacuauguaagguuaauagugugcaguuacuuucuuuuuagcaucuuaaagaguaauaacuuucaauuuacuuauaaagugcuucauuuucacccuaacuuguuugauuaaaagaaguuguacuguagcuaucagagauuugaguucacaguuuuuagcuaauaaucuguagauuauuagccauuaacaguuaccaaagucugguuauugguuugauauugucacacccuaaguaaauacugauagaauaagaauagguaucaacaucuucuuuuauuacugaauauuuaauugguugucacauugaauaaaugugaaaaugcauauugcccagauucugacauccagacuugggaaaaaaucuucuugcguguucuuuauauaaucuaacagucuagcagucuuuaaaaagauccuugcuucauugcgacuuacugacaaaaugaaaaacagggccacuguaauuagcagaugaccucugcgauuccuuuuuuauuguugacacuguuagggaugcucuauaucacugaaguauuuaugguauuuugagggggguacauguguacuugggaaguuuaaguuuuccauuuuuuuuuuugucacaaggaagaauugucucuucaaauuauuugcaacgugggugugggugcugaauaaaugauaacuguugaggugaugcugaugaccuggacagccaaucaucccccacaucugcuuuguaguguuccuguacggaugauauaauauauuggugaucuauaguuuaguaucauagcaggaucacaaggaaaguuacauuggaaagguaaauuuuaaacuuugacguugguuuugcuugcauuuuuugguggacuccagacguugaaugccugacauauucuccagcaugauucucuaccaaaucacuuuugcaaauguugaacuucaagaauuuuaccucuaaaaaaacaaauacauuucacugaaguaaaaacguauucuagccaccaccaccuaaaaauaguuauuugaaguucuugcuaaguaguucugaacuaagugaauccucggaguagaaauacuuaacuuuaaaaaaaaaaaaaaaagguuuuauagcacuccaaauggcaugucuguaauuccauuguaguuacagcuuuucccgccgagggaaaguugcucuuaucaagccaggcuuggaggguccauaauuuggauacucucuggcaccuucugcugaucagccaguggacuggggccaacauuuggauaugcuugcuuaagcuagaagugucauucaguuuauagucuuaguuuuuagaauauaugcuauguauugguagaacucuuuaguagugcuauaauuacuuaaaauggcagaagaacuaacggccaaaauuuaaaaagugaauuauauuuuuuuaugagguuuagguauuuaugccuguugacuacagcauuccaaagcuuauagagaagaggauuugaaaguaugagaucaguguaggcuccagcuugguggacuugucauagugugggggaguugauugacuuugacaagcuuuugucuuaugaccuauuaaaaugcagcgucugcagccugugcguuuauccugugcaguuaaccuugguggauuugucguuugcuuauuugggaaaugccucuuguaccacuacuguuauuuuuuugaguuugauucacacagaaauaguauuagacugguuguugauuacuguuggauaccaagugggcacgaguuuuaugauggggcugaggagccauuuuaugcauaagauaguuguggggugagcuuaggaaaaauagacucgcuggcaucugucaugaucaugggaguuuguugguauuggccgugcucugguuugagcuugguuaugaugucacuggaauaaacugcacguuagcauuuuuuuuucuauagagcauuaauagggggguggcccaaauaaauguucccuaaauacuaggaacaucacaaaagauauuuaucaggaagccacuggaugcaaacacugugcuaggaacauguaguuguuuuaucugcacaaaagcuuuacccucuucauaugaauauaguagcagaugggcagggaagagguguggacaggaaacugaugacaagcuugugcuuucaggccaauuuuauuccugcuuuucccugugaggaggaagcugcugaaagagauuggggaauguuuauguaugaccagcuuagacauuuaauaggacucuucccauucuguuuacucugccuuuaaaaaaaaauguccccaacuuucagagaacucuauuuccaagugccccauucccagcccuccagcagagaauacgaauaaucuuuuuacgcugccugcauaugcaccgguauuauuguuagcaaaagccaguuguuuguuucaaguccacacugaggaaaaaaggauaaaaaacaagcaacguuuucucaggaacuguaauugacucuugaacaacaugagcccacacugcauagguccacuuauaugugaguuuuuuuuucaguaaaucuaaucagcccuccauauaggcaacuucuguaucugcaaccaaauucagguugaaaauaacuguguuuguagggugcuaaacuuggauauagauggcugacuuuuccuguccacagguucgguaaggcugacagcaggacuugaguauguguggauuuggguaucuguggaccaaucccccacagauacugagggacaacuguauuuuuuuaaaugaagaacugauacacuucuuaaaaaaaauguugcugcacuaaaagcuuggguguugagcuuaaacuacuuaggggaacaaucuagauuggggguaagugguggguuugugaaauauacugaagugaaggcuggcagaaaucagauucuuugaggauauagaaacagucuuaaccuucauacgcuaggaaauccaaagcuuaggccaucuuaaugcuacugcugagcuggagucgauguucauuuguguggcuagagcugugugacaaggcaaauuggcaucguggcuugugggagucauauuggcacguguugucuccaaggaagcuggcuaaccaagcuggguucacuuaaugcauaaauauuguucuccuaguaaaguacuuaaguguuuaaguuuaugaaaacuucuguucauuaaaaacauugucucccauaucuguaccucggcagucaucuacccagcaccacccuccauuccccauaaucacuguuguuacucucuugcauucuuccccaguuucuuuacucauuuaaaggaaaauguguguguguaugugugcauauucacauaugcauauucgcauccuuuauuuguguaucucccacacgcuuugcuuucaaccuauaagaugugaugucuguauaagguauccuauccauauaaagugaccuaucacuuauaccgucugaaucuugcuguuuguacuuaacaauguacuuaauaauuggaguuauuaucccaaguggggcggcagccuuucucaucuuuucucuuuacaguugcauaguauuuuguuguaugaaugugugguauaagacccccuguugauggacauggauccugagcuuuuacaguguuguagugagucaccuuuacauaauuauuuuacauaugcacagauauaucuguaggauaccuuaccacaagcuuguccaaccuguggccugcaggccgcaggaggcccaggaaagcuuugaauccugcccaacacaaauuuguaaacuuucuuagaucauuauuagauuuuuuuuuugcaauuuuuuuuuuaaagcucaucagcuauuguuaguguauuuuauguguggcccaagacauucuucuucuuccauuguggcccagggaagccacaagauuggacaccccugcauuaccacaagcaggauuacuaguuuaaaguguggacacauuuggaauuuugaaagcuauuggcaaauugacuuccacugggcccauaccaguuuauucuucugcuagcaauuguuugagaaugccugcauucccauagucuugcucaaugagugcaugauuaaacuuuuggaugucuccauucugaauuuuuaguuucauuucuuuuacuaagagugugacaaguaccucuucauauguuuaugugccacuuguguuucuuucuuucuuuuuuuuuuuuuuuuugauaacuguuuauccauuggccacuuuccccaccauuggaccgaugauuuaaauuggccuagccaaaaauuuaaaaauaaaauuuguuuuuuauuuuuuugauguugaggcaacuuacaccagacuuguuuuauugggcuuuuuuauucaaguuacuugaauucagauagagaccaaauaaaauugagaaggagaauuaguccucuccaaaaaucauguaaugacuauuuuguauguuaugaguguuuaaccaguauuuccuaugaaggaccauucauugugugauuuccugaagagauaacaagaaaaucguggcugcuuuucaaacuaguaguaauuuuuaaaucuaaauuaccaagauuuaugaauugguuacaaguuguuugacuaugaaugcuaaucuuauuaccuaugucucccacuauacugagagcaggauucuuucaucuguauuacuggugccuggugcauaugcuuugagaguacucaauaaacacuugucuugaaagaaggggauaagauacugaccccacucacauccugauggucacuaaaauucaugaggggugguccauuagaacaugcugcuaaugauuauaaagccccaaaagguagugguaauuaucaguuucacuuuucagcaaaucauuaacugucgggcaucaugcuaggugcaaguuauauaguagugaagucguuuugggauugaaggcaguguuguacaaggucuuuagagcuggacggccuggguuugaauucuggcacuucucuuuauugguuauauggcuuugaccaacccaucuauccucuuuuuaccuucuucaucuguaacaugagaauaauuucaguuccuuccuagaagaguugagaagguucgaguugcugcaugccauguuucuagagcaguguuuaacaaauagcugauauuaucaugauuauuucuguugugauuacuguuauuacuaccauuauuauuauuauuauuauuuuaguaaacaaauauaguuauuuucuuggcagaaucucuaugugaugacaguagcugaucauuuauuaugaauuuauuaugugccaggcacuuuauguauuauagcaucuaaucuaaugcuuagaaucaaccagugaguacauuuuguauccuuuuuuuuuuuugcuuaugaggaagcugaaacucagcaaggcuaaaauaacuugucugcgguuacauggcuaauaagcagagcugaaauucuaauccuguuuuauuucacagucuucaucuccaagccaccaggcuauuuuauucagacauagguaacuucucacagaaagaauauagcuucaggcugggcgcagugguucaugccuguaaucccagcauuuugggagacugaggcggguggaucacuugaggucaggaguuugagaccagccaggccaacauggugaaaccccaucucuacuaaaaauacaaaaauuagccgggcaugguggcaugcaccuguaaucccagcuacuugggaggcugaggcaggagagucgcuugaacccggcaggcggagauugcagugagcugauaucaugccauggcacuucagcccugggcgacagagggagacuucgugugaaaaaaaaaaaaggaaaagaaaagaaagaauauagcuucagcuuugauuauuacacagaauugggccucuaccugagagaaggaauuagagcagaugcaguucaccaagauuucugaccauacaacucagugugcauaauugauugaugagaacucagcaggguucuggaugucucuagauaaucucugcuaguguguguuguuggauugccaguauuacaagguuuauaugcauuaugguuaugugaauaaaaauacccaauauuagaguccuucaugauuuauauauggccucugguuguuuagcuuuaacuucaggaaaucguaucuauuuccaagauugccuuaguugcugguggagaaugcuuugccuggcacaggucuuuuucuugucuccauccuuagugacagcaguaggggcuuucuuucaacaaagaagauuguuaccuugauuguuauugcaacuggauguuauugaaaauuaugccuuaguuuucauauaccccugucuccaacauaugaagaaagggacucauauguugauaaaguaagauuuuuuuugguuucauucuuauuuagaguuguuagaguaaagaauuagugauuuaucucacuaauauuaacucaaguauuagguuuuuaaaaauugaacaucauuuggaaaaaauggaauacuuugacaaccauagcucuuaguuaugaggguuguaaaaugcagugggaguaauaaugacccaagaucuauauguacucucaguuucuuaauccuuauuuucuaaugcucuccucagaauaugcagaagucaacaucaagauguuuuugacuacaaguaacugaaucccuggcucauugagccagagaggaguaugugauuucacaaacaggaagcuccagcacaggacugggccauguguggcgcgaucaaggagcugguccucuucucugugauucucuugccaguguccuuuguugugugucagugugucaucaggcuuauucuucucuguggauucaagaugacaacagcauuuaacagaguuauguauacaauguucagagacagcagaaggggccuccucuuccucuggcucuuuuuagagggagagauccuuuuccagaagcccaccaguggacuucgugcauauuuucuugccaaggggugggagacuaccaugauugcccuagaccaauagaagcuacccuugaggccaaucuggagcuagccucuauugaaacacauguggaaggggggaaaguggaacaaaauuuagguucuauuaaaaaggagaaagaguggaagaaauauaucugaaugucaccugaucccaucuagacuugaacuagggaagauuguaguucauauguuuuguauguguggguuuaauuuaaaccggauauuaguuuacaucuuuauaguaauagcucugucuaauaggucccuuauccuuuuaaaaauaaauaaacaagugauauaguggguuauaaagguaacuagggugagcagcauuggauuacuuguucauccuccccauauagauaauaugaacuaacaaauagucccuuuggaauguauuuauacuuacuugaauaugaaguaugguauuuucuagaccaucugacacuuaagaaacauaaaccugugaggguaaggacuuacuugcacucugcucuaagucugccuguuuuuguuauuccuucuuccucuccagauauuucuucuuccuuguuccccuucccaccccacuuccuccuuccccucugccccaccucuccugccucuuccccuucuccuuuuaaaugaugaauauauuugagaagcaucaccucuuuauuucccaaguagaguuagguggcugcugaaucauuucuacauuuguuuuuuuucccucacguuugauggcaucaaauagugcauuauuaaaagaccuucucuuucaauagcuauaggcccuucggggaggugaacauacaagcacgugauuguggguaucagcaggaugcucuacauauccucuacccacaagcagaugaaaacuaguuuuauccgauguagaaaauggccagaacugucuacacauugccaauauguuuuaaguucaaugguuauuuguugcaaaguuuuguuguuuucucaaagcucaaaugaaagccucccuccauccucuugcuaccauuuuugaagcuuagaaauacauaccuucccauuuugugaaucuuggauccuuacaaaauggguugagcucucuugguagaaauuaaagacucucauauugcuugugaucucagcaaagaaugggagcuacucagcuggcagcagcaccuacccuguucccugcucagggguuuuguuaacaguaaggucccaguuuccucaauguuuuaaggaaacaucugaacccaagaauuagcaugaaccccuugcuugaaguuguuuguguguuugugagguuguguaucugcuuugcuuugcuugcuguaguauucugauuaagggccaauguuuuaaguagcaugauguuauaugguuggcaguucagccuagugauagagauagcacauuagaauuuaccuccuuuuuuaaacguuggaaaaaaaagaauggguuuauguaacacagcuccuuaccuaaccaguacugauccucuauugaugaugguuuucugcuucauugcauguuaaaugaugcaugcuuuuucucaugaagcugucacaaugacgaacacuuuuaucaacccagauggagcaugccaacaugguaauugugucaaaaccacaugcuugucuaaugggcgggcuguucacagcaguguucuuuuuaguugaugauaaguagaaagaucauuacuuaauguauuauauaacuauacuaaugauggauuuuggguaauuauaauuaaauauuagucaaugagcauugccagaguuugggaaaccuuaguuccaguuuuggcuugcccaucugacuuuaccaucucaggcaaaucuccuggucuuucugauccucaguuugguuguugauaaaauaaagugaggauauuagacuagaugauugaacaauacucauuuaguaaguacuuaauagauaccuauuaugugccagucuagaugcugggaacauagcaguauauaaaagagagaucccagcccucauggaguuuucauuuuagugggaaugucagcauuccacuacaagaguucucauuuucaugggugauagaguuuaaaggcuuauccacauaugaaagaaacucaggguuauaggcaugauaauuagggugaguggauguacuguaaucauguuuucuugauggugguaauuuguucaagaagccauuuuaucaacaaagaagguaguguuuuguuuugagcucuguugaacucuugaaacuguuucaagaauauguugaguaaugauccaauuagucuuuuccauuguuuucugucuuguaacuuccauuuggaugggugacacugaucaucacuuuugaggcucuuaacccuuauggguguugugaauacaguggugauugaggaugacuucgugaggcuuaaccauaugguuuugucggugcucuuccugucuguauuuguacuuugucuucagugucugucaaccagcucaguuaugauuacauggucaagcaauaacguacaaaugggauuuucuuuguuauuuaaauucaucuauaaauuucuuacuuuuaagagagaauauuuugaauaaaucugagaauacauuuauguuauuucauagucauuuucacuaacuggcaggaaccuucuuugaguacuaggccaaggacucugugguugaguaggucauucgugcauaauggagcugugauugcauuaugaagugugugugagggaagguauacacagcugugugguucuccauuaguggcuuuggauaagugacuacuguuuauuauuuguaaaacagggauaauacauacuuuguagaauauuuugagaaacagauuaugggcacugugucagacaguaaacagugaguggaaacccuuaugauuaaaauauaaacaacuauuaaugcuuuuaacauaauaguggaaacucaaguuuuauauuucacugcuucuaaaauauuuuggccaaaaaucagccuuaguugauugguucccagacuauuucucacagccaaaguaauuagagagcugccaauuuaucuugguuagcuuagacaaguauggggcauuuugguuuuaauuuuaccaggacauuuauucagcucucagaauguaauuagagagcauauacuagaaauacacuuugguuauuucaugauuaaaguaaauaauauuguccacuuaaauaguacaugggaaaugguauguuaaagaaggaaaaaagguuuucugugcaauauggagccaguuuaccuguccucgggucuugcuggaagacauacuuuugaauuucagaugccugagaaugagaagcagcaaagaauauguggguauaauaguuaacuauucccucuuacguagcauugcugucagggauauuacugucuccugaucucccugccucacuacauauuucuucuggcccucaugccuuuucuucugccucaccuuauauguugauggugauaagagcucuuuuaaggauccucucaguuuaagcuacccuuuuucucuaggugauguauccccaugugaugacaacauccaaacccuaucucuaguguguaucuagucuccaaucaaaaccugugugucuuggggucaucuagacaucuccacaaccucucaaucacaaugaauucaaaauugaauuauaugugucagccagacccacuuuuacagguguuccccauuuccaugaaugguucuaccaucacccuagucuuccuugaccugggccuuuuccuuagcucuuuccucucuuugacuuucuauauucagcccggacaucaagucauauccacucuaccucuuuaccauuagauuaauuucuuguucuuuacccuacuguuucugcuguaguauauauagaccaucgucuucucaggucuggaucaaccagagaucagaucaacccaaucuccuggaugucuuucugcuucagucuuuucuuucauccugugcuuuacagccagguugcgcuaagugaaaugagaaucuuauuacauuucuccucuacuucaaguacuuauguaacuucucauugcuuuucaaauaacccccacauugccuuuaaaauaacacaaaaucuuuuauguuuuggcuucugccuuccuuucuuacuucauuauuaccaguucagcuuccgccuguccugucuucacucauaagcccccacuucacuuguacaguggauuauuguucugugccugugguuuccuuuuuuaugaggaauguucucauguuuccacacaacucccuaugccugacacauaccuuccauucuggcuauuuugucugaauaaugaguacccauuuaaaaaauaaacucaaaugucaacuucugcagaaacgccugccuggugacccucuucuucuccuaaccuggcuuaaguccuuugcuuuuuuuuuuuuuuuuuuuuguuguuguuguuguuuugagacagggucuuguuuugucgccuagacuggagugcagugacacaaucucggcucacugcaaccucugccuccugaguucaagcuauucucuugccucagccuuccgaguagcugggauuacagagacgugccaccacgcucagcuaaguuuuguauuuuuaguagagaugggguuucgccauguuggccaggauggucucgaacuccugaccucaagugguccacccuccucgaccucccaaagugcugggauuacaggcaugagccacugcaccuggccuaguccuguguuuuuugugcaacaugcuauugacuuaauguaugcuuauuuguagcccucacucccuuagcuccucaaagguugucuuuauucaugugcccaugaacuuaccacaucguagaagccauuauauaggugaauugacuugacuguuuuugugguugcauauuagaugugaaaaacauuuuuaaguuauuuuuauugagaaaauuuacauaucacaaaauucacccuuuuaaaguauacaauccagugguuuuggauauauucguaagguugccagggggcgacggggaaugcagagugacuacuaaugggcacaggauuucuuuuuggagugaugaaaaugcucuagaauuagugguggugguuguaccacuuugugaguauacucaaaaucacuaacuguauacuuuaagagggugaaauuuaugguacaugaauuauaucuuaauaaagcuuuaaaacaaguguacuuuuuuuuuugacuuauucaaguuuguaccacuuaaaaaguuaacacaauuuuuuuuuuuuuuaagagauggggucucacucuguuucucaggcuggccucagacuccugggcucaagcauguuucuugucucagacucccaaguagcugugacuacaggaauaaccauguccgucucuuaaguuuuuaccaccuuugaagauagcugggacacuacucguuguccagggugccaggacucugggcacuuauuauuggcaagggaggggagagcgaaugugaucggcuaucuccgcaggccccgccuguuguucuuuaugucagcgugcuguaacacuuuaaaagucccucuuugcuuauguaaaauuuaguuauuuucagaauuuauuuaaauuuuguucuaauuaguuaugauaagaacaaucgucagaugcauuuuuuccaccucauaauguccucauuugguuuggauuauggcccuuaaauauuuuucuuauauauagaaagaaaagugugauuaugguugggugggauggagguucggaguuuugauuagaauuugaguaccuuuuccaagauuaacuuuugcauuggaacagugauggugaauuacgggauuuaauauuggaacacagaauaauacauuuuuguuauuuuaccuucuuggcuguuacacaccauacacuuaaaacuguuuuuucuaauaccuaacauuuugauagauuuuggguuuaauguaugaaauuguagugaaaugugucucauugcuuucuagcacuguugauaacaucuuccuguuacagaauaaagaauaccaaguacagauaaaaguaauuuuucuuaaaaaacuuggauuuuagauaucaauuauuguuuauaacaaguugaaaccaaauaaaaguaaucccuguuucuugaguucuugaugauuuuaaguucuagcuauauggaacucagaacacacagaguucuauugugaugcuaguuuugggucugugaugcugauagagaauucuaaaaguucgagcaacagucuccauuuugucuugugcuuuugaaucuucuuucuugaugugcuuucucccugucaucuguuacucuucuucucaucuuuccuuaccaugccccucgcaaccaaacuaaauuugagagaacuuacaaaaugacauuuuaugauuuuuguuuugauuacagcauaagcuguggccaugacuacugaaguaggcucugugucugaagugaagaaggacucuagccaguuaggaacagaugcaaccaaggaaaaaccuaaagaaguagcagaaaaucagcagaaucagucuuccgauccagaggaggaaaaagguucccagccaccuccugcagcugaaagccaaaguagucuacgccgccagaagagagagaaggaaacaucggagagcagggguauuucucgguucauaccgccauggcuuaagaagcaaaagucauauaccuuaguaguggccaaagauggaggagauaaaaaagagccuacccaagcuguuguugaagaacaggucuuagauaaagaggaaccccuuccagaagaacagagacaggcuaagggugaugcugaagaaauggcucagaagaaacaagagauuaaaguugaagucaaggaagaaaaacccucagugagcaaggaagaaaaacccucagugagcaaaguggagaugcagguauguuugggaauaauugccuggaaaugaaaaccugauagcguaaccacauaauaaaaaggguuuguuuguuuuggaucauuuccagauuucuuguacugagauacugcuuuagcuuaauguauacggaaugggucuuagauuggucuaccauagccuuucccuguuacuccuugaaaaaaaaguccccuauauauaccaauuacuaaaaaauucaugucuguaaccuguuuaggugagguagauacuccgagcccugccaucucuuuuuuaaacagaaugcucuuuuaugccucuuuaaguuuucacuggacaguaaguaguagauuugugugugcgcauuuuaguugccuaacaaagccuagguuuugccaugguauaagauuuuaauuggaaauguuauuauuugagaugauacuuaaauuguaguugcugggauguaguuucuuugauucauuuaaugccaaauaaccaacuuggcaaaaugagaauuuuggccaugaaaagaggaugaggggaaauauccuuucuauuggaauuuucaagucuuuaaaaaucugaaaguuacaguguuuaaaguaacgauccuaauucuuaugaaagauuuuccuuuuaguauguugucaucugcaaggugguugacuauaguaugaauuuauuuuuuuuuccucaacagccuacugaauuaguaaguaaggagagagaagagaagguaaaagaaacacaggaagacaaauuagaaggaggagcagcaaaaagggagaccaaggaagugcagaccaaugagcugaaagcagagaaggcaucucaaaaagucaccaagaagaccaaaacuguccaguguaaagugacccucuuagauggcaccgaauacagcugugaccuggaggugagauagggagcugagugagagcuagcuugauauguggauuguggcauggcaugaugaauagauuuuuguguuuuauuaaguuccuguaagccaguugauuacaguuuugcacuaaaaaaaauacauugaagugggucaucauuucugucacaaauauuucaugaccuugggauaagcagggaugcuauucugccagucugcacuagccguguuuacugguucguguguuaaugacuggguguuaaauauuuggaauauugcuuuuggcuagaagauguuuuucuugaggaaaaaugauagcacuaggcugacauuucagaauaaagaaguuucagcaguaaacuuagccccaaguguuuuauccugagacagauacuggcuuaacaucuaauuuauuuacuuucauuuaauuaaaaaacaucuaugauuugcaaaacauacaguucauuagcgcuggugcugacagaagucacuuuaaucuuuuaacgcaucuaguaccuuauaauuuuaugucaaucagaagaguuuguugcuuuccacaaauuauuuacguaacguauacuaauagcuaauguuugcugaagaacugugugaagugcuuugaauggauuaucuuguuuaauggauuaucuuguuuuauugauuaagaaucaauaaagguagauauuaucauugcuauuuucaguguuacauguuacaacggggaacuuagggcuuagagaaguuaaauuccuugcccaaaguuuuagggcugggugcgguggcucaagccuguaaucccagcacuuugggaggccaaggcgggcggaucacgaggucaggagauccagaccauccuggcuaacauggugaaacccugucucuacuaaaaauacaaaaaaauuagccaggcguaguggcgggcgccaguauucccagcuacuggggaggcugaggcaggagaauggcgugaacccgggaggcggagcuuguggugagcugagauugcgccacugcacuccagccugggcgacagagcgagacuccgucucaaaaaaaaaaaaaaaaaaaaaaaaaaaaaagaaagaaaaggacuagcaaaagaggauuaaaaauccuugucuuaguugucuuaguuuuugcuguuguaacaaaauaccgucaacuggguaauuuaaaaacaacaugaauuuauugcccacagcucuggaggcuaggaagucccagaucaaggcaccagaaaauuuggugucuggugaggggcuugaucucugcuuccaggauggccccuccuuucuggaucuucacaugguggaaaggccaagugcuguguccucaccugauggaaggacaaggcagcucccuucaaccucaguuacaggggcacuaaucccagucaugaaggcagagugauuaagucauuuccuaaagacgccaccucuuuuuuguuuuuuuuuuaauacuuuaaguucuaggguacaugugcacaaugugcagguuuguuacauauguauacaugcgccguguuggugugcugcacccauuaacucaucauuuaaauuaaguauaucuccuaaugcuaucccucccccaucugcgcaccccaugauaggccccagugugugauguuccccuuccuguguccaaguguucucauuguucaauucccaccugugagugagaacacguaagacaccaccucuuaaugccaccaccauagggauuagguuucagcgugaauuuuggagggaagcauugagaccauggcaguccuuaaagcuuucuuuucuucuccugcucuuuuuaacacuuuguuugcccuuuccugagacucccuuucuaucccagggagagaggagaggucuuagggauaggaguaagagaccauaaagaaagggacagaaugguuuuuugaacuugauuacauuauauuugauugcaugucccuugucuuuccuaccuauccuagaaauuaggggauguagauuuuugagaaccaacuugauguuaaugugaccuuaagucauuugcucaaccucuguagaccucaguuucuucaucuguagaauauagaauuauuuagaucaucuagaaugcccuuuuauuucugaaguucuuuauaucacuaaaccacaagacugaccaacguacuuuaugguuuaaaucuaucuuuguucucuuuuuuaaaaaaaaucauaaaauauuuuaaaaauacaaaaauauaaaaauaauagaggagacaguuguguauccagcacaaaaauuucuaucauuuguuaccauuuugccauguguuuuagauuuuuuuuuuuugagauggagucuugcucuguggcccaggcuggagugcaguggcacgaucucggcucacugcauccucugacuuucugguucaagcgauucuucugccucagcguccuguguagcugggauuacaggcaugagccaccacacccagcuaauuuuuguauuuuuaguagagacgggguuccaccauggccaggauggucucgaucaccugaccucgugauccgcccaccuuggccucccaagugcugggauuacaguguuuuagaucuuuaacaaaauagaacauuuaagacauugccaaagucucauucucaucuuuuccuucuuguccugcauguaucuuuuugugauauauaaaucuauucauuuagacuguuguauaguauuucuuugacuaaacuaguuuauuccccuccugagucacaguuucuuuguauacuauaagaaauaguucuuuagugaacauuuuaagacauguuuccuuguguaagaguuucuucaggguagauaccuaguggcggaauugcuagauugauggaauccaguuuuacuucuucaguuuccccagauauugccaaaauaauaaaugaaauugauaaaauugaccauuuacauuucaaccagcaaccauuaaguuugauuuugccacauugucaucggugauucuuguuaccagacuuauuaauuuggaccaaucaaauguaugugaaauaccuucucaguauuuuaacuugcauuuguuugaucacugucagcuuucacuagguuauguugcaguagccaaaaaaucugcaaaucuucacgacuuuuaauaaaaaugguuuauuucuugcucauguuacaugugcuugguggguuuguuauggcucuuuuccacaccaucuuuauuucugaucaagacugaaagaauagccucuaccugggauaugcugguuucaugauaaagggaagagaaaacaugguagaaccauacuacaguucuugaaucuucugcuuggaagugguauauauuacuuuaacucacauuucauuggccaauuaagucucauggccaaggcugauaacaguauagugggcaaguaugauccucucaugggaaggauacucaaaaccaugaaaacaguacuacagcuuauauuaggcuggugcaaaaguaauugcaguuuuugccauuaaaauuaaugaggcuggccgggcacagugggucaugccuguaauccuagcacuuugggaggcugaggcaggcggaccugaggucaggggcucgagaccaaccugaccaacaugaugaaacuccaucuuuaccaaaaauacaaaaauuuuagccgggcgugguggugagugccuauaaucccagcuacuggggagacugaggcaggagaaucacuugacuccauggggcagagguugcagugagccaagguugcgccacuguacuucagccugggcgacagagugagacuuuugucucaaaaaaaaaaaaaaaaaaaaaaaaaaaaaguacugaggcugagcaucuuuuuucuccuccccucccccccucccccuccuuuuuuuuuggagacaguugcucugucacccaagcuggagugcaguggcaugaucuuggcucacugaaaccuccaccuccuggguucaagcaauuuuccugccucagccucccaaguagcugggauuacagaugcaugccaccaugccuggcuaauuuuuguauuuuugguagagacgggguuucaccacauuggccaggcuggucucaaacuccucaccaucuuuuuauguuuuauuuagguuuauaugaucacucugaaauuuuuaaaaauaaauauuauuucucagauuaaggacuuucuccccuaguuucuagacuuacucaugaguagguggugaauuuuaucaaauguauuuuuugcaucaacuaagaggaucauguauuuuucuaacccgcuaauguuguaaucuacauuauuuucuacuguuaaaccaucugaauuucuaauguaaacuugguagugaugauucugcauucauuuuguauuauuuuuauuuaggacuuuugcauauauugccuuuaauuuucuuuuaucgaauugucuuccucagauuuuguuaucuggguuguauucuauccucauaaaguugcuucccuuuuaccauuaccuagaaaagccuuggauaaauuacuguuggucuauuuuuggugaucugguagaacuugacuuuaaaacugucuuggaugguagccuuuuugggagaagaguggaaguggaagguaguuuuuguuuuuuuuaaaucguugauucaaauuuuuaaauuuuuuuuucccgaguuaguuacagcaauuaauauuuuugguagagauuguccauuucaucuaauuugacaaauuuauuggcaugaagguuuucauaauauucuuguuuugugcauuugauuuuuauuucuuauuucuagugucguuugccuuuuuaaaauuauucuuacuauagauuuaccauuauauauuuuuucccaaaggaaacaacuugguuuuaucauuucuauuguaucuucucuauuuuguaacauuucaucucguuuugcucuuuuucuuugggauaacugugcuuuuucuaauuucuuaacacuuaaaacauugcuuucauagcucuaauuuucccuugaaguaccucugauugauuguacaaauuugaaauacaguugacccuugaacaaggagggaguuagggguaccagccuucugcacaguugaaauuuuacauauaacucuugacugcccccacauguaacuacuaauaaucagucuccuguugccuggagccuuuccaauaacguaaacagucaacacaauuuuguguguuguauuauauacuguauucuuaacaauaagguagagaaaagauguucuuaaaaaauaagaaggagagaaaauauauuuacuauucauuaaguggaaguggauuaucauuaaggucuccauucuaauugucuucauauugccugaggaagaggaggaggaagaggagggacuggucuugcugucuguuucuugguggaagaaaaucuagguguaaguggauccaugcaguucagaccuguguuguucaagagucaacuauauagugcuuucauuaccauucaguuuuaauuuucucguccuaucccauuugggucuccccucuccuccacucuccuccccuccccuccucuucccuccucuucccuucccugucccuuuucuucuuuuuucaacaggaucucucucuguugcccagacuggagugcaguggcagucccucuucuugccucagccuccagaauauauggggcuacagauauaugccaccaugccuagcuuaucuuuaaauuccuuuuauagagaugaagucuugcuuuguugcccagguaggucucaauuacugggcucaagcaauucucccuccuuggccucccaaggugcugggauuacaggcaugagccacugucucuggccccauuauguaucauuuuugaccacuggauuuuuuauaggugugauuuaaaauuuccaaaagugugugcauuuguguuuauguaugcauguuuugugggaagagagaauuuuuuuguuuguucauauuuccaguuuuauguuacagcguggucagaauguggucuaaauaauagagauucuuaaauuuauuaagacuuugaaauauauagucaauuuuuauaaggguucuuuuugaauuuggaaagcaugaucuucuuauuguugauaccgguuucuaggucuguccacuuggucagacaauuaugugggucauguuaucuaucucuauuaauuguuuaacugcuuaguuuaucaguuaauaagagagguguguucaaaccuuuccuuguaauuguugauuugauaauuucucuugguauuccuguaaguuuaugcuuuacaaaauuugaggcuagauuguuagaugcacacaugugcagaauuauauauucguggauagcccuuucuuuuuuuaccaucauauaauaccuugaaauuuauuuuauuugauauuuauguuauuguacuagcuuuauuuuaguuagaauuucucaugacucucuucugccuuuuaucuccugaccuuuuuuuugcguuuaaacauuguauccuuaugucuuugagaugacuuuuuaaucacauuugagaauucugucuuuaaacugguaaauuuagaccauuuauuuuuaguacuacugagauuagugacucuauuuugccauuuaauuuuggauugucuauuuuucuucguuuacuugaauuugcuuuuuucccuuuuacugcugcucuuuuagaaauuaaguauauuacagacacacuugaguuaauaaagucuaaugcuaaucacuaugccuacucgccucuuuccccaucuuauuuaguaugcauuucguagaucucggaucucguuuuggaaugauacaaaaacaacaauuucuuaucuguguaacuaguccuucuaugaucuacuaccuguagggaaucaacuuacuguguugccugaagcagaguugagauaguauccaaagcgaaaagcagcaguuuagucuucuaauucaccaagauuuaaauugggaaagcauaggagucuucauuuuuaugacuguauuaauuuauaguuagaguaucuuuucauuuaauagaugauuacuuaauauugccauuauaagaaugaacuuuggaggacaagacaugaugaaauaagcuuaaaaacagcauuuguguugaguaauccuuucuuuuucuuuugaguucauagcaaaauggaguuugaauagauuuuagugaugcuaucccacagcagaucuuauguaccagcaguucacuugaauucuaagcugugacuuuacaucucaacauaggccauaauucaucaauauccuaauagcuauuauaacaaugcagaaguuauaaauuauauuccccauuuuauugcauuuuccuuuuauacaaguuuuccucuuauuuugauuuucccguugcuugcuuaguaucauuaguuugggucuguuacucaucagaccuguucuuguuuccuccucaggaguggagcccagaguacagccaucaugggguugagcaggcuaauguuucccaauuccaguguugaccuuaggcagauuggaugauaugcugaugcugcuuaucggugguucuguaucucuacaccggaaaucaccgucugaggacuauuuggggaaguagauaugggaaacuguagcuauuaaugaacuuuugagcacucaaggaaggagaauagaauaugggaaagaaauacuuguauuugguuugagagaauagauuuguuuccaucuguuuacucucagcaaauauuguauuucuuuauggcucuucagaggacuguaguuauuguuuguucuuuuucuuucuauauguacaugugucuaauuuucaauuaaaccuugauauaacaugcccacugaagaagaccuaauugucuucacuuaggguguuuacaacaauggagagaagccacucaaagcaugggcugugcaggaagucaugaggugauagcuuggcuuacagggaucuuauagagaguagggugagguucuaaaaggccucaaaugccaggaugagaagauuaaaacugauccauagcaaaaaggagcugcuuaguaauggaccagagguuguaaagucauugguauacaggaccuagcaaagucaagggcgcuguuuagauuuuggaacauuguagcuagcuauauggcugcaguaauuuaaggggcuggggggggggucuucuuuauucagugcauugcuuaugaugcacaucaguggucucuauagauaauuuuuuuuugugaugcgauuagaacauuggguauguuaggcacuuuccuguucuuguuaccuaucaguaccuuuggucaacaaaaguacccccuuuaaaccauuuaaugugaauauugcuauaucaauggaauaauuuuuuuaaaaucaaaaaacauaauucaugggggcauuuuuguuugacaucugaacaucaucucugcuuccuagcuuacucacucuauauaauuaauauauucuguauaaucuauauuaacauguuguuauauauuuauauguauuuuaugugucuauauccccauguaucuguucauaucccuucuuucuccccucauccucuacuuuuuauggcuuccuguuuccacauuguuuuuccugugggcuaucaaccuauucuuuaucuccuaaacuucaggaauuagauaaagacaacuguccaaggaaccaauacaguacuguuuuuaaaaacaaaucgccaucuuugaaauuuguguucuuuuaaggaaagagggcauuugcuaauauuaaguggauaaaaaauuuuuaugccacacagaauuuucuggauuccccaaggcuggaaauaauaaaugaacauaaacauugaguaacagugcauuuuuaaaugaugauuauaguuaaguuaaaaaaaauacuauggaaauggcccaacuuuaauguuauuuuuggcuuauguaacaauagguuuauugcuaagccaugcguuaauuuugaccugaggccuaggcucucuuugugcauuuguuccaaaucuuugugguagguacuguuucauuguugucacugauaauuacaauuuacauucuauacuaauuuaucaucuauugauagucaacugagaucucaaaaauuuuucgaaaaaacuuugaagauuuuuuaaugaagaaacuuuauaacuugauuuuuuuggaaauguuuuuaucucauugagauauuuaaaugguaugugccaaccuucuuugguuccagaguuaaauuguagagaauuuuugggugucucuuggauccugcauguuuacuucagggacuugacucuagcacucuuuaugauguugcugcuaaggucauuuacauacucaguguguuaaaacagcagagcucuuuccucuaagcgggggaaaaaaacaauaagguuuaguugaagccauggauauaaagucaggcgaucuauguuuacuuuucuuuuuacucuuuggguaucuugggggagucacuuccucucuucuauucucagauugcaaagagaaugaaaauauuugcuuccuccauuucuagaauugagcugguuuuacuacaacugauaagucgguauauguguuuuaaaguuugcaaauaagugugaaaguuccugcaagacuuuggaagcuugagugaaugugcauucugaguuagaguugcucacauuuuccucuggcaucucaaaguuguucccacauguugauuuugucugagaaucaagggcauuguuucugccuacacaggaaugucaguaccguuuuuucuuaguuaugaauaaggcuaacaauguaggcucucuucaucaguguucuguugauaaaaguauuucucagagagcagaaugugucgaggucuuuuugccuuucuuguguugaguucgggucucggaaauccaauuugcuaucauuacuuugaguguguuuuauuugcuuguuuguuuauuguuguuucuuuucacccuccaaggugguauuucagaccuauaguacugacacuuacuaaguuuacuaguuaaacaguuucaacuaucuacauauuuguagaggaucuggaaguuauggcacucuauaagauuccauaaaaauaguggcagauuuauaugucauuuugggaacuaggaauaauuuaaugggcauguauuaugugcaauuuaaaauuccagugacauuggucaagguggcaugucuuuauccuuuuagcuuaaaacaggauuuagggugguaauucuauucaaaacuuaauuuguauuuacuaaaugggaaaagacugccgugccauguaagugauagaauauuuugguccagcuugaagaacacaaggagcucacagcagcagagccuggccucauaaucaagucacuccuuagcuggaccucggccccccucccuccuccacucuuggucacguauaaccucaggcuaucuuuugaccucuguuaccacuugauuuucugagucuucccuugugucaaguugguccucuaaucagacauaugcugaguugccuggccuuccuuccaguuucugacccuaccaacuccacauuuugcuuuccccaucacaugauuccugccuaucuuaguuuccaacucaaauccagcucucagaauguucuuuucuuccuuggaacuuguuugcaccauuaguuuggcaauuaagcaugcacugccuugugaaagacucucuuguauugcuguguugaacaacugcuaaacucuuguauuguuugauuuuucucaugcugauguuguuucuucaccugguuuauuauuaguuucucuggaaaaauaacuuucuucucucuccccauagagucuuaacggaggacuuugccuaaaauacuucucauagaaaguaauuuugauuuauuucccuguacuuucuuguacauuuauaaaguuuuuaucuuucuauccaagauaaaugauagcauuuguuuauuuauguuccuaagucuucucuccauccccucuaauuagaaaacaaagauuugggcauuuguguguguguguguguguguguguguguguguguauguguguguauguacguauauauauauaauccacccacccucaucauugcgacugcuguccauuauugcccugcuuuucagaugcuuggaaacagcagaccgacuuguuauauaaauacuucaaaggcuuauuguaaaugaaaacuauuauguuucuacaaaagauugugaaacucuaggcaugagagccauauagaaguuacuauggugugacccuggcccuuuaggagcucacauucacagcucagagggaauugcaggcucccggaagcucuguucuuucacuucuguuggagcugcuaucagaccagguuguuugcuggcugggcguaggcugggcuugaagauacuauaauucuuauucuuugucccuuguuuucuaauaaugccuccucuucucuugaggaaacuaaagaaugauaggccauuuuauuucucagcauucgaggaauucuuucacaugcuuuuuuucuucucugucuucuccacauuugguuucaaaaccaggggauuacuuuguuugccccugcaucacugguauuuuaaaagcauuaaacuugaaaguaauuucuaacugugagcagccauccugacauacuuuugaagaaacuguccaccucuugcuggauaggcaugcuacacacuggcagccaugccaacuccuuggugauuuaccacuuaguaaguuuuuacccucaucagagggugguaguagaacaggaacuagaucuuugaauuauuucucuguuuuggaaugaaaauuacuucagggucgaguaagguuagaaauguugggaaaaguuauuuucagaauaaaauuuaugcuuuaaaaucaguuuggacacauuuuuguuacuuuaaaauauguacucacgccaguuagaauggcgaucauuaaaaagucaggagacaacagaugcuggagaggauguggagaaauaggaacgcuuuuacacuguuggugggagcaugaauuaguucaaccauuguggaagacaguguggaagauccuuaaggaucuagaaccagaaauaccauuugacccagcaaucccauuacuggguauauacccaaaggauuaucaaucauucuaccaaaaagacacaugcacauguauguuuauugcagcacuauucacaguagcaaagacuuggaaccaacccaaaugcccaucaaugauagacuggauaaagaaaauguggcacauauacaccguagaauacuaugcagccauaaaaaagcaucaguucguguccuuugcagggacauggaugaagcuggaaaccaucauucucagcaaaacaggaacagaaaaccaaacaccgcauguucucacucauaagugggaguugaacaaugagaacacauggacacagagaggggaacaucacacaccagggccugucaggugguggaagcuaggggagggauagcauuaggagaaauaccuaauguagaugacagguuaaugggugcagcaaaccaccauggcacauguauaccuauguaacaaaccugcacguucugcacacauaucccagaacuuaaaaguauaauuuaaaaaaauauauguaggcaguaaaauuuaaaaaaucuuugccagaguucaucaaaugaagggauguaaucuaauuacacucucucaugcaacaacaauuaucaguaucuuuuguuaaauccacuguguuuagaaucauucugucaucauuacuguuuuauuucuagucuuugauuucuuuucuauugcuuccuguucuucugaacaaauuuaagaugauguuacugacauaguuuuuguuuuucagcuaucaggaaauuuuaccaauuauuugcuuuccucauccuaccuccaccuucccagcugccaggcaugauaugggggacagggauuugagaaucuugucuccaccugugaauguuguuuaauuuaucacacaaaagcuggaauuaggugcauucuauucauccauucccuuagcaggagcacauacucuguggccaaguggaaacauggacagaauuuaucauuaguauuuauagcacuauaacauaauaugccagcauuuggagcuuaaagggauugaaugcgguauaacauaauaaaauacagucuguaaaaauccguggauuauucagaaaaauaguuuuaugaugcaagguggcuaaauuauuaaagcacugacauaaaugaucugucaguuugcuauuuaaauauuuauuuaauuaugcucuacaauggaguuauacaucaacucugaacuguguuagaaaaauuaugauuaggaguauuaauuuaucuuuuauuuuguuuugacucuuauauucuggagaggcaccugagggcacaagcuccauucugucuaguaaucaaacuacaucucauaaguguacuucauuugcagaauaugccauuuuagccuguuuugagauuaagccugauuuugugcaucagucugguuauuugcacagagaggaaacuuaaucugaguguuaccaccaucuacuuguuguauucacugacaucuccuuccagauuucugucagcaacaauuucaagugaaucaaauaggacugcucugauaagcuauucuuccguagcacagaaagccuguaugaaucaaaugucaaaauucauucuaggcaaauaguuuacagagaaugugcuagccuacagaaguuugcugcucaugguuuuugaaauaaguuuucauggaaauauggugcuuagcaacuuuuaugaaagauacuuaaaaaaauuuggugugcgcuucuggcuagaaguucgauacuagccucuuuauuaucuaacaguuauagucaauucuccgucuuuuaaaagagauuauaauucauuagagacuuaagcuaagucuugcuguuuaaagugaguaguagaaaaaguuggacaaaaauccuggguuuucauuuuuaaaaaauuaaugacaggguugcuagucucccuuugugaugguauauaauuuuuaagaaaaaugagaaguuaaggaagucauauuuucacacuauuuuacaaauuuccucucaaaauaguauuuauuuaaauauauccuauguguucagaaauaauuuuuauccccagauauugauuugguuccuacuugagcugagaagauaaaaagaaaaguaugaaguaucauuuuuccuuuuauuuaugaauuuuacuuucagagauaagcuuuacauauaagacaguaauagcagguguuuauacacacacacacuuauauccacauacauaaacauaugagucaaauugauaaaguauuguuuauaguucugaaaaguaauacaaaagcacagaagugccaaguuacuauaggcuggagucgguaugcaugucuucacugaggagaaacuuuuggauuucaaagaaugauauauuuagggcugagcacgcuggcuuaugcuuguaaucccaggacuuugggaggccgaggcgggcagaucacacuugaggucaggaauuugagacuaaccuggccaaugugaugaaaccccaucucuacuaaaaauacaaaaauuaacugagcauggugagggggcaccuguagucucagcuacuugggaggcugaggcacaagaauugcuugaacccaggagguagagucuacagugaaccaggaucaugccacugcagugcagccugggcgacagagugagacuccaucucccaaaagaaaaaaaaaaaagauauauuuaggaaaaacucagcuauacccuaaccuaaccuauuacauuuuucauuuuaaaacugcuuaaauaguagcauccaagcaaaaauuggggguuacaagaaagaaaagguuuuaauauauccuugcguaucaaggaugacauaaaaaaaauguaccagaaacauuuguucagggcaaaccacuuuccuggcuuuacagggcuaguguugccauuuuugauccaggcuuucuuuggcuuggcauuaacuaggaaucuucaucuugcaaagccaguguauuuauugggguuuaaauaaauuaagcucuuugcuucugcuaaaucuauggagaaguggauucccacccaugggaaagaaagcauaaaauacaaaugcacugauccuaccuccuauccuuuuucagucugcuuauccuaauuuugcuuuucccagguuccuugcauugggggaagaaucacgugugcauauguacacaguaacauguacacucugcauugucuuagaacagauuuuguagggaacagagcuaagugugcauguucauucuaccaucuuuaauuggaagucuauuuucuacuuaauaaaaguugaacgaugagcauguuuugucacauacuaaaauaaaguggacucuuccccugaauauagcacaugucaaaguuaccauuaggcucucuggauaucuucuaaaaagacuuuugauugugguagcuuuaguagcaucuguuuugacauaguucauuguuuucuugcagaugcuuuucauuaguuuucauuuuguugcuuuaguauucccugcuggugucuagauaauccguuuuauuuugcauguguguuuaauugggggguggguccuaggagaugaaagaggauagaaaugcuuuucuccuuaaaauauguuauuuggggccgggcgcggugucuuacaucuguaauccuagcacuuugggaggccgaggugggcggaucacgaggucaggaguuugagaccagccuggccaacauggagaaaccacaucucuacuaaagauacaaaaaauuagccgggcuugguggcacacgccuguaaucccagcuacuugggaggcugaggcaggagaauugcuugaacccgacaggcggagguuguagugagcggugaucacaccacugcacuccagccugggugauagagugagacucagccucaaaaaaaaaaaaaaguuauuuggguuuuuggcaaauaggugcaauucauuuguuauucacuugguuugggucacuauuuauuauauauaguuuuguggcuuuauucauuaaacauuucuggaccaagcauuggugauaucaugagggauuuuuagucuccucugccccugguuggagccugugcaguaaaggggaaagauuucauuccuguguucaugguuggguuucacacugauuuacuuuucuauuucuuggugcuuuucgccguuagacuuucuuguuacuaguuccaugaugauauccagguguuccuuuauaguauuauaauacaaaaaauguucuaagcuuccugccuacuuuuucuuccucuggaaacaaaaucccuacuuuuucaaaucuagcagauaagcagcuaaguaacagaggaucagcaguuugagugaaugacuuuagugugugaauuaccuguacugccuucuaagagaucucuguauuuuaaaagaagauaccuguuuacucuaaagaaucuaguggucgaauucuagugguagaauuucacuauugaagccaagagaaguaaaaaaauaaaggcauuuuggggugggaggaggcuagagggcuggauuuuuggcaucuuuggaucaggugggcacacuaccaguaguacagccuuuuugaaaggcacgguucagggccauguucacccaaagcugcuuaacuuuccugcuucugaauucuagguucuuucugaugccucagaguuuccuccuuacauaguuguagcauuuuuuguguauguguguuuuaaaucaagcaagaccuuaaagauucacccagccaggucccccucccuccacacuccaguggugaacaaagaccuuguugucacuuugucuuuuauuuuacuuuguuagucauccaccaggaaugaaaaacuuuuacuuggaaaaaaugucaaauugaauagaaacacuguugccccaaguagaucaauguuuaaaaacugagauaucucaaaaugaaguggauuuuucccuagauugccuagaaguugcuugucaucaaauucaagaaucagaaauucagguggugaaguauauggcaacuacuguuguuaggaaacucaucgagaccucuccuuuugugucacguccuaucucccucugcuuuacaaccauaauaaaguaagcguuuaagugauauaagauuauucugcauuguaacuugucuucuacuuugguuaguuuuuaaaagaauaagcacuccuggcuaauagagguaagaacaguuucaaugggucuggcuugugauaagauguaggaucuccagucgucuuguguuuuuccaccugaugauuucuuucacaaagguagacucaaauauaguugucauugaagauugucagauaaaucuuauuuuagcaggcuguguuaaucuuuuuuuuuuuuuucuuuuugagauggagucucacucugucacccaggccggagggcaguggcacgaucuuggcucacugcaacuuuugcuguccugguucaagcaauucugccucagccucccgaguagcugggauuacagccaccugccacugcaacuggcaauuuuuuguaguuucuguagagacaugguuucaccaucuuggccaggcuggucuugaacuccugaccucacgguccaccugcuucggccucccaaagugcugggauuacaggcaugagccaccgcgcccagccaaucauuuuuuuuuuaaagcauuuuaagugaauaauugagcauuugauuuauuauccuggcuuuucuaucugggucuuugaaagggacaaaaggagcacauauacaccaugggauguagccuggccagauugaaaacugaaaauugauggauuuggaguaugcaggcagauaguugaaugcugggacagggauccucuuugcugacugccucaugguuaagcuuuuaaaaauuuguugguuaagcuuuuaaaaaaauuuuaggguuuuuagggcaaugaaguuacucuguaugaugcuauaauacaucguggauacgugucauuguacauuuguccaaacacauagaaugcaggacaccaagagugaacccugacauaaacuguggacuuugggugauaacgacaugucaguggagguucaccaguuguaacaaauguacccacugugugggauguugguaauuaucccaaugggggagguuaugcaugugugaaagcagggaauauauggaaaacuucuguaccuuaugcgcaauuuugcugcgaaccuaaaacuggucuaaauaaaaaguuacagaugcccagguucuucuuuuguagauucuaauucagcgggucugaugccggcuggagcauuugugcagccagaguuaagaacugcuuugagaggccucacguuaagacuguaggaggucuuacuaagugcauguuuggguuccuuuacuucacagcuguuugcuaacuaaucgauagcugaauuugguuaugauuuguuuugagcaaugccuaggacauaguaagggcuugauaaauauuaacucuaauuguuauuauauuuuaaaauccugauuauauauuuuucucaggauuuuaccagcuuucuuaaauuucugaugaaaauacuuaagucguaugccuuggauaaauuucuaguauucuuguauuuuaucacuauuuggcuuagaagggccuuaauguaaacguaugccacuuauauauuugcaaugucuuuguaauuuaaauaacuugguuagacugaaaaauuaaacccuauuuaguacuuuuacaaguaagaaaaaccccacaagauuuaaaaauaguauauuuuaucuuguaauuuugaauaaaccaaucccuaguguccaaggacuuacccuucuguuggagggucagaagagagacauuggcuauaaccaguuguguuacaaaaauguagaaugucaaaggugaacuuauuucccacugaaauaaacucuaagaguagaaauauuuguuuuuugcagauaagaaguugcaaauuuagcaggcuauuuagcagcuguuuacuuagagcaaaugaagauuuagauaauucuuccucauaagcuagaauacuauuccauuaaacuuuuauuaccaaaggaaggcauuuauggaaugccugcagggcuguauuuuaugaauggcugagcaacugacauacuagaacugacagagguguuuauugucuuguuuaagcaaaaaaacuuuuuuuguauaaaauuuguggguauuuacaugucaucaaauaugguuuucuuagcaagcuuuaagauccauugcucugggggcuuuuuugagguuuucugcaucuucauuccagagguuggcuuuggguuuguuguggagcuagaauguaaaugugaggagugggaauugguuccuggaauagccuucugcauaccuguuuggagauagaaguccuccaagugggcacacccuagucuacuagcugauucuugugucuugaaaacuauugaaaauuucugggcugcaggagauaaaaacuacaacugccuaagaaauaaauucguguguaguuaugaaugagauauuaaaagguugauauuguuuaaaacuaaaaauuagcauuuauuuucuuuuuaaaaaaaggggccauaucauagacuucaacuguuauugacaguggguuuuuuuguguuaauaauguugguagcaggauuucagauuuuuuuggugccauuuuccacauagcauaaaaaugaaauauauuuuugcaucuuguuuaagcuuaccgaguugcuuaugagauuaauuauaugcucaguuaagaauucugaaauauuucaaaacccagcagacugggguggaagaacauuccauugaauacugcucuuagacuugaugggcuuggaagcaucgugcucaugaaauaagggccuuacuuauauaacaaguaagaagggcaaguaaggagucaaaguaucuaugugauuuuauuaaaggugaaccugugugcuuauagcuuuacuaggauuuccuuuuaaaugauugcagguuacaguuacuggaggguaucuuugcagucuguucuagucuaguguguguuuuucuaagcagcagcuuuuuaauuuuaauuuuuagcaacugaaacuacauugaaugguauuuugugucauuccugucaacaacacugcaaaauucccccaauauucugucauaauccuuugaauccuguggaauggaaaagauguggcaauccuuaaugaacugugagaaguuuuccuuucucccucccuuccuuuuuuugguuuauucucuaaggaauaguauacaagaaaaauauguuguaagaauccaacauguuuacguaaaucucuuaucuaucuuaacuguuuacuuguauacguauauacaaaguuuuccugauuaaugaaaauuaaguuugaaaaaaauuuuucaguuacaaaaaaaaaaaaaaaagaaaacaaaaagaaagggacgggugcuguggcucacaccuguaaugccagcacuuugggaggccaaggugggagaauugcuugagcccagagguuuuagagaccagccuggguaagaugaugaaaccccaucugccucuaccaaaacauuuuaaaaauuagccaggcaugguggcaugcaccuguagucucagauacucaggaggcugaggcaggaagaucguuugagccuagaaguuugaggcugcagugagccaggauugugccacuucacuccaggcucagcaacagagcaagaccccaucucuuagaaaagagaaauauguauuuauguauaugucuucuauauuuauguaucuacaugcauauguuuguauauuauauauaauauguaucuuuuuugaguauuuggaaaaaacguuuucaaacuuaauucuuacuaaugaucagggaagcuuuucuuaagaaucuuccuuuacuauaucaaugucucauuuacuacuggaauuauguuuuuaacacacacacaaaauugaccaggguuucuuuuuccugggguuugaaugaacuuugggaaagagauguguugacagcucccuuagauugguaagaaaauaauuaucugauaaaucacagccuuggauuugagacacucucucuucuuccguaugguuuuauuggauucccauccuccucccccaacaauguaucaguuguuguguuugcucugugcauaccuuucuuuccuuggccuuuuauauuugcauaguguuguuuggagcuagugcaaaauacauagcuucagggcuguaauguauagauugcauugugcgcuucccaucaucgucuccucagcacacaauaacugcaguguggagggcccuacacggagacagugaugguguuuauaaaacgccagugguguguggcauucacuacaaucugccggguaagcaguugcacaaauuccuccaaguugagaggccuccagaaaugucauguuuuggccucaguguugaaugccacaaauaacagcacaggcaugggggacuuugcucagccucucagauuccagccugccuuccuugggcugcaucugcaguagauuucauuuacucuuuuucuuuuuaaaugaaaguucccaaaagcuagcauucuaauuuuugaauaauguauuuugagcccauccaaauugucuuguuuugucucucuuuuguggguaucuauaauauauagguuuuuaaaaaaacuaaaacucugauaccuggaaaguagaccaaagggcuuuuuuuguuuauuguuuuaaaguuuucaacccguuaacuuuauauugcuagugagugguauaaguaggguuagggagaggcagacagacgaaaaauagauagcuaagcuuguugauauuuaauauagaaaguuauauucaaaauauuucuuuuugaaguguauuuggcaaguuuuauuaacaguugcaugguuuuuauuguuuaauaaacuugauaucauauuauuagaauagagauugacucggauuguacuuuaugaagauucuacuguaagaacagaaacaaagcaaaggcaugcuucagauagcaagaagaaaugacagcgaaagugaugucuuaguggaggaaugugcaagacuaggaaacccccuguccuuucugcauaaagaugagguauggccuacucuuaagaggaaggggcagauuggcuuuuucccucuaguucccaaaauguauuuggaaaugcccuaguuuacuaaggaagaguauaagcauaauguagaauugugaaaaugaaguguuggucugugcuggucuucucccagaaacuaguuggcaguguguguuugguuuagguccuugaacauuauggguugguaguccaucagcuagguaaggaagauuguguaagaaaccagcaggccugaauucuagacucaacucugccaacuuuuugacuggccuuauggcauugagccguuccaucagcagcuaucuuuuggccuacuagucagcuaauuacucaguaggaggcauugaaguaagauguccucuuucuuaaagaacucaguaucugaaaguaauaaguaucaaaaggaguagaauagaagaauaagugccauagaugugaauaaugcucuugaaggagaaugaugcaauauugagagauuggaacaggcuucauagggaaggauauuuuggagauuuguauacaaguagagguaguuuugacacuuguaaauaaaucagaggaaaaaaauuagaauaugucuugauaagucaguaagugguucucuuuaucuggggcaauaccccaaaauugcugugacaacuaaugaagcaacuacguguacugguaucuuaggugaaaguuaugaagcaaaauuauguguauauuuugcuugguuaacaaauguauauuuguaguccuuuuuauacaguagaauucaaguuguugauuuuuuuuuuuuuaaaagcaauguuaauggaagaaaauuacuuuccuggauagaaguguggaauauuaguguauauuaagagcauacauaauaauuuaauuauuuuaaaagaaauucagaaaucagacugaaaaauuagauaaacuuucuauaaccuuauuuuucuuauuugugaaauaagaaaguuugauuagauaauggaaaacuuuaaaaucauauuuaaaaucaauuauuauuuuagagcagcucaaaaaggucuuguaauuucagcuggcuuuaaugaauccauguaauaagccaaacauuuuauugaucacuuuaaacauacuucauuuaauuaucucaucaccauuauaagguggguacuuuuaaagagcggaacugaggcauagagaaguuacguaacuuacugugguuacagagcuguuaagaguagggcugggggucaagcccaggacacugugauuauacugcaguacuuuucuuccguauuguuaagaauuggugauucucaagaaagauggaacauaccagaaucucgggggaaaggaagaacuauuuugaggaacaauuucaacuuacaugccccuguacauuuuuaugugcuaccauuaugcauugugccuugguucuucacccccaccccaaagagaauuauuauuuauggaauguguugugaacagugugaagacaaaguugugagccacuagaugguguugcugucugagccgacccaaucgaguuugauugaacauuagugcuauaaauguuauaacuuggaacauucauauguagcauuuaauaugugucaccugauaaucugaugcuuuuuagaauauaagaagaaauguacuacuuauuuuguuugccuuuuugaauaagccuccaaagcacaucuguuuuagguuucuuaggagugacuuuucuguguuuuuuuguuacaauuuuccuucucaguccuucuuuuuauucccuagcuuauguuucauucccucuugucuugaugacuuuauuauagcuauuuaaaaaaauaaugcguguuagaaccuuuuauauguugaguauaaauaauaaauuaguagaauaaaaucauuguagauuaauaaauuuuauuaauuuugcuagggauucauugagcuuucuuaauuugaaguuuuauagcguuguuucuuuuaauauugccuuucccuuauucucucucaucuccaucuaggacucugaugagauauuuguagaccccucauucuguucuccaugucugugaaguucuuucauauuguccuucccuuugucuuucucagccacauucuggauaguuuuuuucagaucuaucuuccaguucacugguuuucucuucagcuuugucauauccuguccauuuggauuauaauuuaguuacuauaguuuucauuucuagguguuuuauuugauuauuuucaaaaccugcuuuuucauauucacuuuuuccuuagucauauuuuaaaauauuucuuauaaacacauaaaacauauauauuuuguguuuuguucuugauaauucuacuaugugcagucucugaagaucugauucugauacugugucucucaauaauggugucugguuuccuugucguuuugugauuuuuaauguauguuuuuugagauuuuugucuaugagaauuucuugcuucucccaggcagcugggcauaucuaaucuuggaccaguuuaaacuggauuaucuuuuggcauuuuugaaucaaacagaugugaauaccagugucuacaucugcguuagagucagauggugguacagguugaguaucuuuuaucugaaaugcuugggaccagaaauauuuuguauuucaaguuuuuucagauuuuguaauacuugagcacuccaaaucaagaaauuggaaauccgaaaugcuccaaugagcauuuucuuugagcauaauguuggcguuaaaaaacuuuuggauuuuggagcauuucauauuuuggguuuuuggauuugggaugcucaaccuguaauucuuuccuaccucauuuagugagguguggucuuuaaaacaaaaauucuguuguagaauacauuaguaaauguuguauuaaaaaauagugggcucuuuugcuaaauaguuuugggaaacaucagguuucccaagugaaaggaauaaugggaaacaggguuuuugcauugcaggacuccucagggugucuguuauacaaauagguguuuuggugcucaguaaucauaugcaacaaggagaauuuuucuugucucacucugcugcucuuuuugggaaugagugguguauauaacucaugggaugagugggaccaguggaaaauaacuuuggcaaauauagguuggccucgugauaccuuuggcuucugcuaauugccuucucgcugucuuuccuacuguuuauaccacuuuaugacugugcguguaugugugugugugugugugugugugugugugugugugugugacugucugucuuguauuuaaucucccugagggaagucgugauucuaucugcuauuccucauccccagagcaaaagauuguuguugugcagagcucuuguaucaggcuaucuuguaggcuacuggucacuuuucuuugagccaauugggccagguaccuaauuauguccaaauugguagauacauaaugcuuuauuuuuggcuucccauucauucucuuucucugccaguugcauauaaauuuccugagaccauguuugucgugcucaucauugauucccugguaucuuaacauaggaacugacacauaugggucaauaaagauugagugcuagcuuggcaaguccucacagucaucugagagucggacaggguaaccagcagucauaucgcauggcuuguuuauucuggauggcuuccuuuuuucauuuuacuguauccuccaguaucuuuugaacagaaauucacucagucucuauaaacauccgaaguaaaaaguaagcucuauaaacauccaaaguaaaaaguaaguuauuuugaauaucuguuuucucuaccucaaaaaaucauuuccuccucuaagauucccuucagauaucauauucuuggcgcagcugugauuucuguuagucacauuuacucauuccauuccugguguucugauagcacuuuguacaucgcucucucaacaugugcuucauguguuguugcauuuuugcuuuuccuuccagauuuugaguucguugaggguggagaggcagauggaagcuuaaguaauguguaugugcaaucaggaucucaucaagcauugagaauaucuguucccuggagagagaaggaaagaauaguagagaagcagcuuuagcaucuagaaacauuuugguguuuguuagauguggacuagugaaggaauaguugacaguagaguacugcuaugguugguugaggcauauuccaucucacuggguuaauuuuauucucacgugagcucugagguagcuauuacccucauuuuacagacagggagacuuaagugguuuuacuuugucacacuggugcggugcaguaauaguaaaugcuuacaaaauguugaaugauagaggaacuagguccgauagaggaacugguccagccaucaugcugauaccucauguacugccaaauuguaguggugagcuguguggauguuuuuuccucuuaaucuuguaaggaaauucugcccaugagggcauguuccuauuuuugaaauggaaaccaaugagaacaugugaauuauuaguaagaguugacuugaagcuaguguuggaauuggaacguguuuucuccuugaacugagguguauuuuuguagacaucaguugucuuaaauauccuuuuuacccuaauuucaaauagcaucauaaccaauuguuauguacugcaacucuuuuaguacucaccgcaccuccugugguaucugcuaucuguuauccccauuucacagaugagcagauuaaggcaagcagacguuaagugucuugccaugggucacauagcuuguaaguaguggaaguguauuuagaacuuugguguuugacauacagagcccaauacucuuauucucuaugcuguauuuguauauacuuuuaauauguagacaaacaagcacauaucuaucuuaaacaugcucaguaauuuaauugacuauuaaauccucauugcaaaccuguaauauguaugugacacauuguuuuauuuuuaaauuuuuuauuauuuauguauuuauuuauugagacagggucucacugucacccagccuggauugcaguggcgugaacacagcucacugcagccucagccucccaggcuuaagcaauccuuccaccccagccuccggaguagcugagacuacaagcacacgccaccacaccuggcuaacguuuguauuuuuuguagagaugagguuucaccauguugcccaggcugaucuugaacuccugagcucaagagauaugccugccucagccucccaaagugcugggauuacaggcgugagcuaccaugccaggccuuacacugcuuauuauguugaaauaauguuaucuguguggcauucuccuucuucccuuuacaauuugaugcaauucuauucuuuucagaaauguuaccauaagaggcuuaauaauaaaaauaccagauucuccuccucaagauacauguguggggaacauuaauuuucacacacuggaugagcuaguacacauuuugauagugagagggcauucguuuugaggauggaaaagucugauggcuuuuucuuuuucacuagcagugcauugguggcuuuuaucagugcaccuggggaggaggcgugugucugaccugaccucacaguuggguuguuccaggggugugcaucuuaauuggagaugagucaccacucugcuuauguuuugccauugaagagacaaugagcuuuucuucuauggcugucaaaggcucuuacaucucuguucacagcagcuucuuaaauuuauauauauauauucaagguaaaaauauguuaaguccuuaggggcaguugauuucuugucccacuuccauuaucuuguauuuuuagaauuuaucccaaggagcgaacaccauaucauuuucuaggaaauuguaaauaggagcauagcucauauagaaaauaaaauucuauucuacagauaucauggaacaaaaaaucaaacaugaaaccaaaguguugauaggauaaauuauguuaggaucuacugaauaauagggcuaaaugauuuuccuggggaguaguguacuuuauagauaugagccaccuugaggaauugauggaagcaguuugaacauuuuugaaauaagaaaaugaacagcuaacauuucgccuuuuucguccuuuuuaugucuauauugaguagcaguaaagcagacggugcuugcuuaugcuuuuguuucagauuuuaugcuuuguauaugugugcagggugggagggcuaaaguuaaaaaauuaaucacuuuuauauuguuagaaaaugagaaaacaaauauuuaauguuaauuuauaauaaaucauguaucugauaugaugucuuaaauuuauagcagucuuggaaucuuuaguacuugaaaaguaaaguuauuauuuuuucuccagaaacaugccaagggacaaguguuauuugacaaagugugugaacaccucaaucucuuggagaaagacuacuuuggacuuuuguuucaggaaagcccugagcagaaaguaagugauuucaaguuuauuuuuaucuuuuuagaacauauuguauuuuuuuauuaaccaguuuaucucaguuuaaaauuuagcuuuaaaauaacuuagguguuuauuaugacuucacugugaaauuugguaaauacugaaaaacuaucuuguguagagagaaaccaccuguagcuuuuugguguauguguauuugugugugugcaugcauauguguacaugcuuugcacuuacaucaugagcagacagaauagaaugucaucaguggaaaagugauguucuggcauaaagagaacacagaauaaaugguauuauuuuaaucacuuuuggcucucaaucacucagucuggccuuucgguacuaaauaaguaaagaagcuggucacaucugcucauauugugcagucaccuguaugcuagguauuaaagcauaccugaaaggcagggaaggcggcacauuggaacgauucugucugaggauaccaagaacacuuggucacagugaaagggauuacucuccaugaucuaacauucaaaucacagucagcagaacagagcaaucaauagaagaacagaagugugaauuuuauuugccuacauugcuaucguuguuaguauuuacauguccuacuaaugaaauauaagauaauaagagugauaauuauauauacuuuaaguuuucucaacuugcuuagcuuuaaauacuugauaucuaauuugugguuuaauucuuuguuuagacuaaagacaguuaaauuacaugccugccugcugaauacuacaugaguauucuuaauagaacucuguuuagaguacuguuuucagacguaauagcacauuugacugaauaaacuagguuuuuuagacuguaaauuauaagguggucuugauaauguuuccaauuaugugcucuucuguuuguccuaaaagcugcaaaagagaaaguggugggaauuuggcuaggauuaccuccuuuuuuugagaucacauacugguagauucauaggagcauauaauauaaucuuuguaaaguagagggacaauucaguauguuguacaauauguagaauaacauguucucuuaguaggcauaggauauacuacauuaagaaaucugggcuaagcguggugguucaugccuguaaucccagcacuuugggaggccgaggcgggcggaucacuugaggucaggaguucaagaccagccuggccaacauggugaaaccccgucuuuacuaaaaauacaaaaauuagccgggcaugguggugggcaccuguaaucucagcuacucgggaggcugaggcaggagaaucacuugaacccaggaggcaaagguugcagugagccaagaucacgccacugcacuccagccuggaugacagagugagacucugucucaaaaaaaaaaaaaaaagaaaagaaaucugauauuuuugaaauacuaguuuugcauaagaaaagguaguauuuaguaguauuuauuuagauaguaggauauacuguuuuuuuauuuugacaacucucaauuuaugucaauucagcuuucacugaaucucagacucauauucuuaauugccuacuggauguaggaguuggcaauucccucugucugucaucuacacauuuaguacacaccuuguuuguuacucuuucuccccauuauucuaugaauuccucgaggguagaggccaugacuuacuuaucuguauagccuccguauauguagacauuaacugcuauuuauuacguguguguuauaucacaccuauaaggaucuccacucucaugaaaauagaaaauagcaaguguuggcaaggauguggagagacuggagaugcuguguacuauggguaggaagguaaacugauacaaccacucuggaaaacaguguggaaguuccacagaaaauuaaaaauagaacuaguggccgggcaugguggcucacaccuguaaucccagcacuuugggaggcugaggcgggcagaucaugaggucaggagcucgagaucagccuggccaacauggugaaaccccgucucuacuauuaaaaauacaaaaauuagucgggcaugguggcaugcgccuguagucccagcuacuugggaugcugaggcaggagaaucguuugaacccgggagguagagguugcagugagccgagauuguggcauugcacuccagccugggcaacaagagcgaaacugcaucucaaaaaaaaaaagaacuccaugaucuagcagucccacuucugaguauauauacaaaauaauugaaagcaaggucuugaagagauauuuguuuacccauguuuauugcagcauuauucauaacagccaagagaugaaagcaacauaaauguccauuaaugggugaauaaagaaaaugugguguauacauacaauggaauauguauguacauaucaauaccuacucagccuugagaaagaaggaaauccugucacauguuguaucauggauuaaccuagaggacaccauguuaagugaguuaaagcagucacuaaaagacaagcacuauaggauuccacuuauaugagguaucuaaaguagucagacucauagaaacaaagaguagaauggugguugcuaggggcugggggagggggaguugaggaauuguuuaauggguaguguuucaguuuugcaagauguaaaaguucuagagcucuguuggacaaugagaauguaguuuacauuacucaacuguauauuaauaaaugguuaaaauggcaaauuuuauguuauguguuuuuuacuacaauuaaaaauaaucccacuaccuguguacaaaccagcgugcucgcugcugaggcucuaaccguaaacggugaggacgugacucugcccucagagaugccccugcuuauguuuuaguugagaaggcagaguggaaaagcuaauucugcaguuagugaauuuugauuacuacucugcaggaaaaagucaggaugcuaacaggaggacucugcuuaggaggaagugauccuuaagcagaaaccucaugugugaguggacuuuggcugggugaugggacaugggaagcacauacacgaggcccugagacuggagcagcugucugcuuaaaaacuggaaagaagccugguguggguuaguaaggggagaaugagauuaggcuaggggaaagacuggguguuaacaaggcucagaucaugcagggccacuuaaggcuauauguuaaggcuugggacauuuccuuuuugcuaagaaaaauggcaaaccauugauaggcugaagcaaggauaugagaugaccaguuuugucuuuaaaaaggucacuuugguugauggguggcaugggaugagaggggacuugaguagggcuguacacccaaagcacaaaaguagccuugaguaagguuuuggcaguggaaguagaaaagcgaaugauugaagagagaaugaggaaggaggcugacucaaucugaugaaugauugaacaugaaggaugacagauaccaagaauuaaggccuggguuucuggaugguuggaguuguucaguaagaaggguaggaggacucgacugggggguugguaggggauaucaugaguguaguuucugacauauugaguuuuagguucaauaacuuacggaaagagcaaguaaauaaaugaauuuaguuuuggaggugucuuaaagaaugacagcuugcauggaacaaauacuccacucuagguauaaucugucuuagcagugcagggugcaugggguagcuuuauuuccugaugugaauaucauauucauauggaggcuuguaaccaggaguacuucuuuguaacuuacuuguuuuuaaaaaaaucagagguggcuuuuaccuugcaaauauuccaaauaaaauauaaauggcuguuaacagcugaucauucugguauucucacuaggcagcaggcaccuucccuguguugucucauguaguucucagaauaacccuaaaagguagguacuauuaacuacacuuauagaugcagaaauuugaggcauagaggaaguuaaagaagucacccaaggucaccuagccaauaaauguuggugauaagauucaaauucaggcaaaaaacugagaaggaaaaaauacauuuuagauuuuaaggaaaaugccaacaguuguaaaccuucugucagucaagguaaaaaugggcacaguuuuucauagcuaucacaacuggaaguagaagaauaccauguugccucagaggaauuuuucauguucucaaauucugaaagucaccuugcaagacuuuaaacauaguguguugaaggacauuguaagcugaguuccuaggaugaguuucacaguugucauuucuauuauauugucaacaaauuuaagggcaugagcuaacuuauugauggugauucugugauggucugugccagugcugcucaaaagagacuucuuccuuuguguuagaaucaccugggagacagauuuucaauuaggaaucuuauuuaucucucuucuuccuccauuguucguaaacacacgugcgugcgugugcgcauaugcacacacacauagaaaugcacauucauuggguaugccaugauuccuuccuuuccaguuaaaaaauagugccauuacuguuuaauuuacauauaggauguugaaggauguuaugggcugugcuuccagcagggauauguccuauuccucagauauguugggacagaaaacagauuaaccuuuggucagguugauauuuucaaguauauagcuuuccaguaaucuaauucagugauagagcuuaauauacccuguccuaaauaccagcuggacauuuauuagggacuagauaggagagacacuugcaaguuuuacuaccugacaagggccugugguaugaauauuuuauauugguauauuaaagcagaucuauaaauuuuggaaaucauaugagcaguuuaguguugacauucuauuauagcuauugagaauuacggccaguauucuggaugugggcagggaagggacauuuugcacagaagaaaaguaaucguuccagcaugaaugaucaugaugugggugcggaguuuaaaguuuguccggagggcuggaggauguggcaguuccagccucucuuaauaggaaagaccugugagggguaggcaagcuggcagggggagguagggacucguguuuucucaugagcacacuguuuuaacuuagaucauggguuaauuugggaugacuuuguggggagugcuaauggaguuuaugggaaagcagcuggaaaaauaagcaaauaucauucuuuggaucuuguaucucaugcugaggaaucuagauuuuaaguaggaaguaacguggucagauuugcauaucagaaagaaccuguugaugguguggagcgagaugauaggggacugagaccagaggcaggaaggucaggagacaguugcgguagucuagucuagaggugaugaaaaccagggcagugguacuaggagugaagaggaaaggacagagauucuguguagguaaugucugcagucacuuugugacugccaccuguuagcuaugacagcgaggggagaguugaggaaaaguccuagguuucaggguuggguagcuggggagcuugauggagacuuuuacacagggaccuuggaggaagagcagcaguuugagguaugcuagggagcggagauggaacuuaauuuuuauuuugccaaguuggacacguuuguaagcuguuggcuagauuggggaucagggaguaggugaaggaugaagaaauuuaaaaguaaagaauuugagaggccagguaugguggcucauaccuguaaucccagcacuuuaagaggcccaggcgggaggaucaguugagcccuggaauuugagaccagccugggcaacauagugagacucugucucuagaaaaaaauuaaaaaauuagccaggcauaguggcauauaccuuuaguuccagcuauucggaggaggggagaggggugcugaggugggaggaucacuugagcccaguaggucaaggcagcaaugagcugugauugcaccacugcacuuucgccuaggugacagagcaagaccuugccuaaaaagaagaaagaaaaaaagagaaauuugacagugaguguaaauuguuguuuaaagaaguguuuggcuguggagaaaagaacagaugggagaaugauacuagaggauguaaaccugcaauguccaguacaaguuuucaugaugaugaaauguuugauaccuacacuguccagcauggcagccauuagcugcauauggcuauugaucacuugaaagagugcuaguguguacgaggaaauagacuuaaauuuuauuuacuguaaguaauuuaaauugaaauagccucgugugaccaguggcuaucauauugcacaguggugacaguugacugagaguuuugggguuggcagauuuacuuugauggaaauaacuuugacuuuagcuaugagaaaacccaagagaaguuauguuugaagaaagaggagagugacuaugaugaugaaagucaugaagaggauuagucuugaauaaagauguuaugucauccugagucugcaagaaacagaauaaaagguggugcaguuguuaaaaaaaaaaaucuuaguugagcaaauuguagucuccaaucucugugaaauagaggguaaaagcauuugcuuaagagugacuaggguagcagugggacaagagaaggagccaaccaagaauuaguauguggauugcuguuaauaguucugcugagauugugggggucauacauuugggauggcagcagaauauauuuguguguguuuuucucuaauugccauuagcaaccuuagugucauagcugaaaaaauggaguauuagcaggguucucaguugacuauguucauggaggcaauaguaagaggaugcaggauugugaaaucugaaguugcugaugagauguaauuaagcugauuauucacagggucacaggaaagaaaauuacugaagcuguaauaggcugauacauugggagaacguggcuggggcaaaggaugaauguucaaagauguugaagaguagguacagugguacaguggggauacauggguagaaaauuagagggagaggaaaugauugcaucugagaaugagcugaugaagucuaaugaggugaagaacuaugugaugaugacaagacccaggguguggcugugaaaggggauggcugaagucaaggagacagauuaaggucauuaaggaagaaaauacuaagauaaagguacauuuguuugggucuacuguagcguucuuauugacagaaagacacuaaugcuaaauaaggaauucauaauuccuuauuauacgugguaguuucucuuaugaaagguaagaugaacauauaaaauuagacacaugcuuuguauauagacuuuaacucaaaaacuuugggaacuuaagaaugagguguccuuucugagacauucacuuuucaggugugaauauuuaaauacaauuagcaauaucuuuaauuauucauauauaaucugauuugcuauaacuuuuauguuguguaauuuuuaaaaauuucuaucugcuuauguagacaaaauccaguccucaagacaucuaggcaaaacaacucuuauucuuccacuauagauuuguaugguauccuauuuuuucccccacauaaauuuauuacuauuauacuaacucagcucaaucaguccugcuuuguuuaaaucccaugcaguuuuaacaacagaauauaaugauguaaggaucuuuccuuuccaugccgaauauuaucuguacuuaugggaaauuuugauucuuaauucaacccauuauaaaguaaaggugagugaaaaccacgauuauuuguauacaaauuuuucauggagagaaaaucuacacauuuguuugguuuuaauacaguacuauaucucucaugguugagacacugaggugaaagucuuuuuaguucauucuagguaugaaaaaucugucauuguuaguguuaaagcuuuuuuaaugucuauugagagugcuuauauaaacuuuacuauggaaaauguuguuaaaaauacguggaaucaggcaacauguuauucaauauggaauuccaaguccauauaguucuuguauucaugucuaaaugaaaccaucguuaaggguuuuggacucucuuuaaagggaaaaauauugucuugaauuuuugauguuaauaguuuggcauuuggcccaaaaugacauuauaacgucauuuugcugcaagcuauauugaaaaaggagcuuguuagaaauguaguugauauucacggcuaacuuuaugaaaauuaguugaagcagucaucuaauagaccauuuuguuccagaaacuagaacuaaaaacucaaauauuaaacuguuugcauauauaaacuauucuuuaauaaaguucuacauucaaucuaguuaaacuuuauaaucccacauucucccagauguguagugaauguuucacugugauacagugccuguaacuuuucuccuaacaccagcauuaugguagaguucucuuaaacccaauuuaggcaaagguauauuaaaggggaucuguuucagcacuauaaauuccugugagaaaaugcagauucuagacaaaacuacuuuuaacauuuagucauacacugugaauuggguugaauuuguuaauuucucuuaccuggccaaauuagagaucaccuaaagcaagugaggaaggcauggcgaggcauuugagaaacuucgaacucuggggucuuagggucuaacuuaaaggagaauuaaaugaaugagauagauuuuuuuggggggaaaggaacuguuaaagaaaaacuuauucuaacacuuguuaaaaugguaaggcagacuuuauucaggacuguuguaauagguauaaggaccuuugcagugggguuuugcaguaggcaagagagauugggcucagcuccagauacgacaaggagaaguggaaauuuauagucaaggagcaggguggggguuaguagaugggaaacuaauaagaggaaacaucaggggugcacuuaggggaauucugguuaaaccaagcuaacaggauucuuguugaaggcaggugagggugaucugauaucacuugggggaugguggaggaugaggaaccccaucagauaucaaggguaauuaguuaucaaggauggggguuucccacuaaaccaacuuauuaacaggauucuugcuaaaguuggaugguguguagauggacacagaagucuaaaaccugaagccuaauugggaagaggauucagaggagccugacuaaaguuuggucaagaaaagacucuuugucuuaacuagaagauggauuuuaugacuguauuuuggguuguuauccaggucaagcaugguuaggacccugcuguggacaacugcacacccagacuacuaaugccaguugaugacugugguugcauaucucuucucaggugaaagugguuagcaaguagaauaaaaagaccuggaauucuuugguacagcugcuuauugugauggggaggaguucaaaggaacacuuagauaugggaauguggaaacugugcccugccagggcuuucugcaggaagcugucaaaaauuagaagguuuacucagugaaggcugacaagccaguaggacuugaaaaaugucucucuauauugagcuuucaggaaaagaaagaaauuucuacauaaaaagaacucuagggcuauccuacucaaagagugguccaaggaccagcagcguuggcuccacgcagaagcuucuuagaaaugaagaacucuagcgcucacccuagaccugcugaaauagacuuuauuuuggcuagauguucaggugauucauacgcaccuuuaaaguuugagaagcauugauguagggauaaacuguucuuuugauguagcagagagcauuacaggaguuugaaaugucaugaaagccacgggaggaggggaguccuagugggcccaugugguucauggucccagaaguguucaaauauucguagccacugaggcaagaguuaggccguuccccaaauauggacauuuggaccauuauucugagguucuuucuaacacugguauucuaugaauauaaauacaguauuaggauucauaauuaagcuuuuuuuuucccccuagauguuucugucacuagagcauaauugagaaucauguuuaacacuuuuucugggaacccguaaugaaaauguuguaggggaaaugucauaagacaagacuuucauccucagauuuguggcaaauaaagaguaagauuaaggagauucucuaauuaacuaauagaaagauuuuaguguaaaauacauauaaguacagcuauucacugugcugcuuaguuuaaaaaaaauucuguaaccuuuuaaggcaggaaaaaaaaaucccaccucuuuuugugccuugaauuccuuuggcagucugcugaauucuauaggcugcuucucagaacaguguuuucaauguauaacuauaauaaaaguacacagggcuacaaagaaagccaauaacuaaauaacauucccaaaauaguaaucuaaaauuggagacaaaguaauagguauguauauuagucuguuuucauacugcugauaaagacauaccugaggcugggcaauuuacaaaagaaagagguuuacaauuccacauggcuggggaggccucacaaucauggcagaaggcaaggaggagcaagucacaucuuacauggaugguggcaggcagagagagagagcuugugcagagaaacucccguuuuuaaaacuauuagaucucgugagacccauucacuaucaugagacagcaugaagaucugcccccaugauucacucaucucccaccaggccccucccacaacaagucagaaucaugggagcuacaagaugagauuuggguagggacucagagccaaaccauaucauuauguguuuuuauuuauauauuaaucaucaguaucaaaucuaguagcuacugugacuucaaaauauuggcuagcauaaaugguauuuuaagaucugcagcuacuacaaugugauguggaaauguuuuugauuucugcaggugacaaagagguucugcugauauuaaccagguuuuuuucugcuauguuccuaauugacagugaugcuaaguuucaguuagaaguuaguaaaaauaaagauggaacauauuuccccaaacuugaguucauuaccucccaauuucauguuugaaggugauuuaacaauacuugauauucuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccaccgcgcccggccggugauuuaacaauacuugauauucuaaggccacauuuuaauuuuauuuuacuucuguuggaagccuguuuuaggauuccuuauaacuuuuauuauuagucucuuauuuuaccugauguucauuuaggagauaaauauuuacuguguucauguuuuggguuuggauuagggaauggagaggagaaaguaaggagaauacugaauugaguaagugacuguuccugcucuuaaguaguuggcaaaauccuuguuuuauuuuuuuuaauaaaacaagauaaauuuuauugaaaucugauauaggucagcucucgaguuuugcaugguugcuuauaccuuaauguuugggaaacacugagaagaucccugucuugccugaucuugaauugccugaagcugucacuuuccugaguuccuucccuggagaauguuuuaggauguucugggcaguuguccauggacaaagagcugucuuuuaaaaaauuugccggguggauuuuuaccaucggccaaacuggauaauacuuuaacauguacauagaagcucuuagacuagucauauagaaagggcuugguuuucaugucaucucgccugugaauacagugacccuauuuugugaaccgaaagucugauuuauuaacuuuuuguggguagaaauauucauauagagauuaaauucuuuaauguauauaacacaucaccuauggauauauaaaauuaugugaagaagauauauauaccaaaagaugauaauuuaguuuuauuauugcaaauagugaucuacuaaugaugaucugcuggggaagguacuuguaugcauauuuauucuucaggcuugaauauuguuugaaaagaacuacccuaugagguagauguugugauccccauuuuguguuugaggaaauugaggcuuaaagaagccaaggaaugugcccaaguuagaguugauagaaaaccagaauuuuacugcguguauuucugauuccacgguuuauauauguggccacagcagacaaaucuuuaagucuaaaaccuggcaaugaauacuguaguguaucauggggugagggcgguuguuguauguugugcacacacacccucaugcauuuuucucauucucugauggcauuuuccaucuuuuugugucugcuucuuggucugcucaacccuccuccuuaagugucaaaccaagaaauuaauuuuuauuauuuacuguauuuauuuaaaaguuuuguuuguuauuucuuuguaacugguaaugcagaucauuaacuuguauuucuuuuaagucauuuaagucauuuuuuuuuuacuuaggaauuuaugaugcuauaccccacuuaccaucuaaguacucauuagagauauguauucaaguaaaaauaaauguaauaaaaguaauauaacgugaucauuuaagaugaucacagcguggagaggaaggaggcaagcaaggggcauauaucagucagcagguauuaauuuaguucucacugguugccuaaaacuguauuaaguacccuggaagauauaaauaauauggucuguuccagcccuugcaaaguuguaguacuggggagugagaagacagccuaaugcuuggcaggaauggaacuuacagugugaaagugagugugguuaggaaagggaaaacgcggugaggaagucaugcugcuguuugaucacaucagguaaaccccgcccacuuagucuuuggaugguugaaaguaagccauuucagccuucaguaaucugucuggcaguguuguggaaaguggccugagaaugacaccaagucugaauuuggcugucugacuuuucacucauauugcuggguuuauagagcugacucuuaccaugcccuauagaaacuguuagguaauuuguacaagggccgggugcuuuaggugagaauagaaggugccagguggcugggacacaggguuaguccuuggguucacaagcuuccaccaucuucuggaacagagaaggguccuuuguugcucuucuguacuggggaucuguaucacugcucacacuuaaugaaauuggggauuuggaagggucugucuuuaagaccagcacuuucucuuaauuucucuguguuaauauucuggggacuuuuuuuuucuuuucaauuuggcgccauucaauuucguuuuucuugcuaugguuguuccuugggugaaaauuccacccauuugccccuuucucaccucucucccagccuccaaccagugugggcuagaggcugaaugauguguuuuuucauuccugugcacuuaucgaggcuggccauuugugagccagcuguugggugggacagcagcugcagugcaugcaaacugaauggcaggcucucuucugaagggguaauuagagcugcucccucacauggcacuggaggcacccuuagagaggccugcugccccucacgucaguagugcaugcagcugggacaccaguaauaugaaacuagaccaugcucugguaguucuuuauugagagguuugaauauaaccaguguuagaacagagccauguacaccuuggauccuugcuaccccgagugcgggccaugaacaguagugaaacccgaggggccaugcggcucugcuuucacagcaucuuacuguuuuacuuuuuaauagugucaguuaauguuccguuauaccauuuuaauaugguauuaagacagcagguuauuuucuguguacuaauaagcauuuuaauuguuugcuuuauauaucugaauaaaauucuguuuaagcacagauguuguaauacagugguccccaaccuguuuggcaacagggaccgguuuuguggaagacaauuuuuccacauaccggggugggggugagggaaugguuuuggcaugaaacugcuccaccugagaucaucaagcguuagucagagucucauaaggagugugcagccuagaucccucucuugugcaguucacaauaggguuugugcuccucugagaaucuaacgcggguggugaucugacaggaggcggugcucaggugguaaugcccacuuaccugcuguucacguccugcugugcagcccaguuccuaauaggccacgaucgguaccaguccgugggauggggguugaggaccccuguuauauuauuuuggacacugcuuagaaugaguaaaacuuaauuagacucauuuauuugaauuaguuuauuguaccucaaaaauugcacuucuccuauguuagugauaacuugaggguagaaaaauguaaauauaaaaauauaaacaaaaaaaucuaaauuuuuuauuggacuuuugcuuguagcuucgaaaaacaaaaauuuaauguccuugggugguucgaaccuagugguuuaaauuuggucuuuuuugcuuuaagaugcuguaacaguuuccuagcauuuuuuuaaagcuuucuuuuuuguuguuuaguuggagaguuuauuuaaccauuggauguaacuauugacuuguuuucuuuuuuuuuauuauuauuguacuuuaaguucugggauacaugugcagaacgugcagguuuguuacauagguauacacgugccauggugguuugcugcacccaucaacccccgucaucuacauuaaguauuucuccuaaugcugucccuccccuagccccccacaccccaacaggcccuggugugugauguuccccucuccguguccauguguucucauuguucagcucccacuuaugagugcgaauaugcagguuuucuguuccuguguuaguuugcugagaaugaugguuuccagcuucauccaugucccugcaaaggacaugaacucauccuuuuuuauggcugcauaguauuucgugguguauaugugccacauuuucuuuauccagucuaucauugauaggcauuugaguugguuccaagucauugcuauugugaauagugcugcaauaaacauacgugugcauguguccuuauaaaagaacgauuuauaauccuuuggguauauacccaguaaugggauggcugggucaaaugguguuucuaguucuagagccuugaggaaucaccacaccgucuuccacaaugguugaacuaauuuacacucccaccaacaguguaaaaguguuccuguuucuccacauccucuccagcaucuguuguuuuccugacuuuuuaacgaucgccauucuaacuggcgugagauggugucucauuguggauuugauuugcauuucucuaaugaccagugaugaugagcuuuuuuucauauguuuguuggccacauaaaugucuucuuuugagaagugucuauucauauccuucacccacuuuuugauggaguuauuuuuuucuuguaaauuuguuuaaguuccuuguagauucuggauauuagcccuuugucagauggauagauugcaaaaauuuucucccauucuguagguuaccuguucacucugaugauaguuucuuuugcugugcagaagcucuuuaguuuaauuagaucucauuugucaauuuuggcuuuuguugccauugcuuuugguguuuuagaaaugaaggcuuugcccaugccuauguccugaaugguauugccuagguuuucuucuaggauuguuaugguuuuagucuuauguuuaagucuuuaauccaucuugaguuaauuuucuauaagguguaaggaaggaguccaguuucaguuuucggcauauggcuagccaguuuucccaacaucauuuauuaaauagggaauccuuuccucauugcuuguuuuugucacauuugucaaaaaucagaugguuguagaugugugguguuauuucugaggcaucuguucuguuccauuggucuauauaucuguuuugguaccaguaccaugcuguuuugguuacuguagccuuguaauguaguuugaagucagguagugugauaccuccagcuuuguucuuuuuguuuaggauugucuuggcuauaugggcuccuuuuugguuccauaugaaauuuaagguaguuuuuucuaauucugugaagaaagucaaugguagcuugauggagauagcauugaaucuauaaauuauuuugggcaguaugaucauuuucacgauauugauucuuccuauccaugagcaugggauguuuuuccauuuguuuguguccucucuuauuuccuugugcagugcuuuguaguucuccuugaagagguccuucacauuccuuguaaguuguauuccuagguauuuuuuucucuuaguagcaauugugaaugggaguucacucaucauuuggcucucuauuauugguguauaggaaugcuugugauuuucgcacauugauuuuguauccugagacuuugcugaaguugcuuaucagcuuaaguagauuuugggcugagacaaugggguuuucuaaauauacaaucaugucaucugcaaacagagacaauuugacuuccuuucuuccuauuugaauacccuuuauuuguuucucuugccugauuggccuggccagagcugccagcacagcagucugaguaaagcuuucuuaaggaguuccuugugauugcuacuuccaacuuagaaugagguuaagaagaaagaaggguguuauauuaagaccaggaagggaaauauugucuccaaccugaccuuaccucuccuuacaauuauagaguuggagggaaagggaggauuaaggaggaggaguaguucguuuuaggaguugagauaauuguguucgcuugguauguauauacuuuuagccaacaguuucaauuuucacacuuuauccuucaugacuaggaauccauuauuguccuugaagagcucucauuucagugucugcaggggcuauuuguuggcaguucuacagaauaagacugugugaagauaugucucaucauuuggaccauuuuagaugcaggagaaugaggcccaugggacccaccuuaaaagcaugugaauauuuuacuuauaguacacacuuaccacauuuacacacauauguccccaaggacaaagcaauacuuagcccaguggaaugcugauaggugcaaguugcuuugaauaauacuuuauuaaaauguguuuacacuuaaauaauuaugugaacuguaaacuguucuauuuuagacucuagaauauuucuuaugaauuaauuuuuuucccucaugcagaacugguuagauccugcuaaagaaauaaagagacaacugagaaguaaguauauaaauaaucauucuuugaaguuaaggugucuugauaucuauuugugauauaaaugaucaguaauagaauggucaguucuauuuugcauuuaugccaucuuagaaguuaauaauacuaauaauauuuuuguggaauugugacuguuucguacauggcucaggugcuccuacuuuugggaagguucuagacucacauuccuaaauauucacucagaauguccuaccaaguaacaucugacauuuuuuuucugggaaagaaagagaaacuacuuuucuguaaauuuuacuuucuauguaaauuuuacuccagugagaccugauacuauugcuuugucugcuucauuuugaaagugcauaauuaguucaauaugcacaucuuuggccacagagacauagagacacuguuccuggauguacuggagugaggacucuuuggggagaagcaaggggaacaaucuuuucaguucucugaggucacugccaucucugcucauugguucuacaauccaaggccacuuugcauacucuuugagccugggcuuguaguuaggccucauuguucauuucuuccccuuuucccauuuguucuuguacaaucccaaaaugacuccaagagucccacucuaaccagcuucaguucucucuauacguucugccucugcagguuguuuugccuguggcuguuuuuuugguaucugugccaagaaacaugauaaauagagagaaaucucuguuaggggaucuggauacuuaauuuacuucagggucugugaaugacugaagcagagaagguaggcagcuacaggcaguuggaauuuucggucuggagaauaaaaucugaaggcugguaaauuccuaacagccuuccucgacuguggagcccagaguugucccaggagaaaccucuucuccaggugccagcaugcaagaugcccuuuguacuguugauuucauuuccuuacuuacuuauuauuccuaaggucaaaauacugaaaccaaucuguccuuucccuucuugcccuuuucaucuaccaucuagcucccauuuuagguucuucacauuuguuuucuuuauuucuuucucucucgaauuauuuaucuuuuugguagucuuccugucauuucuuugcuucccuacucucuuuuuuuauucugagcauauaccuuauuuuucccauuuccucuuccuguagacucaucuuucuuuuccuuuuuaaaaacgucuuugauuagagugaccaaccuccugauuugcccaggacugaggggcuucucaggauaugagacuuuaagugcuaaagcuggaaccagucccaggcaggcuggaaugguuggucacuauccuuuugauuauuauuccugguuucccacauucucuuucuugcauuuauuuucuugguguuucauccauuuaugcuugcuucaugauggaaaagggagaaaaagaagaggaauaaguagacaccagauacauuaugcuuaccuuauggaagaaacaguaccagagcuuugaaacuuuuuccuuugucccuucugcaguuguuacuuugcaaagugcaugcauucaaaaagguuacggaugcuuaguucuuacacuuucucugaaaccagaccugccaagugacccaaacagagagaacagggcaaccucugaaacaugauugauguuccauugaguuguuuccuaugguuuuguuuggguucuuguuugauuauuauuauuauuuuuuuuuugugccacucucuucagagucauggagauuuccuaacuuuuggaagccaaaccucuugccgauuaugaaucauguucuuauguuuugauuaucugugaaguuucaaaaaguuauuucagaacuuuuacccuugugguuuggcaauaugaguaacaguaagauuagacuuuuuaaaacuguuggaaccaguucuuuaaauggcauccuguacuguacccaucaugaaagcaggcugaggaaaugaagcuuuagcaguuguaucuaccucuuucuuucuguauuaaaauggaccaaaaaaccugccuauucuauccuuggugucugcuauaauuuuauuuuuauuuuucagcucauaggcaguuagcgaagauaaauauuaaucuuuuuugagcuaccuaugacaaccaacaacuuaaugauucucauuuaaaauuugccuuaaaaccuuuauuuucugaaacauaaauaagacuauaugucuaaggcuugcguaugacuaguauguaaacauuucuguagcuagaaggacuguuuauaaacagcuagguaaaaauuaugaugauaauauguaaucaaauuaaaaguuuaacuugaaaacugcuaagggaguagauuuuaagugcucucacugcaaaaauaguaugugaagaguaaugcauauguuaauuaggucaauuuagccauuccacaauguauacguauuuuaaaauaucauauuuuguaccaaaauguauaccauuuuuaauugucaguuuuaaaaaagcuuagcauuauugguacauuucaacagcuuuuagauuuggaaguauauuagaaaauauguggucuaguagaaaugucuccgaguccuguccaggcaagcauguucuaguguuauuaccuagaaaacaaacaaggagccauuaagaaaugauaauccugugauaacuuuacuuaauucgagacuagcagucaccuugaagaaaugcuuacacaaacacgaugcauggauauuugacagucaucauggcgcuauaggccaagaaaccucauauaucuugauauucaggaaaaucuuauaucccauuauuauguuuuaaauguguaaagcagaacugaaaucugcuucuuaaguucagcaggauugacuucauugguugaaucaguggugcauugagccaaaauccagcaaaaaaugcauuuguauacaacaguagccauuuaauaaauauuugagugagugaaaagguagugugcugaugguaagacaaaggacaaaaugccacacugaacaagagaaugggauucaaggaauuuuucuucagguucauaaauuaaacaucucauaaggucuuuaaauauguauagaauggaauaacuuggcugggcguggugguucaugccuguaaucccaacacuuugagaggcugaggccgggagauugcuuaagcccagggauucgagacaagccuggcaacauagggagaccccgucucugaaagaguaaaaaauaaguuagccggacaucguagcgcaugccuguggucccagcuacuugggaggcuaggaugggaggaucacuuaggccugggacguugagguugcagugagccaugaucaugccacggcacugcaaccugggcgacagagugagacucugucucagaaaaaaaaaaaaggaauaacauauauacacacacacauuuuuuuaauuuaaaaauauuaugaacuugaagucaaacucuaaauucaggcuaguggaauuauuuggauuccauuaggaaaauaauaccugcccuuucccccauaguuuuacuuuuuuaaaguuauccuacacaugaucuaucaaaauagcaguuaaauuuuacguauaaauagcaguguuuuaacuuuuaacaagccauuuaugauaugguugcuugacuuauucauucuuuauggcacaauacagccaaguguauguuauauacgaauauacuuacaccuacucuacuaaaaccugggaaauaauuguauuguccuaaaguaucaugaaauuauaccaugcuuucccuucuugggaucucuuuuaacaccuucuucaaauagcccauuaauaauuuuuugaauagcuauuaucucuugaucauuacucuccuuccccacaacaauguagaaaauccugaauuuuaaaaaaaaaaaaaaggguggagaauauuuggcaacaggagauccugugguuaaauugaaucuuaucucagaacuauuacauggagguuauauuaaaauuuuuguauaauagaucaccauauaaaacacauguugagguaucaguaaauguuuauaagaaagagaaccuauuacucuuuaaugguggcuuauuuauguaauugauuucuauuuuauuuuuuauuucauuuuuauuuuauaaacaauuuuaauuuuauuuaaauaaaaaaauucugcaugcugauuuauaguuggauuagucuguacuguuugauccuugaccuuuaaauuuuaucacaauagucauucuucuguuaauugggugcauaacugugauauuuaauaauuacagaccuuccauggcuauucacuuuuaaugugaaguuuuauccuccugauccuucucaauugacugaagauaucaccagguacuuuauauuugcauuuuuaaaugaaccuuuccuuacagcucucguuuauuuuugugcccugggagcauagugguaauuucaggauugaaaaccaaaacaguuuuucuuaaguuuuagaaguuuccuugaaaauggguacauccaaauaguuugaaauguugccaguuucaaaaauuuuauucacuuucuuuaauaucuucauuuauauucuaguaaugaaaauuuuaaaaaugauacugcugacaacuuuguuuucuauguuauacuuuuaaaagucacuaauauuuaauauuugagauuuuaauaccaaggucauuuuuauuguauauaacucaugugugcuuauauacuagucucauauuacaaagaugauaugagguuagcaaaaugaaauuauuuuaaaaguccaauugaacugguaauuucuuucucucuucucccuccagaaccaaacaagguaggauuucuuauguagagucaauagcuaguucauuuccaucuccuuggagauugugugagcuauaagaacauacacuugaauugcaaagaaaggauucuguuuaggagcaagagaauauuuauugauucugaguaccugaauggcaaccaagaaacauugugaaucaacaaguaccuugaaaucuuagcccaguuagacuggguaccagaaacauugugaaucaaucaacaaguagcuugaaaucuuagccugauuacacuggguaccagggauagcauuucuuagcuuuggugagaggaaguauaaaggguugauuuuuuuuuuuaaaggaugauuuuuauauaccauauuuuuaaaagguuacuuacauggucaaguacaacugugugcagugcaugacuuuuagaaaacuagaggggcuuagcaaaagagucugcuugucuuuaguuccuguaucuuugaugcuuucugcugggccaguuuuguugucagacaucaaguuguggaagugguuaagaguucauaauauccaugugaaauagcaaggauggaaauuucuuuccaauauuggguacauagcaggccggccuuuuuuuuuuuuuuaaacuacuuguugcugaauaugaaugcacuaauuaagcucugaaugaauuagcuucaccuaguaaauaauaaauaguagcuuuuguaacugcacagugagcuacuuagagcauaaaaccugaccgaauggcauguguaggaugcagagcuucacugcaggggugccucugaacaaugcauguaacuggggcuuugugacccaacacucuguacauacacuccuccuggcaguaauuuguuuggagaaugauaauccuuuggugauugcaaguuuguagcaucaguacuuugguuuuccauauaaauggaacuugaacagucucccugucuagugggaggaacaauauagucugcucagcuaacuaaaguucucaguggugcagccugagaccagccaccugccuguacuuguggccuggaagcuuaaaugucaugaucgaaaucuucaccaugacuugagugaacauuuagaagcugggguaggcuucugagaagggcaagaacacuauuucgaauaauguuugaagaaugcuucauagugcugugugaagguacaguuggguaauucaggaagcucaugccauuuuuuguuugaaguuuuuaggauuuagacuuaggcuuugaaaacagaggaaaggaccaaugugaaaagcagagacaauaauauaaaaggaagcaacaagaugaaaucuuuguguuuagguucuaaaacuuccauaaaauguggagaaacaucacuguuguuuauuagagaauuugaggauaaccuggacccaugguugaaaauucaguugucugaaguauguacuguuaaugcuuauguuuuucuacgggucaaggaaacauauaauccuccuuaaaaggagaucugcaaggcauaaaauacucaaaauacuguagugauagcgagaagacuuucagucucucaauuaccgagcacuugucauguggcaagcccuccaguaacugugggacuauagugaugauaaacagaguccccgcccugccugaugauguauuugggugguaauccagguucugaacugaccuggccccaugugcuggguugugcucucugacccaguaacaacaaggccuggaccagaggccagcacuccccauuugauuguguaggguagagagcaggaagaggauugggcccuaaaacccaggccaggcaaguguccacaggacuaagauggccagcugccaguaugaaugccagucucuaaaaggucuuaaagaaugaggacucugcuguugauuugggaggauccauggugaccauagcaaguggugaaguuaaagaguagaaaucacauuuuaaaauguuaccaagaggaauugauaguggggcuuaaaaggugggggaaacccacaggguauauaugacauguuucugcauuuuauuucauggaaaacggaaauucuuuuauaaccguagugagccacauggaacauugaaugagaaacauuauagccacuaauuauuauagcuacuaguuauugauucuuaagcauguaccagauauuuuauuuauauuaucuaauguucaugcucaucuucaaagggagguagaguucuuagcgucuuauaggugggaaauuacccuuaggcaaguaaauuaacuugcucaaggucauauagagucaggucuuccuggcuucaaagcccaggccuuuucugcuaaacugagcuagcuacugcuuuaaaugggguaaauggaaaaguaagggcuucaaaguagagauuuaccaauaacuguuguuaaagguguuucuggaaaagaagaaaugucaagaugauaaagggugggugaccuuagcuuuucuuacaaaugauuaagacuaguuuuuuuuuuuaaucuauuaauccuuacaucuuuugaggggcgugcuaauuuuuauuacaguuugaaauccaaggagacaguuuaagugauugaaauuuuuacuucaguuauaaaacucuuauauauauacacacacacauauaaauuagccuucuggacucaguuucuauaaauaagccacaaguuuagaagcccaaggagcaaguugaggcuuuuuauuagagaagaugauuuuugcuguuuauaugaagagugccuauauuguauauuuguuuucaaagggguacuagcuuuuaaggacugugagugcuccaaucucaccuaaugguucuccccugacccauuucucccucugcuccucacagauacuucuugugccuucagcuccggcaggacauugccucuggccgccugcccugcucuuuugugacucaugcucuccugggauccuacacccugcaggcugaacuuggugacuaugacccagaagaacauggcagcaucgaccucagugaauuccaguuugccccuacucagacuaaggagcuggaagagaagguggcagagcugcacaaaacccacaggucuguugccuugcuuacuggagagaauggccaugggagauuuaaauagcuucucuuguagcacuuacuagacauuugagcaugauuuacaggauuauccaauuuuuccuuuuggaguuucaccuagcacuaaucaaggcaacguggagcccuugagguauccuuucauuauuuuuauaacuaccgucugagaaacuauacuuguaagacuguauguuuucauguauuggaaaaauguacuuuuccccaugacaccuucuucucccuaucccccuaacacauacacauuggagacaaacauguccacauacuuauuugacauuuacuuuauauuucuucugccuuauaauuguccuuauuacuauaugugguaagaaagcuagggagauaaggaggcauugggauuugaauuaccaguguagguggugauggacguaggaauaguaacugaaauguacaggugauuccguuggaagaugacccguugguuuagcuaagauuacuuaacauuacauuaauaccauauuacgcuucuagaacauuuauaugugugugaaaagaaaauggacuuuuuacacaaauuuuuauaacgcuagcuacaaaaugauaauuuguucuauauugcaaaauuacaguuuuauuaaauauuacuaaagugaucugaaaggaacuuucaaaaauuagguuuuuaaacaggccacauucauugauuuuucuuuaaaaaaaauaugguauuugacucuaaauguuuucuuauuaauuuacuuaaauucuacucaauagacauuuguuguauaauucugaugugaaauaucagguacugacaugccauggggaaugugaaaauuaaugggacaugaucuugcucuuuaggagcuuaaaguuuacuuaguuggguauauagauaggaauggaaauaauuuuaguauggacaauugauuuguguuaccuaucauagguauaaaaucaaauacaaguaauuucaaucuuuauuaugaucaacucuagugaaauaaaaugaaggaguaagaauguguuuaucacagaaagaugagaucacuguuuuuuauucuccaguacuuauguuguacacuauugcuggggcuuuuuuccucagugaaaauaaucaaaagcaacuuuuuaagauaaaauggguaagaguggagguauaccuccaugcaguuuagcagguuuacauuauaggaucuuaagggaaaaauguuagagguugagaguuguuuucuuaccauuuccuacuuuucugcaaacuuggcuggguaacuuucucuccuccaaacccucugagcacagacacuccucccauucugacuacauuugcucugcauccauuaauaagauaauacuguuucuuuugauucucaggggcuuaucgccagcacaagcugauucccaguucuuagaaaaugcaaagaggcuuuccauguaugguguugaccuacaucaugccaagguacuguaaauguaacggggaguagcaucauaguagucuguugacugagguuuugagagggcuccaguuucaggauagcacagcuuauuuuugggaaaaggauauuugcuuucaauugagggucucuggaauauuuccuuggugacuaauuaugggguguuugguugugggagggaccauguauucugucucuaccacuuguuuucccagucuuuuuaauuaaugcccuuucauagguacuuacuaugacacaccuugucagccuuuuuuuuuucaccgcuuauccugguuuauuuugcauugcagcuucugcuaggccaagugcugugucugucccaguucccucucccaccucugucuugggagaggagagaagaccuuagcaaccauaaaagggcaaaaguagcaugggaccacuuuccaaaaagcuuauguuugaugaaggagcccuagaguuggucuuuucccuguagguguguuuuguacuuugugaaagauaacguaggugggcccaggcucugggugauaaagcaccuucagucuaauuugaaagaugguaaaagagugggacaauggggacaugggaagccagucauaauccugaacaccguaaucccaaaagaucaaaaucucaaaaauauaaugcucgaaaaaauaauuuuaaaaguuauuuaaaagacauuuauuuacguuuuuaaggggggauuugagaaacauaaaacacaacagaaguucauaggccacuuuacacgauaaauuaggcaguaguaacauacauuuuuuuugcaagcauaaacguucgguauacuaacgagagucacaggguaugaguuaugaauagacaaauccuguucauaaagaaauaagucaaaaagugaaauguguaagcgcacaucgcuauaguugguugccaguaacaauaucacuuacaucaugguucuaguuuagaugauuauguaguggggagagucgaggagaaugacaagcaaggugaaauaugaauuugguuuuaaaaaauauguccagagucaacauuuccuuaugguagccugcuuuuaaaagacccugccaaucuguagauguuguuuagaagcccagauuauaugauuugagaaaucucuaggaaagcuccccacacaaugaugucuuuccucccuaggccucugauuaauaauucuugcauuuguguuauuaaucauacuucauauuuacaaagcacucuuuuucuccucaguggcuuccuuuauuuaaauauuuuucuuuauuacaaaacuaauacauguucaucauagaaaauagaggcaaacagaaggaaauaaagaucacuuaaaucuuuuuaugcagaaauaagcauucuuaauaccuuuuuucuuuucuuuuuuuuuuuuuagaccccugggcaguugaauucacaugccuucuaaaaauggggucauacuaugagcaucauuuuuguuaguuuuuuuuuuuuaacuuacuauuauaagauuuuucugucaguaaguagucucuggcagcaucauuuuuaaccacuagaugcuguaugcccuuaauuuuaaaaaguacuuucauaccaucucauuuuuuacaaguauaccaucucauuuaaaguuugaauguuuuuuaauuuuacagcuacauaaaacagugcagagaaugacuuguuuaaagccauguauuguuaaauggucuaucugccugauaccgucugguaaauccuaguaggaggugaaacagauugucuuaacacuccaguguuuuucagaucauuuucuauguaauggggacaggcuagguuagccaagaaacagaaauagggaggaaggaaaaaauauguuugagaccaaaaagagcucccaaaccucuccuccucuagacccugccauucuuaccacaugcaaaucuugcaucucuacuuuguugauuguuaguuagaaaccaauucuuaaauggcaaugcuguauguaagguuucaggauucuuguuuuuaauguugucucuuagaaaaguaagaaauuguggacucuguucuaaguauaauacucuuucuugcuguguaguuaggagcagaacacuaaaaaaauucaagauaaccuucauucuguuuaucauccgauagacuccuuagguaauauuugauaagcaagauauuuguggcuuauugaaaagaauauauguggcaguuuaaaagaacuuuucauauuucaugucguuuaaaguuuugugucuuuauuuuucauugccuuaaaaucagauuuuuuuuuuuaauuagaagaguuuguaaugucauauucauguuaggaugaguuggagagaguuaaauaaaaggaaucucaacaaaggugcagagaaaccauaagagaagcgggacacccgugguagccccaggauaguaucugcagcuauccuaaucucucuaggucugucugaaggagggagggcagagugguuuccaaaacucccaaggagagauauguguggagagggccgucuuguggggagccauugucagagggacauagucagccugaggugaccacguagggagggaaucuggauauuaaacacccugaccucccuuuccuuucucuccugauccuuugcaagaacucccuuuauacugaacucauuugaaagccagccaucuccaugcauugccccaugcauugcuccauggagcagugagcaaugcagagaaggugcuccuuuccauuaguuuauuuuucugauuuugauaccauguggcauaacuuacaugugaaggaucaaggccugccuuuuccucuuucacuuccuacccuucaucugucguuucuauucacacaaauacugguaauucuaaaauaauuacauagaacaacaaaaaucaacugauuuacuugaaucugcguugugucuauuuuuaagucagauaaaauagcuuccuuguccuguccaaagauugcuucagacuagagauggcucauucaauguuucaaaugcggguugccuccccacuugugguaagaacaugccgucucgggcaaucuucugccuugcucccgguggccaugggcagugaugguuuuggcaaacacaccauggggucuggugccaaguugcuugggcaccugugccugauucaccccagcuuuuuagucuauuccuagagagaguuguggcugccaagauaagggugaguaaagcaauugauuggauuuuuuaaaauggcucaaguuggucuaauguaauuuuauuuguauauaugaauuacucaagugucacagcagagaaagcaacuggcaucaauuagcuaauacuauacuuuuauuuauaaaaaacugauuuaaaugguaucaaaauguucugaguaauaagauagacaaaauguccuuuuauuaaauugggaguuagacuaaauaugggguuuguugcaacauuuuuugugagaauuuguuucguauuguuugugauuucugaaaaugugaaugucuuugagcgguagucuucaauuuuacauauguugaaugagagccagcucuccucuuagagauaaacaauaauuuguauguuuugaauacaugcaucuuagaucuucacuacuugaaaugugaggagacagguuuucacuuuugccuguaaauuuguuugguuuuuaaaacauaauuuaggccugugauuauucuagauugucaucgauuccagauuaaagcucuagggaaagaaaacuauuaauaacuucaagaauagucugcaguccuuugaaacgugccagccaaaggaaugccuaaugagaacuggaugucagcauucuaaguuaaugaaaaacugcuugaaagaauucagagauuucagcacugucagccuggaagagaaauuaucugcaagggauugguguuuugcaaaauauuggcauaauuuuaagagcuauuagcuaggguaauccaucugagguaaaugcaccuaaaggaaaaugguugaacacaucuuaggguaggccaacagacugucccugaggcuggacuagccuacgggaaaagcucauuuuauuucccguaucuucaggaucucuaguucugcuuccuuucuucucuguuagcuccuacaguggagcuugagaacauaugcauuacgccuuuugaaggacacugugucuuauggucauguugccguaacucuucggcaaaucacaccugaucccugaagaugaauaaauuuaacauguaugugugugcgccauaguuuucauuaacgugcguacuugucacuaaacuuuaaauacaaaccuguuaaacugucauuccugaucaugauuugagggagcuaauuagcuucuugauuuguguaacuuucacagcucuuaaccaugguuaauuggguuaugcuuggcaggacucagaagguguggacaucaagcugggcgugugugcuaauggacuucucauuuacaaagacagacugcgaaucaaucguuuugcuuggccgaaaaucuuaaaaauuuccuauaaacgcaguaacuucuacauuaaagucagaccggcagagguaagccaagacauuucuaaucaguuguuguuagucggccuguuuacgaccaugaauuuaaaaauucuuuucuauuaauucuaaaauuuuaagaaaauaaacuauuuauucuuccauuguaaaaggucaggguucuuaaugguaaaauugcaguauauauacgucuggucuguuuuuaaaaaaagcaaccaucacgcuuuuuacaaaaaagaaaaugugauaaggugugggcucguuuuuucuuguugaaucaauuaaguugugaucauuaggaaagcaauaagaugaguuuuagugaacauugaaggauaguugguuuaugugagccguuguuacuugcuuuuuguagaaaauaguauugcagucuaugaaauucaucuuuauaugauuauauuagauaugcaauauuuaccuuuuuugagaagaauaauugcuucucacagaaacaucugaaugcaugcuuuucaguaacuucuagucaguucuuaaggaaauaugcugauuuguuuuacggauuuauuccagcuggaacaguuugagaguaccauuggauucaaacugccaaaccaccgggcagcgaaaagacuauggaaagugugcguggagcaucauacuuucuacagguaauuuuaggaaaacagcucggaagccgggcaugaucgcacaugccuguaauuccacugacucaggaggcagaggugggaggaucacuugaccccaggaguuugagaccagccuggggaacauacugagacuccaucucucuuuuuuucuaagaaagaaagaaaacagcuugguauugcuuuuaguaaccucugugaauuaggaggugguagugguggggaauguggcagaugcauuaacccacugucuuugaacucuuuucuccccuccuugccucaucuccuuugucugcagucccucccagguccauuucuguccaugcauugucauuuauaacugagcugccccugcagcugucuagagcuccacuuucugacucuaaccaccuuuccuuccaccacagccacacugccucaugccugcuaccauucuucuuuccacuaucccuccucuuagguuucacuucgauauucucaucagcugccuccugacuuaacuucuuucccaaaccaacuugaacccuauggucugacugcuuugucaggaacguucugacccccucaaacuacucuccucuuugcacauuuaccuucucugucugcuaguccuggauuaguccuguguccugaccucaccaguuuuggaccugugcuguccaagugcuaccuuaaaaauaguacaaccauugugacacaugcaguuacucuauauaacaaaaaauagcacaacucuauggauuagugcuauuacagauaaauaauuuccagcaugagcuggauccucagugcugcuaggcaagcaauuugucuuuugacuuccuuugccacuccaaaugcucaugguccucgugagucccuaggcaccccugcuuccucuucugaugcccuccacugugugggucacugaaagaagaagcugugcaugaguguucuugguuucaugcaccuucccuucuucccuuuugccuuuaaugaagcaucgcuccucucuccucccauucauucuuucccacuucuccugucucaaggaggagauaaucauuccucugcuuugaucccucauuuugugccucuuaaauuauccugcuuuguaaauuauuuguucccuaguggguaccuuuagguucuuuggccaauaaauauguccacaucuugcucuuuaaaaaacaacaacaaauauguauauaugguuauauaagauuuuguauauaaaaucuuugaucaucuaaccaucuuuagcuuguaucuugucucuuuuuauacuuuucuucaaggacauguuuuuuacauguaguuugcuuaucuuuguuuucuccguuuccucaguuuucucucacugcaguuuagcuagcuguguaucuagauccuucaucuuuaagguuuuugcucuggacuuauggucuaauacuguucuaccaaauacgagcugugucaccgugauaccaaccucucugcuucacuuccaucauccauauaugauaguaauacuaguaucuaccucauaggauuguuuugaaaauuaaaugagauaacacacaugaaacaacuuagaaccauuucuggcauaucauaaaauuuaucuucaccauuaucauuauucuucguuugguaucacaguuugcuauuuuuaaugugaauuaucagcuggcacacaugauucuuucuugacguuaaauugauaauaucuauuuuucaagacuaauauguuaauuuuugaggagaaauauaacucauaaaauaugcuugaaucccucaaguuacacugaucauauaaaucuuugaaaacuuuauaauuuuucuugguagccauaacaaauuucuccuccagacaacaugagccagcucauauaaagcuaguagaugacauuuaugacacagguccaagcugggcagacaacagcuuucccugucacauaaugauaaaaaaaaaaaaaaaaaaagcaauaaucuguucagaaauggcaagugcuagcauucauugaacacuuauuagagucagacacagaauugauugcuuuauaucguggucuauuucucgcccuaggcaagacaacugaugcuuagagaucggugccuguggaggagcacagcagccaggcaucugagcagagauggggaccgggcuuccugauucugacaccuguauuccucaccucugugcuguccucuucuuguauucuuguagcaggaguuuccgaggugcauuagcugugcaaagccucaggccuccucauuuuugcuaauguaccauggacuccaguuuaaaaguagaccaauuugcuccugcaaacuuuugauauaaugguuaacaaaagcaguuuuaaauuuuuaaaccuugcauaacgcugcuuacaaagcuauauaaaagaauauaucuaacacaaagggccagucauacuuugucuauagauugcuuugaaucaggucaguggaauuuauucuguuucaguuuaucaugaaagguacaaaugauuucuuuagaaaauuacgguggcuugcagauugaagccauuaaucuguaaacagaucuauuaauugauagccaaucagcuagauugauacuaguggaauaagaauguaguaauaaaacugauauggccgggcacaguggcucaugccuguaaucccagcacauugggaggcugaggcggguggaucacaaggucaggaguuugagaccagccugaccuggugaaacugugucucuacuuaaaaaaauacaaaaauuagcugggcaugguggcauguaccuuuguaaucccagcuacucaggaggcugaggcaggagaaucacucgaacccgggaggcggagguugcagugagccgagauugcaacacugcacucuagccugggugacagagcgagacuccuucucaaaaaauuaaauaaguaaguaaguaaguaaguaaguaaauaaauaaauaaauaaagcugacacccuugcuuggagcauuuaauagagccugucaccauucugaguguuguacagggauucuuuuuuuuuucuuuauugcagaagaugauuucuaaaaaaauuguacagaaagucuagaaauacuugaaaugauaguguucuuuaagaaaucacucuuccauaguaaaugauaggaaaaguuucgguggaauucuucauguuuuugaguugucaacaaaagucuuccuauuuaauaaauuaagagcucugagauuauguuucuguuaagauauuugucaacuuuugaucaaagagagcaaaauaauuucaguugaacucccaaaaagauugguccauuugcuaaaaacaugcuuuuguauaagccuagaaauauuugacaucaagaaaguuugauuucauucuuuaugaacccagggauuaagcaguagaauugugcuggcaagaagggguguuagccaucucuacagauccacuguguggcauguucuucaugggaaagaaucacuuaauggaacagauuccugaguuagauguuuucuucccaggagaaauaggcauaaauauuaagaauuacuaaugguaauggauuguuacuuggcgcuuauagcuagaagcaaaaauucagacauguguuuauauaaaugauuuaagcuaauacaaauaaauaaccuuugauauacugagaacagcuguuucuuugcuuagguggagaagaacauuauucaugaauacaugaauguggauuuacucaucaccaucauaaagcuguguguguaggaggguuuauaaauaauguucuuuagaaaguuuaguuuuugaguaaucauacuuaaaaugagauaugaaaguacauagcuuuaaaguuuuuuuaaaaaauuccguaaagucuaauuuugcuuccccuuucucucucucuuuuuuuuuuuuuuuccucccauaggcuuguuucuccagagcagccaccaaaagccaaguuccugaccuugggguccaaauuucgcuauaguggccgcacccaagcacagacccgccaggccagcacccucauagauaggccagcaccacacuuugagcgcacuucuaguaaacgggucuccaggagucuagauggagguaaacacauuuaugauaauuuugauuuucauucaucuuucucuaaucccaugaggucagaaaauguuaauccaguuaauaaagccaccagaaauacccuacagggauagccauuuuuucccgaguaaauaaaaugcuauuacuuacaccuacaagagaauaauuuuguuguguuuuagaguuguuacucuuuuuugaagcugucacacuuuuuucuuuuuuuuuguuuuaaaacagguugaacauuccauaucucaaaaucugaaaugcuccaaaaucagaaagccuuugagcacugacauaugcucuaaggaaaugcuuauuggagcauuucagauuucauauguucagauuugggguguucagcugcuaaguauauauauugcauauuucagaauacaaaaaauauuagaaauccgcaacacuucuggucccuaacauuucagauaagggauacucaaccuguauugucagugcacacaaauauuuguuaagaguucucauuuaugagauguuggacacauauguuuuacugauuucucuugaucaugauguguuuuaugugguucaauuuccugaaccuuuuaauuaauggcaaaauguaauucuaaggauuuuuucguaugguagcauaugaaccuuaauccagacgaacauaaaacauucccugcaucagcaaauuuucaugagugaaacaacuuaccaaacuuuccaucuuaugagaaagcuuuaguagcuucaaaggauucauuuuaaauacagcauuuuaacaaaaaguaaauauaauguguuuguuuguucuuuagcccaagggaaaauauguauaaaugugaauuuuuuucuauuagaauucuaauuagcuacauuuuguaguuuuauauaaacuacacaugaaauaaguuuuauauaaacuacacauggaaaaauauauauauaaauuaccugguccaaaauggguuaauaauagguuuucuauaaaagagcuaagguuaaauuuauauuagaaugccuugugaaggaauauucuuucuuuguaauagaaaaugauuaguauggaugauuuucuacccaaagaaauaguuuuccaacauuuuugguugauugaacuaaaauauauauauaauaauaauacuaaauuugaaaauuguauuuuacuacuaguuauuagcagaaacauuuuuucuugucuauuguauuuuucugaaauauaugcucgaacaacuuauauuuuaaauaauuggaguaaaacagaucaaauaaugcuaacagaugaaaaagcuuucuuaauagugaaggauucauauggauugccuucaucugcuuuuucuagaagaaaaacuuggaaaacaaaugcagguggacacauagagauauuugccaggauuuguugguugggauuuugguauauaguuauuaaauccugaaaugugcaaggggguggugaacugugcuuuaaacaaauuuccagaauuguggaaaugauuuaaauucaguugauuguuaauguacuaucacugcuaaaguaucuuuuaggucuucaacaacugagcacuuuuccaaguaaaucugaaaaaugugccaacccauguaaauauuucccaagccuugccccuugccacagagaauuuauacaagugccgaauaaaugcagucacuguuguuuaguacccugagagaaaugauugcucuuucuggaacacugucuguuuucagcauuuguuugaaacugugaggcuguauaacucuuauauugcaaaguuuagcauuuaaaaagagcaguaaaacagcauuuucuuugagguauacaaacugugcucaaggaaauccaccaucuuguaugggcaguuagugcagaggguuacaggaggucuguaucugaaaacaaugauuuuuccaagugaaaacaacaaacauggcacaguaauccauuauuuuucucuuuguguuuuggaggccguaauucaucagauggguaagucaucaaaaggauuauuguguuauugugaaaaauaggaggcuuuuaacgccaauacaugaccagacagccagugaacucuuugauuagggcuuauauucuccguuuuuucccccagagcaaagcuaggcuguaaccuggcacugagcuuuuauuuucuuuaccacuccuuaucaacauaccauuuguuguuguagucuucauguauuguauuuucuuuuuccuguuuacuuuuuaaguaaggcuagaauaauuuagguauauuagccucacuuuaaaguuuggcaaauuaaaauaaauccucuuaugauuacauagcaagugaaaagugggauucaaucuaaagaucaaauaucaaaaugaaaaucaaucuagaacagcuguuuuaggacagggaguccccuccgagauuagaaaaucaaaccccaaagaagacaaaucagucauuuaagagaaccaacaaccaagaugcauuuggggguugaggaaccaagugauuuccugaagguggaaaguaaaaugaacagggacguuacuuaaauaggaucaucagggaaggaaggccuauuugaggaagaaccaggucaguugagacuugaaggaugagaaggaggcagccaaggaaaggacaagagauauuuaauaauaaagcauuccagguagcagaggcggcaacgaugaagcuauaaggugagggagagcuggauacauuccuggaacagagagaaggcaagugcagucagagcuuaggaaguggcgggagagguaagccugggucagaucaugcagggccuuggaggccauggugaagaaugugguuuuuauuuauuccauaugcucuaggaaaccauugaaggguuuauguggguuuaugugcccgcaagagcacagcguuaucuuuuaaaaaaaaaaucauuugaugcaagagaacaauuagauugagcaaggaagcaggcaggcugguuaggaaugguccaggugaaagcgaugguggucuucccuuuagugggaguaggccaauuagccauuugguaucuugggcucugccagggccuacaagcuucucagauguuuaagaccugaauaaauguaucggcuucaaaauacaagaaacugcaugcugaaauuaauaaguguuuaaaaguaugcaaagucagcauuuugucaacuuuaauaacuuuuaauuugauauucaaauuuuaauaucauuacauuugaagccauuucuaggucagauuuuuuucauuuugcaaaauuucugaguauguauaauagguguguagaaaucauaauuguaagcaaaagaauuaaucauagccauauacuuuccaagggaaacuuauuuagaucuuguuagaaguuucuuuauuaaaaaaaacugcuggaggcugggcacgguggcucacaccucuaaccacagcacuuuaggaggccaaggagggcagaucacaaggucaggaguuugagaccagccugaccaacauggugaaaccccaucucuacuaaaaauacaaagaauuagccaggcgugguggcgcgugccuguaaucccagcuacucaggaggcugaggcaggagaaucgcuugaaccuaggaaauggagguugcagugagccaagauugcaccacugcacuccagccugggugacagagcgagacugugucucaaaaacaaacaacaacaacaacaacaacaaaaaccgcuggaaaauaacuauacuuaauguaaaaugcaaauuuauucuaauguugacuaugauuugauaugggcauucaaagugugaguauuuaagggcugggaaaaucuccacaaggugagguaguagaauuagaaauggaaagaacuggccacauuuagaaauauauacaaggaccuuguuggacuugcugguguugaggggugaagagucuuggaagauguucacguucccaguucaagcaaaugggagcaaauaugagaagagcguuuugugaaaagggcaagacuggaaaagaauuaaguuuuggacagggcaggugaaggcuguggauugagagguagcuugggauacauguauucaaagugcuugaggccucucaaguucaguaugguaguucacacacaauccugcccuccaagagcuugcagucuaaagguguuuguguugaccaggcuucccuuaggacauggaaccagaguaaacuucaugguguccguagaguacuuuuuauguaaagugaaaugaccuugugguaguucuguuguuuggggaggagcuacagauggacagagguccugccaccuacuacucacuuugccuugcugauguuugagguagucuugguuugaucugcacuaugacagaauuuucaauacaauguacauuucugccuaucuguaggagagaagaagagagcacaugagggccagguuuucugggaugagggaggugucuauguauagauuuaccauaguucguguuaaggcauugaggaaggggauuaaaaaauaaaaaauauuaaacauaaauauagaaguuaaaaucccuaaaauuuaccuuuacugucuuuuauuuacuauuuuuucuuuugaaggguauucaaauuaaagguuccuuuauggagcaauucuuaaaacuuauuggagcaaaucaucuuaauaauugcauaaucauuuguugcaauagauagauucagaaauaaaucguaggagaccaaagaguuaaaauacugcuuaccuuguaauucuguuugccuuaacucugguguuucagcuggucuuagagcuccuccuacuggccaguuccaugaucugaguuuauccuuccaauaccugugguuugagacccugguguagcucagugcauuaaaauucagaauacuuucagaauuugguaaacguuuaaaaauuaguuuauuuuauaugguggguauuuucagagcucaagcaaugucucuguuccuguucacuauuuauaugcugccuguuuaucuccuguaagggggaaauuuuccauaaaguuuaugauucauauguccuaaaauaauccaaaauugucacucuuuacuagcuccgauuggugucauggaccaaagucuuaugaaggauuuuccuggcgcugcuggggagauuucagccuauggaccuggacuugucagcauugccgugguacaagauggggacggcaggagggaagugagaagcccaacuaaagccccacauuugcagcucauugaaggaaagguaugguaaauuagcacaguaugugguuuuaaacauuuacuuaaccuagaggguaucuguuguauuuucuguuucagaaaucaaguauuuaaaauuaguuguucuauguucucugcuggucauuuauguuuucaaauaugcauaguggucucuaaccuuugauuguuguucaaagcagaauauuucaauguaaguuauuuuaaugcaaguaaguaauuuacuggccuuuuugacuguccucauaaucaccuuaucuaauugaauccucaaaguagaaaagcuaugaugauuugaaauuuauuuuugguuugguccaaguaaaauuuaaaauguagcuucuugauuauuuuaauuauugacuugaauuuuuuuacaucaccaaagauaaucuuuaugaacaaauguauucauuaaugaucuauaauuaaugaaauucucaagaaaagguaauuguuuugugaauagagagugagaacaugguguguugcuuuuggcuuuaucuugugcguacaccauggugaaauggagaaguaacccauauuguguucucaaaugugucacuguuaucuuuuguuaccuugggcaguaacaucacuugaauauugauuugagaagccuuugaauucuucagaucucuuuucugugucugcacaaagcgacuuuuuuuugcaugcaacauuggaaguaagcacagauaaaaacaaaugaauccaucauauugauuucauaguguuuucuauuuuauuuuuuuuauuuuuucgagaugaaguuucgcucuuguugcccaggcuggagugcaauggcucgaucucagcucacugcagccucugccucccagguucaagugauucuccugccucagccucccaaguagcugggauuacaggcgccugccaccacgugcccggcuaauuuuguauuuuuagagagacgggguuucaccguguuggucaggcucaucuugaacuccugaccucaagugauccaccugccucagcuucccaaagugcugggauuacagguaugagccacugagcccggccguauaguguuuucuaaauuuuaacuuugaaaauuuuuaaaagacauaaauguauaaagacaugcuagaugaaguagcugccagugccucaggaauuccuacacugauagccucugaggcccagcauggagaaggucucagggaccaccacaugggcccagucuugugccacaaggucaagugcuaccuguauagcaagugacaucaaaucaucgacauuccaucguuaaagaauuugugacugucauauggaaaaauuauuugguggggaauucagauaaaaauaacagaaauugugaccaacaagguuucuuucaauugcugacaaguugucaggauaguucuuuaaaaauuuugcuaacaaggcacccaggagagugacugcuuacaucugaaacagaagagcucagcauuucagaauaucucuguuccauuuugccuaguuaacuugacauaucuaguuauuuuccuuaaaaaaugaaaaaguucuuuuaaauuucaaaggaaauccuccuugucugcggugaacaacuggguacacuggcauuuuugcuaaugcuuugaaugucugucagcaaccagguuuaaaaguaaauaaugcuguuugaguuucaugggaucuauuugcaacuaguuugaaaauaauuaaaugagucauauguauaaauuuuaugugacacaaguagucuagucuuuucucuuuaaaaaugggucauuuaauucauuucuaacuacacuguguuaauauggucccuccuuuaaaguaaacguuuucacuaacuacucauuuuuucuuuuguccucuuucucucuugcaucuguuuuuccuuugauuguaucuguuguguaauuucauauucaaucauggguuugcacuugagaauagacuguuuccaugugcccaccuucaccucucauccaccguacuucaucuuuuuccccaaaccuauugccugucccugaaauggacuugcuuucagacauuucagaggaagaccccuuuggggaggcugaccagaucacacuagacagcuuagagcaccuuuccacaggugaaauaucggagcagggggauucugaaguugcuaugccugauuuggucuuggauucugccauagccccuucucagccugacuguccuucucccauccaugggaagacucuuaaagcagcugacgacagugauucugaguuugguuacuucuccuucaguuucuccaaauguuuucccuccggcuuccccucccuucuugaugaagauggauaucuugcuuuccccagccuccccaaggucugggucuccuuccuccccgcuggugugcagcacuaugucccaaucaccuccccuucauucauuccuucccuuauccucaucuuugggcuacuucugucugcuucucagucaguuccuuuuucucuugccuuuucccuuccucuggcucuaucccucugcuaucuggaggcuaaagccgccuccuuuaauguuucuuaugacugugacuugaaugacaagcucgaggaagaggaaguaguugcuggcaugccuacguaagcucaguuuguggagucaacacaauacacuuuaucuuaaacccuuccuaauauagaguguaaaugugugcauacauuucaccacugauuacccucaacauaguaguaccugcacauuuucacacacacaauauuuuagugcaugagaaauaaguguagacacuucuccuucauugauaccauugaccaguuccacacauucuaaguuaggagcgaaauuguaggauuauuuuacaaauaucuagaucaaaguagauuuguaacagaaggugugggggaggagggaaggaggagggaaccuguauugcccguaacaauccauacagggucucuccauuuugcaaacagauauuaaugcuguuccuuuaggaugacaucuuuuuguuuugauauagaauuuaggaugcaguggacauaacuguuccugauguauauuaguagaauuccuuaguacuguuauuucucuuguuggaaacccaaguguguucuagcaucuaugaggauguaucuguaaccuuuacuccugacauuuguaagucuaaucucaaaagcuccuuaucucccuauuauuguaguauuuggagaccagaugaauuuuagcuaguuuuuuuuucuaaccuuaaauuauguaauuauauauaagagucacuauaggguauuuuauaaggaagguacuauucuguugucuuuaacaaauguaugugaaaagugaaacauggcuuuuugaaaauuuagacuauauaacacuaagauugggccucauagugcuccuuuauuuaaaauuagguguuugguuugaggauuuuuaccccuauauaaggcaaauuuuuuucaaguauccuaccucugugcuacuaagucagcauuaacauguacaauauauuuuugauuauuuuguuaaauguggccuggugauuuagugccucauauucuauggauccuaccaauacauacaguaaaucacaaaauuuagagcaaaccuaaagaaaaauguaaagauaauugcagugaguaugcauuguaggacaauuguuaaaaguuuaccugaggaaugucaaagaucaacauuuuagggaauuaaauguugaccaaggaguuggaagauguuucuuaacagauuauugaaugucugugucucauuuuucacaucugauaaagacucugagcuccuugcuuaccucugaaaaauacuaugaaugguuaaaaagguaagccguuugaacucucagauuugacacuaucauccuaauuaagaaggaaaaggauauauauuaggaauuaaccuauaaagguuaaaugauuugccuuugauaagggagucaauauuuuuauucucaccauuuuuucccuugagucaaaauucagucaguauuuguuaguuuuaaacuucuacauucauucuuuugaaucaucagauauugagaaauguccaacuaugaaaaacuguucuuauuuaaagaauuuuauguaagugguuauauuucaaagauuauuuuuaaauacccaccauuuuaauaugaaacuaguuaaauaagccaaucccccucccccagccagaaaagaaauccauauuuaacaaacugaaucauagguugaacauuuguuccccaauauaaagcuaaaaacgaauuuuacaucauuauacuuuaccccaucacuaguugcuuuagacauuucaaauuagaacagauugaauuaugccauuuuugcacucucauauucuuguuccugaguacaaaauauucaaaagcagagcauaaucuagggacugagaaagagugaagcuuccauccuccauuccaccuuugcaaaggaucauuuccaucauucguacaacacuguaggugaagaaagaccaaagaggcuuaauauucugcaucuucugagggccucacaguaaagguugguaacacugguucaccauuuaaguucaaauacagcuucuuugcacugaugguagaguuuccacuaauacuccccuucuuucuggccguuugcugugugacuuuucaggcgaagauggaagaagaggaaacgcagcuggaagagguggcugaguuuucccuaaaguuaaacaucucaugacugcugccugccauuaguauuguguggggaggguccacucucaggguuuauuugugaguuguguuuguuguggcuuuaaguucauaagauuuguauuccucuuuuauuuuaaugucuuagacugucgaacucugggucauuuuggugcuugcugauugauacacuuauguuuauuugccuuuuccccccugugugugauuuaauuucacagaaaaauuccuugagaguagaaggggauaauauuuaugucagacauagcaauuuaauguuggagguuuguauaaucuaagaaaacaacucuguccuaauggcugcccggcugcuguggacgggaggucacgccuaggcuggcuggcaauguucuucaagcacggugcaugcagugcaugggggaauucagcucgggagugcauguuaccagccugacgguguuccuuucaaguggcuuaggcaggacuguaucuacuagaaguucucaaagugacaagugggaaaaaaaaguuuagucaaaugaaucaaguuuuuauccaguacucuugaaguuguucuacaaguaaaccuauucucuccuaaaggguuaacucuagggcaucaaccugagguaacacaaucucauccuuaauauguauuaacuagaacagagauuuguuuauugaucuggcauuaaaucaugugacucuugaucuugaucugugcccacuuuuuuuguuuuuuuugguuaaaauccaugauugggaaugugguccacuuucaguauucuguuugagaauaugcuaauuaaagaaauuauuuuaauuagaaagaacaagcaaaagugagagagaaggaaaggagaaaaagaaagcccaaucacccaauuaugaauguaaaguguaaaauauguuccccgugucacgugagaacauuuuuuuuucccuucuuauuuuacaguaguauguggcaauguauucaauggagaacugcagcucucaguaaucugacuaaucuguuugguugcuuuuggcagcuugguaacugauggaaauguauuuuugcuuaacuuacuaaaaugcuguacaguguaauaaguaacauugcuuugaaccaaugcaagaaaugugccugaucucaagccacagucauuuuuccaugccaugcaaagauuuuuagauuuucaugaguuuuugcaaauggcuauagaagcucauagaugagcuacuaugcuugugcaugaauauggaauaucuaauuuuauugguugcaugaccuguuccuuaaagugggaugaaagcuauaauccacagguggcccuaugauuuuugaaauauaaauaaauauuuaaaauuugguuaaaacaaauacuauuuaugagagccagucgaaaaaaauuccacaaauaccauuuaucagggccugcucccaugaaaauggaccugguaguuuuucuuguauauuugucuguauaaggacgaucuggcaguugcggaggcuagaccccacuuuugugcuuggcaaguacaugagaccagucugugguuuauuuauucuauaaagaggcuaaacagaagcagccucuggaagcaguaauuuuuauuccuuaagaauuaaaagccaucacuggaauuuccugaaaacaaacaaacaaacaaaaaaccuuggcuuuuccagcuggggguugauccuggucuggcuuuuucuuccagccagugugcuucugagucucuaccuuccucuauuuuguacuugauuuccuauauucacagaaugcaauuuuaggaguaguccuaaucagaaagguaaauuugcuggaacaaagucauagucugaguuucaaauccagguacuggaaggaaguguuauuagccauuuugaugaucaguuccaugucaucuuucugauaauguaaauaauuauuccuuuaaaaauccuaaauagagaagaaaucagaacccuuuaaaauguaaaucauugaagaaguacgcauugacuuuauuuucaaauuuugaugaauucaugaacuuacucauagauaauaauauggcuuuagagacuuggcauuuuucuugcuuuacuaugguuuuuuuuuuaaucguaaguuugcuuugucuuauuuuuugguuuuauuuuuguccuacuggguuuuuuccuuuuggauuuuuccccccuuuguuacguuacauauugcuaggaacuggauaaggcccaggaggacauacugaaacaucaggcuagcauuagugaacucaagcgcaauuuuauggaauccacaccugagccgcgcccuaaugaaugggaaaaacgacguaucacaccucugucccuacagacacaagggguaugucauuagcuauuuguuggcucugucucacuucaguugcucaauaaaacuuaaauuguuaaucucuauguugagucuagggaaguuacaaaauguucccauuuaauuauuuuuauguaauuacuaacaauuuuguaaauacuaaauauuaacaauguaauaguuauuggccuaguucuuagguaaauugcaugaguuucaaaauacuuuugaaauaguuuuaggauaauuucacuauuuuacucagguaaauuguaguaaugaauuguuauauaggacaauuuagaaacuaacauacuguauuuaauaagcuuuuuaguuacugauaucugaaauagggacauuuacuuaguauaaauaauuaauaaauaaagaaauauaggcuaucuuuagagugguuuaaaguuauuacugugaggaaaaugaguuuaacuuagcuuuaaagaccgaugagcccuguugaaagcuugaaaaauauuauauauaauaugacuuaguauugaaacuuccuuauaaugaaauguuagaauuguguuuuaaaaacguuuuuucaaucauaacauuucuccucacuuacucuauuucuuuucaugguuuacuucuccccaccacugauaugaguacauauugccuucaggauauauucucaauacauuucuccauucauugucauccacaucugugccucuaggauucuuccaaaucccuccuguuauugaccaagaacuuccaugggcucguuuaucauacuugagcggacagugaucauacuauauuuaaucuguaguuuaaaaaaugguauaaagauguuacccuacaauuucaucuuuuuccuuucagcaucuagucuggcuugaauguugccaaauuguagacauugauuuagauauucuagugcuauuuuuauucaccuuuccuuaaaaagaaaagcuguuaguugcuuuaaauuucuaaguuugugccauugaaaaagaaagcucuuuaagaacagaugagcaaaaagaauugcugaacugaaacacagaacuuuugaaaauauuaagacaugcuugguagagucuuaugaaguugaauacaacuucaguucuuaguuucagauuuuucugaagaugauaaaaaaugucaauuucagcagucuauuccagaauguuguguuuucuggagaaagggucugaugccaugccaagguuuucaccuuccauuaugugccacuucuccuggugugugucauugacccacacugggucaguauuuuguguuuguguugcuauagguguaauguaugugucuuauuuguugauuaugucuauuguuuaaaacaauagagaaaaggagaccaucuuuucaaggauauuuuauccgugaaggagaaguaccugaugccgacaauauggacaguugaagaaaaagcucaggagacggacaagguguucaccuugcacccuuggaucuacucuugcuuuuucccccuuuccuuuuguuucuauccacagccauaagauuucuuuuuuccugugugucauacuaaaauuuuuuugaaaugauuuuugagcauuuaaaaaguuaaauccccuguguauagaagcauaggauuguuggaugagaaauaccauauugcagaagcacuugaaaagucaaaauuugaaauacagaaacaucaaccaauuuaggugauaacugauuccuaauuugauguauguggcugacaguugggaaacugauuucaugugaaagugcacuguuuguacaauacuuaugcaugucguguuguuaaaauaaccacuuaugugccuuagaugaugaguuuacuaauuacauauggaaaccuuuugaguuuucacuuguaagauuuuuaaugggaacaaagauuuugaugcaccauagcagccccucaccucucucucugcuccugcaugugugacauuucugacacuggugaggaaguucacuuuccauugcuuuuacauccucauucuucucuuucuacugauuuuacuuagccagguggucagucuguuauuugcugggacuggagagcuuggagucuaguggaggagacauggaaauaguuaauuagaaaaguuucuuuuuuuucuuucuucuuuuuuuuuuuuuugagaugcacucuugcacauucgcccgggcuggagugcaauggcaugaucuuggcucacugcaaccuccaucuccuggguucaagcaacuuuccuguuuagcugggauuacaggugccugcuaccaagucuggcuaauuuuuuuguguuuuuaguugagacgggguuucacuauguugaccagacuggucuugacuccugaccacgugauuugcccuucuuggucucccaaagugcuaggauuacaggcgugagccaccacacccggcuggugauuagaaaauuuucuaauugguacuuggaaaguuucagacacuaggaaguaaauguuaagaaggugaaauacaauguuguguuaggaggggauuaggaagaccguuuugucauuguggucaggaggagaugacauuugaguugaaaccuuaaugauaaccagguggacaugugaaaauguauccacguguaaggacgagccacaacacaggaacugaaagaccaaaugacaggggcuuggugagcaagggggagcacgaaggaaggaaaauucaaagagguuagacccuaggucaugucacgaucuuaaaggccaugcuaacaguuuggaauuguacaauaagaaugaugggaaagcauuggagaguuugaaggugaguaguggcagaaucccaccuguuucugacagaagucccccuggcacuggaugaggaauagauuauaggggcugugaaugagaacagagauuauuaauaaggaaacagugauucccuuccacaaaguagauucuguuaauugguagagaguauucaucagaacacguagcaggguugggaaaggaggcaaaauaaguagaaauaaggaguuuauggucuaguugagaugaaauauuuucagaacauugcaaaugagaaagauaaugucaugaagcuaaaccaagugacauauuuauauacuuuaaagguuagccugaaaccaaagccaauuagacuccauguguauaaugaggacuuuaauaucacaugcuuugaaauauuacguauuuuucauaaccuguccuucagaagcaaucacaugguaucauucgaucaaauuuaaagugauguccuuggauuuuugcaguaggaaacuuugacauuuuaguggagauguuuaaaauuauuaucauuuuucuggaucucauguuuuaggaauguacaguguaaaauaucuugucauagaagucacauuaaagugauguuaaugugaaauuuaaaucuggaaaagcccccaagugguuuaucuguacuugaaguuacuuguuuuucuguucuuuuccucuccaauacaugcaggaaaauacauacuuuuuugacauucauauagauuguucuuauuacaaucauccauucauccguuugcccaacaaacauuuauugaccaccuacauuguaucuuuuuuguuuuucuuuaaauaacauacuacuauuaguugaaaguaugugagcauuugucuacgggaguguuuugacuuuaccagaguaccuuuucaauuucugucuuuguuguaucuucauuuuacuguuaauucugcagggguucucguuuaucuuugaauuguaauucuuauugaaaguaaaauaaaaaaauuaugcauaaguauauaauuugaccacuuuuccaaauuucuauaauaugggcuuuuauagcuuuuuaaaaaagcaggaauaguuucuuuuuaaaaaaaaaaaauacauugcauuuucaaaguggcuguaguuugaacaauuuugagaguagagcagaaaauuggaaaccaagucauuuaaucuuuaauggguaaauaacucuauuguaauccucuuaacguguuguaugaauuaugaugacuuaaauuugcauagacuauucucuccugagucuaagagauuauguacauugaguuguaagguacuuuugaagguaugucauuggauaacgaaauguguggcacuucuuuaaauuccccagugaucucucacugggaagggcaucccacccacccccacuuccccaagggacgauguaaucauagagaugguaaugaaguuaagucaguccaaaagcuuuuuccucugcugaauauugcaagugccuacuccccucacccuccucaccucacuuucugcgcuccucacccuucuuagcucacaguaugaaggggccccuuaggagcgucauugauuuuucuuuaagauuucugaauagugacugggugcgguggcucacgccuguauucccagcacuuugggaggccgaggaggauagaucaccugaagucaggaguuagagaccagccuggccaacauggcaaaaccccgucucuacuaaaaauauaaaaauuagcugggcauggugcugcacgccuauaaucccagcuacuggggaggcugaggcaggaaaaucacuuaaaccugggagguagagguugcagugagccgagaucgcggcacacugcacuccagccugagugacagagcgagacuccgucucaaaaaaaaaaaaaaaccugaauagugggguuuauuaggaauuauucucacacuucugacaugagggggugcuucaugaugacucuugaauauugacauuucaaguuucuaaggacaguucugcugucccucaggcagguugggagccauuguuuaagagccagacacagcaaaguuaaauuugcuuuaaugguuuaauuuagggagaaauaauuuucacguugcucauugagcuuucaacucugaguuugucuuccuauuuugaauuguuuuucuuuaccuguuucuuuuugcaaaaaaaggggacaggguaauuuacucuguggcauauuuagcacgccugagggaaugaaugugggcugcugucagaauguuuguuguacagagaguuaaggugguauugaggagggagauuguaggaguuggaguggugagggaaggccuuacagaaaaugcagacuaugaagugggccucagggagguuagaaaacuggaaaggcccagaaugugcagauaagggcaaagaagggccuuggaggcaggagagggaggacugcccaagcuguaacacaggaauaagcauuucaaguguaggggccacugaagaggccauuccgugcagagaaaggccaaggaacuaccucaagaauauaugaaauggcguuugggugggucgguugugcucaguuggugaucagccaagcaguuuucacugguuucuggaggucgcaacuaucaaagauucucaagcaggguggaaaagcuggcgcucacaaaccucuucauaagccugcuccagaaucugucagaauucucaucuuuucuuucauuuuaugcuguucuguuguucuuucuuguguaaccuuuccuuucuuccaauaggucacugcugucuguucugacuuauugcuaauucuuugcucuuccuuuucugaccucucuagagccuagaagaggagauaacaucaauuuuguuuagugaaaagggcuuuucugauagcaugaaagccaccuucacuucagccaccacuuggacagcagagggcgcuguugugagcgcuaaugcaccuucugaaaagcuuucuuccucgcccuucucacacuugcuugaggugcauuuuacuuuguuuccccuguuacuaaaagccacauaugagagagauuuucauuuuuuuaaauauucaggcaccauucccuccagugcuuucauuggugaaauuaauucuuccugggagaaacauucaagaaacaaugacugaauuggaacaugaagaaaagauauagauuggauguuucuccugcuucuuuggucaaagaaaaaaaaaaucugccuaaauucagagaauaauuuaaaucauuaaguuccagagucugggcuguuaagcagagggaaacccucaaccagauaugcuuugcagaguugacauuuucaaaaccccaaauuucaggcauccucugauggcauguuauuuuuaaaauucuguuuauauggaaaaaaucugaagugccucccaugcuccaugacauaauugcuuuugaaugacccuaaggaauucccugaacuugggcagaaccuauccagcuaauugagguuaagauauaacaauaauaauaauucacugaucuauaauaauaaugaaauguguguuucagaaauguucuggucacuggauauguuuauuauauguagucaugguuaaauuuuaccugcuuaucaaaauagauugagaguuuuuucaguuuaauaucuagaaaccucugaguuuucaauaaaacuggaaagauagcugucuucuguuaguaaugugauuuacaugguauuaauuugggucaaugaaaccaugcccuuaccauguguuuaagaauaauagggcagguccaagagaguuugugaguagacguugacagugcugcagagacgugugugugugauguuaggaucuucagcucaugguuguccaagugucugggagagaugaacucagcccugcugucuauuagaggcuccaguccaguuaguaccuuggcagcuucacaacaauauccagagggcucagugguguggugcccuucuccauccagaauggagucacuuucgugaauaaauagggcuccuggcucuagcugaauuauuuuuaaguuagaucauaggcaguaguaccaccuagaagucaaaaaguuggccaugcuugaguuauaucauuguaaagcagacuuuuuguaagugugagaaaaaugugaagcuuuaaaaaccccucuguacaaaaagguuuccacccuaguuaauaauaucauaacauaguaauuuguuccuaauguauuaagucaacagauauuuauugaacauuuaggugcuauauuacucaacuggaguaaauuacuuuacucccaagaaguagaugucugaaggggauaggagugaacaugucaaauaauaaacuugacugaguuuagauuucaaagaugcuaguagaggagcuaaauuguaaaaggaaacacuuggagucaccauugacacccacccuauuguauaauauagccuuugccaaccuaugauacgaauuggaaaguuaauaaccauuucuggaaugaacauuuucauguuaauagccuucugaggcuaacuauaauuuugccaauuaaaacuuuuuuuuuuuuuuuaaagaaaaccagcaaaaaauaaaagugccaucuccuuggugcuguguucauuuaagaaucagcguuccaggcuagacuuuauagucugauuaaaaccaaaacuguuacuagguuuuaaaaguuaaauuuuuuucuuuaaaaugaugagucagcuuugguauaauucaauuuuuguaaacuguuuuaacuacauagguagagcuuauagguauaucuauaauaaaagcauuuuacuucuuugggaggaugcuggcuguuuuugugucuuuuuguaagcuuuuuggcauuugucuugauuguccucuaugugaccuugagcagagguuucuguagauguugauucuugcuguuuugucuuugcagugucagauguuuguuucagugguuguugagguaaaacuguauugauuuuguguccucgguugcuuuuuguucugcagacacgugcucccgagucagaagggccuugcacuggagccagggaugcuguuaagguucuccccuuuuuccauguuaacaccauugccucacguuucucauugcccucacguuugccccgcuucccuuucagucagccaucauaaucaucuuuguuuuucuccaugacaugaaucugccaucgguuaauuuggguuuccguuguuuuuauuuauucauauauuuuuguuuucccucauccaucuuuuuuuguacagaguucacaugagacucugaauauaguggaggagaagaagcgggcagagguugggaaagacgaaagaguaaucacagaagaaaugaaugguaaagagauaucaccugggagugguccuggggagauucguaagguggagccugugacacaaaaagacuccaccucccugucuucugagagcagcagcagcagcagugagagugaggaggaagacgugggagaguaccguccccaccaccgagugaccgagggcaccaucagggaggaacaggaguaugaagaagagguggaggaagaaccccgcccggcagccaagguaguagagagggaggaagcagugcccgaagccagcccagucacacaagcaggugccaguguaaucacaguagaaacagugauccaggaaaauguaggugcccaaaagauacccggagagaagaguguacacgaaggcgcucuuaagcaagacaugggagaagaagcagaggaagagccacagaaaguuaacggagaggugucccauguugacauugauguuuugccacaaauuauuuguuguucagagguaaaugggagucccaggugggagccaaacucuagagcugcuucucagauggggaacuccugccuuucuucuccuguccucccaguucuucagcuuuuuucaacaagaaucugauuuuucucucucaugggaggaagggggaagcacugcuuuguggauuuucugcccgcccaguucauggguuccagcuucucugcggccacuggacaccuguaggguaaacuuuccuagaagcaccacaucaauuuuuccuucccuuuucacauuuaaauuuuucuuugcauguuuuggguguuuucaacuguuuugucuucaguugcacugcuuccucacacuaaaugccuuuuuuuccccuuuugguuuaauuagaaaaauguauauguaauguugaaaaaaaaaauggucacugcugagugugugugccccugaugucaugauuggguuugacuucuuggcucauucuucagcuucagaguuuuagaaaugacagcagucucugauuaccgugguucucugaaugcaguauccagcagugaugagaauguuauuucuugaaugccacugugauuucuguuuugggauugcagggguuguaugguuuuguuaagagccuuucuuuucuuccaggcagccagaggcuaggcuauuugauaggaggauauccucgcuucucauucuauccugaugucaauucuggaguauuugccagaugauuauauguuuuguggauuaucuauacauuggacaugaaucuuuuucuuuucaaagaagagaacuuuuuggucacuaagugcagugucucucauuugggaguuaggcugagggaggguuuauuuccuugggaauauuucuugauuuuaauauuaaaugcccacaguacagagauuuauuuuguucucuucgaugggauggaaaauguugaagugacuuugucuuaaaauaauuaaguggauuuuaaccauguuacuuuuaaacuucuguuucacuuuagagaagauuuuucaagagucuuugaacacuuugaacuauucuguauuuaacauaucguuacuccucuuuaaauaauuaugccuguugagaauguucucucaaagaaaguacugcaguauuuugguaguaguauagucugguguugcauuaauauuaagcaugcauacucggcagacuaaaauguuaauaagccguugaauauuuccuuuaauguuuuaaauuguucaaagcauugguguaacauugauggaguaauuuuagauagagcauuuuaacuuagguaauacagaagaaacacugcaaauuuuagacagguauaacugaaaacaguaauacuugaagacauccuuucugaaaauggugugucuguuaacaauaaggcagaaaagguauugugggcagaagaacaaaucuuagccuaccuagcuggcaugccaguuaaaggcagugagccuucacacaaacuaugugguccuuuaaauuauaauaaaaauagagacaagucacuucacauaguucauucuauuuucuuuucaauuuauuauuacuugcccaaagcuaaggagggaggaggagagagagagagagagagagagagagugugugugugugugugugugugugugugugugugucacuauacacuaggcuugacauaaaaguaguuugggaccaucuuaauuuaaagaguaacauaauuuaggaagccaucaugucaacuuauuuuucauauauguguauguacacauacacacauucauauauauguacguaucuaugugcacauguauguauguguauauaugauauauuugaaggaaaauuuuucuuuuauuucuuuuguuuguuuuagguuguuugcuuuuacucuuuucuuuugugcaugaguguguguuuggauauguuucuuacuauuauuugugaagguuccauuaaacacuuuuacuuuauuaccucuagaauuuauuuuucccuuccuuuuccaccucagccaccagugguaaaaacagagaugguaacaauuucugaugccucacaaaggacagaaaucuccaccaaggaaguccccauuguccaaacugagaccaaaaccaucacauaugagucuccacagguacaaaagcucuagacuuggacuguucgagcucuuuuuucccuuaguguaucuauguuuucauucuuucuucucuuaguuuacauguuucuggcuuugauguagcuuuuuguaucugcacuuuguaaguguacuucaacaacauaauuugcuauguucucuuagauugagacagagagcugcaauuaaauugguaacccaguaauuauaggggaacuguacauaugauuauuuaggacagacaguaucaaucuuguucauaugauugaaagccauuucugaguugacauaucuaagaauguuuguguacacuuaggaaacaaauugucuugcaaaguuuaucugauauaauucaucgauuaauaauaauccgaucuaauuguggaugugauuuaggcuucuuucccucucuaacuccgugaagauugacccaaucaacucauucuugcuuguaauaacacacauacacacacacacacacacaaacacacacaggcacacacaccugugcuucuccuucguguggaauuauuuucuaaagaccuauguagucauucauaugugaauggugauaccaugugucuaaauaauuaucagauuuguguguuugauuuuagguuuucacacauugguucuguaaagauuuggaauaagcauuaagauguuuaaccuuaagaauaacaaaaaaagauaaagcauucaugauuucaaaauagaauauaaaauaaauauuuucuccacuuagaagaugaaccuucugugguagaauuguaucaugguggaggaugucagguuauugaccucucagaauauuuuuuaaaagguuuaaugcaugcaugugugaaacacaucugaaaauuauuuuggauauggcauccuugugugugccuugaucccacauaagcacaaauagguuucuuaugaacagcuuggcgggggagcauuagugaugugucugugcugugauaaguugccagaaugaagacauacaggugcaugacccaaguuugaaagagauuuccucuuacagucagaaaggcucuggaccguccaguuauuuccucgugucagugucaggaaacagagggcaaauauguuucgugaucuuaacauaaacuguuaggcuauuaauuugcuucauugauuccccuuggaaacucuagaaucuucugcaucuuucaauaucaaagcaaacaaguuaaaaucuauuuuaacauauguaugggauuuauauauauguaggagcacaugcguaugugcaguauugaaauauaugugcccguauauaugcucacaacaugcaaacuauuacaggaacaauguaguugaugaaaacaaucgcuagagguaagcagauaaccaaaucaugcagauucaguuuguccuggucagguucuguugcuugguaauuugauaaaauguuuaucuauuuuuacccaccugugcuuaaaaaacaacaaacucagcgcuucuggucacuguggaaacuucucugccuggcucucuaguuucauuuucuagcuugugcaaaaguccuucagacaaauucugucauaauucccuuguagcuuucagucccaccuacuauguccauucuccucucuuuucuccacucacacaguugaguuugcuucuccaugugcaccuagccuuuugccucuacucgguuucaaauaccagccgcucuccuggaugguaauuacuacugcaaacacgcaaaccacauggauuuuaaaagaugcauauucgauggggcggggaucuucucugacaacauaacagaaguuaagcauuacuuuguauuuuucccccaacuauccaaagauugauggcggggcugguggugauucgggcacguuacugaccgcacaaaccaucacaucugaguccgugucaacaacgacaaccacacacaucaccaagguaaagcaaugcaggggaucauauggagaggaugguacauuacagacagaaucuuuucugaauuguuucucucuuccuguacacacuuccaaguaagauacagacagugccagcggaaucaaaaugccuugguuuaaaguauccaagaaauuaggcuccauugacaaaugcauucaagccaaauugcaauuuugugaaguacaaggggguaaaaauauguuacgaauagcuauauguaagauagcuacaaaaccauaaauaauuuaauaaaauuuauaauuuauaaaaacaaacuugugcuucuacuuuuauuaaaccagcccuccugacuaaagcgaaugaaugaaggccaucauucagaauuuucagcaaguuguucaaauaauguagaauuucccucauuuaagaucgcuaguauacugauuuggggcauuccccuguuccucccugcauaauucucuaaauguuuagcacuggguaaccagucaucccuggaucagcagcaucagcuucacccggggcauuguuagaaguauaaauagcguggccccacuccaguccuccugaaaccuuagaauugucuuaagaagcuuccagugauucugaugcaugcugaagucaucagcuuucuaacuccagccuuauuuuccacuauuuccuucuucuguuuuuuacuuuggauaagugucuaaaggucuuaaaggugucccuugugcccuucccaacccauguuucaacaacaauuuaaaaaacagcaaaaguaauuuguaaauuuaaaaaugccgcauaaaugcaagguacuguuggugcucauuuuaaagcauauccaguuauuaagcauagugauaagccugguuuguuaugguaaaaugcugucacuugugacugagaguguacauuuaucagaguuguaaauguuggaugugcgcuuucccaggaccgugugguauuugcuuauugacuguuuagaaggucacagccagaugaucuccucagccucauccagugugccccaggcacucgcagcuuguacggagcccauaacgcugugaggcaguucccccaggagcucccuccuccagccccgcucgcagccuuugucuagccaugcgccaugucuacguguaugacuacuuacgcagggugucaucaaaucaaacauucaacaaaaaucucauccaucuuccguaucugaaaccaaagcaaauccuuuuuaaaauuauugcacuaaaugcaauaaacaaaaucagcaaauaaauuuguaugcucagaauccaucagucaaaaccaucacaucauacagaagucuucugugaugggaaaaaaauauauaucacaucaaacaguuucucaaaccaaaaacagauaccuaaauucuuauaauuucuuguaauucugcaaguaacugauuucucccuacucuccuuuuuaaaaauuggccagcuaggaguaaagaaacucgggaaacuauaacagaauucccuuaaaggaacuacuuggauuaaauaauaucuguccuaucuuaaucaagugagauuaagaugggacagaugccaucuugaauauugauaaaugaguuuuaagguugcucucagcugagggauacuuguggaugcuauaacuuuaguaauaggauucucuauugagccuaaaaauaaagcacaaaguguuucuagaauaucagucuuuugcugcuuguuguguguggccuuacaaugauccacaggucuagguggacucccaucucuguuugcucugacuguguaaacgugcuucagugauugcuguuuuuucuucuucuccuuuaugaccuuuagacuguaaaagguggaauuucugaaacaagaauugagaaacgcauugugaucacaggagauggagauauugaucaugaccagguaaauaaguuaaguucuaguuuuggaaauggcccuguuuguuuucuaaguuucacauuugucaucaugucgcauaccuguguaaaccucuucuccccaaaccuccuggaugaaguccaccuccuaagcaggacauaaagacacagccuggauacaagcuuuccuaccucugaaucagaauaaaacacagauuucucuuuauuucccacuggcuuuacaugcacuuuugggucaacguaaucuggaggauuucuggaaaacauaagauucgugugggccugguuuaaaggcaagugaucaaauauuuaaaaaugaauggcaguucaaugcaccaguuuccaaaaaaugaagaaagccacuaagcuugaccuaugccuacuuuuaggaacuuuucaaguauauuuauggcauuagaaaaguugagcuauuuacuuccagguguuuucuccuauugcgauuauugggggaggggagguaauacaagguuucuuacaaagugaaaauuuacauugauucugaaaauuuuuuaaaagaaucaugccuccauucuaauguuaaauuuggcagcaugcauggcuuugagcaggugaugaauggaacugcuggagacuuugagagcaguuuuaauuuuagacugcagucccaagugaugcugacaauuuuuuuaaaagugauuuuaacucagcuuuaaaggagaccaagcuguuuuccuuuuauaacaacuugaagaaaaggaaaagaaauauucaauugacuaucucagcuggggaguaggagcuaacgauaguuacacagcuuuggacacaauacugagcucaggaaagaaaauuuuagagaacaaaauuccucauuugagaaaggcagccuauaugugaucagagauaaauggauuuuucaugccuaagaagaaaauuacucccaauuuuuuugaccuuuguaaguaugauuugacuuacauauucguaauguacuuuuaaaauuuucuuaagaguuauuagagguuaaaagguugccuugacucuggauuuugacauaggacauaggacuggagauuccuagagagcauuaguacacuugucugcuuaccaugggaaaaugagugacuuauguggaaacaagccuccaguuuuccagaggggauuuauucuacuauccacuggaacagucuugaguuucgccugagaaauuggaguaaaccugcuucuuucucucugggacucuucucaauaagcacucauugaauuccuagaauaugugaagcacaagcucacauuuuuuggcaugguggaaagugcaaacuagggucuucucccagccauuguuucuuccaccccccucuccccauugaaccuaggcccuuuacacacuuuaaaaugccaccuuuccaguacucagguuuuacuuauguguauuguuuugccuuuuauaacaaaagccaaaauaauuuuguuauaaaaggcaaaagaauauuuuggccuguuuuaccccaaaauucaaaucuagauaguacugcuucugaaaggcaaauauuaaaaacacaaucugaaauacaagugccaaaauaacauauacaccugacucuuaaaaaaucaugaugacccagcagccuuaacugcugcuguugcaaggacaguaaucuccuuuuuuguauaugaugucauguuucagcccuuucuaaaacugaggucagauauccaaaugaagagaacagagauuuugccuuuuuauguuugugagauagcauaaacuuuuuuuuuuuuuuuggggagauggagucucccucuggugcccagacuggagugcaguggcacgaucuggacucacugcaaccucugccuccuggguucaagugauucuccugccucagccuccugaguagcugggauuauaggcacccgccaccacgcccggcuaguuuuuguguuuuuaguagagaugggguuucacuguguuggccaggcuggucucgaacuccugaccucagguuauccacacuccucggcaucccaaagugcugggauuacagucgugagcuaccacaccuggccaacauuuuugaguaaaugugauuguggcuuuuggucugcuugucaccagaagcuguuggggguucacuuucuccuuuaagccuguaaugagaugacagagcuacuuuaaauuaaaugaugaaaucgcuuugcugucaaaauccgauguugaucauagagugaccuucauaacauugacaucuuuuucaguuccuugccuacguuaaaaggaaucuucaggcugggggcgguggcucacgccuguaaucucagcacuuugggaggccgaggugggcagaucacgaggucaggagauggagaccauccuggcuaacacagcgaaacccugucucuacuaaaaauacaaaaaauuagccggguguaguggcgggcaccuguaguugcagcuacuugggaggcugaggcaggagaauggugugaaccugggaggcagagcuuacagugagcggagauggcgccacugcacuccagccugggcgacagagcaagauuccaucucaaaauuaaaaaaauuaaaaauaaaaaaggcaucuuaaaauggaaggacacuuucacugggccagacagaaaacaagaaaucuuuuuuguguuggcaaaucaaagaggcaugcuuuuacagaaacuugcuuugcagauucuucacccugugcuggucaugauacuuucagcuccauaccaaggagagguaaaauacacugcagugucucuucagaguguauuucuuucuaagaaauaauugcucaauuuggcaguaagagccgggcgcgguggcucaagccuguaaucccagcacuuugggaggccgaggcgggcagaucaugaggucaggagaucgagaccauccuggcuaacacgaugaaaccccgucucuacuaaaaauagaaaaaaaauuagccgggcgcaguggcaggcgccuguagucgcagcuauucgggaggcugaggcaggagaauggugugaacccgggaggcggagcuugcagugagccgagaucgcgccacugcacuccagccugggcgacagagcgagacuccgucucaaaaaaauaaaaauaaaaauaaaaauaaaauuuggcaguaagaugugauguuuucucauaauccuuauuauugccauaauaaauuaacauuuuacaguauuuaauuuugcaugcugauauuauggaaugaaaggaguuuuaacaaacugauuuugaauguguuucaagaugacuguagcaguuuuugcuuuucccaaucuuucugugaauuagaguguauuucauauguguugccuucccuugggcaucaucuacauuuucucuugaacaguugcccugcuuuauuguaggcagaucuuuguagaucagauacucaaaguauuugaucauuugucuguagcuacguuuggcucccaucagagcuuguccuugucuuugacuuuucccaguguggacugcacaaaccaacauguaguaaauggcuuggaucauuccaaucuccuucccucugaagacacacacaaacacaauguagaacugcaccccugugccuccucucccuuuccuauucccauuccagucaacacguugaaaagcuucucugcccuucccuggaaccagauaccugcucccacuccugcuccacgcuagcccuccagccauucacucucccgccuugacaaacacuucugcuacugcccagauuggagucugguuccauguuuuauuucucuauugucccaacacaggucacucacaagaguuuguucccugguggaaauuuaagcacccucaaaugucuuccaaguuucugugcaaaaaauuuucuguaugaaaaugaugucuuuuuuuuuuuuuugguagcuuuaccuuuuuuuaaacgaaacgaggcuuaggguuucuguuuaguauccuuacagcugacagaaacuaucaugcaaacaagaaaugcaguuguccccuuaggcagcugacagcaaaagaaaaaauugcauggcuuuauuucaaaugcaguuuccuuaugagauaugguauucucuguccuaguaaaauuuucucuuuguuuuagcauucuuuccuagacuuuuuuuuuuuuuuuugagacaaagucucacucuguugcccaggcuggagugcaguggugcagucuuggcucacugcagccuccacuucccgguucaggcaauucuccugccucagccaccuaaguagcugggauuacaggcgugcgccagccaagccugguguuuuuaguagagacuggguuucaccauguuggccaggcugguuucgaacuccuguccucaagugaucgcccgcguuggcgucccaaagugcugggauuacaggccugagccaccacgccuggccuuuagaauucuuuccuagacuucaaggguucucugauguuuuguuuucucacccauacuuuaaaaacaaaaugaguaauaauuaggaaagcuauuuuccuccucugaaaaauaggaucuuuccauugugccacaacacucuuacaguuuacuuucugauaaaacacagagaaacuuugcuuucuuaccacgugguccaaggaaggaccauaaaccacuggagucagcccucuggguccucccugcuccuauccugcugcucacaggcuggauggccuugagaaagacccauuaaucuuugugccugcaguuuugucaacugucaaauagggaccuguauuuuauaaccugaagauuagucagucucuguucuuuagcuuuacuaauuguauguuguugcuacugcucuuuaguucugugucuuagagguuuauagacaucuuuccugcagucuuuuaguucagcaaacauuuuaguucaaacaauuacugagagccuaagaagauaaagaugagcaaggccugguccucugccuugcaguuucaggcaauugggugacagcuaguaucaccugaaugucuagaucaggcacugugcuggcugcuuuacagcauuacuuuaguucacacagaaaaccuuaaaaugaucguuacaacucugcauuagucucagguuacagguaagaaugcuaagcuccaaagaacuguuuucuccaaaucucacagugaguauaauaagccugggauucaaagccaacauguuuccucuacgugucauuauuugaaaguggacugaagaauugggagauuuaggaaaugagaagcagucuguaaaaugacagugaacccauuucaaaucuuccugcuuucucaaauacagaagugagugccucuuggcuugagguuggguccgaggugaucaguguguguguguuuugccauugugagguggaggcuguuccccagcucacagccguucucuguccugacccuggcaggcacuggcucaggcgaucagggaagccagagagcagcacccugacaugucggucacaagaguggugguacacaaagaaacagaguuggcugaggaaggggaagauuaaguaagguaagagagcccucauugucuguggccuuucuagugacugcucuguacuccugaacuugugaaaggaugugaaaugaaaguucauaucagugucuucuuccuauaguacauuugacuuucuagacuguuaucauccccaggugcaucugcucggguguauauaaucucugugaacugauggucauguggugucaauaacucugauuuauugaggggcugcuaaugauugacauucauauauugcuuuacuguuuaucaagcacauuacuguaaguuacauuaauuaauauucacauugacccuuucuggaagaugcuauuaaccuucuuuggaugagagauuuuuauuguaggagagauaagagggagaugagcugauuccaccuaucucuacuaaaaacacaaaaaugagaugggcauguuggugcaugccuguaaucccauacuugggagccugaggcaggagaaucauuucaaccugggaggcggagguugcagugagccaacauugcgccacugaacucuauccugggcaacagaagugagacuccaucucaaaaaaaaaaaaaaaaaaaaaaaaaagauacaucugagaaugaaccagaaaggaaaagauuucuuugacuguguaaaaauggaaauaaauacuucaguuaagccaauagaaacaaaagcaaaggauuaauaaaugauuaaguuuaaugugcuuggcagagaaaggaauaguauccugaguauauuaagaacucuacugugucauuaagaaaauuuaaacacuuuuguagaaaaaugggcagagaauuaaaugaguaaacuaugugcaaacuaaaagaucaauaaacaaaaaaugugcagccucacuauuacuuaaaucaaugcauacuaaaaacucaguggacaaguuuucaccuauaaauuuggcaaaacuuauguuuuuaauaguguugggaaggcugcaggaaauauauacugcuguauaaauuaguaauauuuuauggaggacaauuugacacaaauauaucuaaaaaauauccacauuaaacaugucuaccauuaaacuacuuauaagaauuuaucuuaaucagaaauauauacaaauauucaccuacaaggguauuugucacauuuuaauauuuauauuuguauaaauuuauauuugcuaguauuaguaacaggcaaaagauuuacacacccugaagagaaaccagaguauuauauuugcuaguauuagccaaaaaaaaaauugaaauaaucuaaauggucaagaguaggggauuaguuaacacauuaugcuguuuccaugugauaacuaaaucuugaugaaguggguaaauguuuauaauuaucuauuagggcuuuaagaagcaggucuuaucacacaauaacacauacuaagauuacuuucuguuguuaaaauaaucuguauguugaacagucaauagauagguaacccacaggaauggcugggucacagguuacacauuuucauuuucuaccuugcguggcacagccaccugcuguugcauccacuaggaggcaaggauuccuaccauuuuacagcugccucucugacuuuuuaauuuuugcuaguuugguaaauauguguaacugugauuauaauucucacuuucuucauuaauauauuuucauaugguuauuagccauucuuguuuucucuucuaugaaaauacagauggccaaaaacuucaaaaccuuaaaugcuuguucaccucucuugccugcuuuugcuuucauucuuucuuucauuguuaauugauucuugauagauucuacauacugauccuuugucaauuuuauauguugcaaauaucuucaggcuugugguuugucuuucauuauuaaaauaguugaauaggguuaauauuguugaauuuaucaagcuuuuccuuuaugacuuauguuuuuuccauaccccuaggugauaaagauauuuuuuauguagaaauuuaacauuguuuuucauauauucuuaauccaucugaaaucauuuuuucuaaaugaugagaaaguuuccuacauaaguagccagcauuccagcacuguauugaagagcccuucuuucccccaucucaucugcagcauccuauaucaaguuucuuauguguggggguguuucugacacuauuucuauugguccaugcgucuaucccugcuccagugccagaauuacuauaacuuuauaaugggucuugauacaugguaugcaugucucuaucccccugcacccccuccccccaccaccgauaguguucuuuuucuucauucuuggcucuuccuguuacauacaaauuuuagaaucagauugcuguguucuaagauuaaauccugcaguacuucaguuggcauuguaucuacucuguaguucaauauggggagaauuacaucuuuuuaauauugccuucuuuuccuugaacauaagaugucucuauuuguauauaucuucuuuaaugucuuucauuaaaauuauauaguuuuuuaaucaaaugaggucuuacaaaucuuuucuagcuuuugcuagcauagagagauacaguugacuuuucuauauuuaucuuauaucuagcaaccugacucuucauaucugagauucuauuuuaaacacaggguauauaaugggcccauaagcagaaaucauuaacaauuuuaguaaaaauaaaacauccaguggccugaguaaauguacugugcuguauguggauauugaucuuuuuaucuuugagauguauuucccuaaugguuuuauuuauuuuuuauuuuuuugugacggagucucgcucugucgcccaggcuggagugcaguggcgcaaucucgguucacuucaaccuccgccucccagguucaagcaauucugccugccucagccucccaaguagcuugaauuacaggcgcccaccaucacgcccagcuaauuuuuguauuuuuuaguagagacaggguuucgccauguuggccaggcuggucuuaaacuccuguucucaagugaucugccugccucggcuucccaaagugcugaguuuacaggcgugagccacugugccuggcccccuaaugguuuuauuuauuuauuuauuugagacaaaguaucccucugucucccaggcuggagugcaguggugugaucucaacccacugcaaccucugccuccucgguucaagcaauucuucuccuucauccucccgaguagcugggacuacaggcgcucaccaccacgccuggcuccuaaugguuuuaaauagggaaggcuaaaagcauucuuacuuaggagucagaaggcugaaggcuauguuuucaucuugccagauauccaacuauauugacauuaggcaagucagugaaugguaugaucuaccuuuccuaacucauaggacuuauucuaaggauagaauaagauaaugaaugagaaaagugaguguuauacaaacauaagguaauagcacuggauguuuuuuucucuaaauuuuaugaaucaguugcuucuuaaucaggaauacuagcaaaaaauuggugacacucuaagcguuaccaguagcuccaccuucacuuguggcauuuuaauaaguuuuuaaaugaauucauuguaucacuuauuccuagcaccuuauguucauuuuuacaauggacacacacagacacacacacaacuuuugaaguuugcccaucucagaggcuaacuuuuaugagaagccuuguuaaacagauuuaggaaguuaaaguauaaacuuacauauaaggugaacaaacuagauaaauuuggaaagauucauucaugcauucaaaaaguauuuaaugagugccuaaaugugcuaggguagggcuggguauugaggauuccgugauagacaaagcaaacauggucccccuccuuggcagagaggaugugcuccaggaagguaggugugaauauuaacaaaugaacaaaauguaaaugugaucagcccucugaaggaaauaaaaugcuaugagagaacaaaauaggagacuugaacuaucauaaauuuaaccaauuuccuuuagaaaccaguuuacuugagaaacgaaguuugaguuuaaaaucugaaggaugacuaggaaugaccucagugucucaaagucauuuuggcaucuccaccccccacuggcugcagcucacucuuaaaaaauuuccuuugcuggugacugucagaucugggaagaguguguuuucacugcuucagcuacugucuggcugcccugccagaaucccacagaggcagcaggugggcugaggcaaagagcaggaucaggacaauaucggaaugucaaaaaagaaggggaacugucugcaauguaucugcuccgucucccuuuuucaggcacauaaagcucuccuccugaccugaucuugcccuuuggaguagcucugagcuuuugaucaaguguugaaaguagggggaggggagagcaaacagaaagaugguaaaagaacaaccugcagaggacgaaccucccaaguccaccuuucucaguggauggcagccagcugugaggcagagaggagcuaaaugcaaaccccguuaaaaagaaaacacacuucagaugaggacuucacuaaaucuuuguaacuuuuuaauguccuuucaaggacuacucccuccugccggcuuagcccaaaugcauauuuaugagcccucacauggaugaaaaauauugcugaccuuaucaccacugcagugguauucccaaacggucccgaucaggaggaagaaggguuccaggcuugguggugugaucuguguggucucagaaagaaugagccacaggagagggagcucucccaacccagacuucacaggagccucucugacucuuagaguaauaauugaugucagguaaaaaagugaaugaagccuccuguucauccaaaaucagugagcaccugaaggaugaaacgacagaggaguggcugcucauccuuucacucauccauucauuuauuuguucauugcauaaauauguauggaaugcccacuggguaucgucugcuguuuucccauggaaauaucaaauaaaauaaggucugcucuucagacaauaaaucagugguagcagaagaauuucaaguuuugugauaauauucugaaccucguguaaugggaacaagaaggagagaccucugaaucagaauagagcaucagagauguuucacuuaagcuucgugcuggguaggaguuagcucugugaagaaggaguaaagggggccauuccaggcaggauuggaagcauugaaccugaugcuccaagaacagugcaaaaucagauguagcuggauugugggauacuuguaggagagcgauggagaugcaggaggaaggaggcagaggcccaauguuaaggagucuucuaagccaagcugaggaggcuaaacuauccugaaagugaugggguugcuccuccuguguuugagagaugguaaggauguaacuuaccuucuuugugacuuguugacggucagcaugaggcuguggaaguuagugcauugggaagaugggagcagaggagaaucacacaucauauuuagguuuuuggcuugggcagggaguugauguuggcaccuauaauuugaaucgugcaauacaugaguuuugucuuuugcaugucauggccacguuacuauggcuggucuucucugcuuggcuaccuuaaagcaaagguguauuuuugguucugcgguacugccggagagaccaacugucaugggaauucuggaggaaacuuagaaaugaaucuauaaggccccaucuuauaacaugacaugauuaauuggaaguuuucuggaucgucugcauguuaagagggagcauaggauagcagauuugcuggguucauaucuacuucuuaguuguuugaccuuggcuggucucaucccuuugucccagagcugucaucuguaaacuggggaugauaauagaagcagaagggcuuguuuccaaggcagguuguuaagaacuuuuuauaacuuacaaggucggccaugaacccuuuuugcucuuaagaguccaauaaaaaugagaauuuucuaccccagagauaaugaguuugagaugcaugugaaaugcagaaauggcacauuugggagcacaagagcuuugagagugcaacaggcuucugagcaggagagagauuugugaguccccugaaugaauuguguacugaugaagccuguguuuugagcuguguuauccagggcuagcucagagcugaggucugggaaacagaggccauaaagaaggaggagccaggaggcagaaaggaaacagggaaaaggcggaggugacacaagcugcaaggcaagauaacuucaagaaggagagaguaaccaaguauuaaauauggcagaaaaaccaaaugagcauguuuuuggaaauugaugaacagaagucagccuggaggcuuugucagagcuguuucagugugguaguagggagagagcccuguaacagguugaaaacacaugaaaacauauuaaguugaaaacccagugacaggaccuuuugcucuuccaugagcucugccugccuucaucugagaagaugggagaacauuaggugucauggagccacuggagcuagugcugugauuauuaaaagcagggucaguucaccauucacuggaaccucuuagacaucccacccguuaaccugcagugaauaccucuaaauuagucguguugcuuuuuccacuguuguggguacacgaaugccaauuucuaaacaaaacaaucuuguguuuguuucaaagucagggugaugugcaggguuucaaaacaugaacucauaagccaaacaggaaauuaacauuagcugccuagcugacuugaugagagaaaagaacccuguuggcugaacugagcucuagcuaaucaugagccacucauuuacaugugggcccugaugagugucaccccugaccuucaaagagaacaaaccuauugacuuccagaugacuauuucaguucugcaggcauaucagguguguugcauuuuuauuuuauucuguuugccuaguuguguuagucucauaccuaaaauuagcaucuuauuacugcuucauuuucaauauagauuaaucacaccucagaugaggacugacuucugcauagaaauaaaaagcuaguuuugguuuagugaguuuuaggcauagccaguuuucacucugaaaugcuguggaauguucucauuuaacauugcuaaaucuaccagguguuaucaaugagucaguuacaaucuauuugaacuccccccacacaagaggugcuggguaccacugcucuaaugcguacauuaagaccaggcaguagucacucauuccccaaggcuugcucuuggacauaaccauuacugacuauuauuuuuucaaaugaaacuaucuuuauuguuuuuuucugguaauaaaagagggguuauaacuuuuuaaaagggagagauaguaggaaaugucagugacccauaagucccaugcucccagagauagagaauuucuuuccaguguguauguguguacuuauaaauauacacacauguagacacucacauacacacacccccccuuuccauauaggcugauauugugauucuugcuuuuuccuccacuuaauaguacuuuauaguuauugguccuugucguuaccucaucauuuuucagcagcuguugaauggaugagugaugguuuacuuaaauaaccccuauuaaugggcauuuaaauuaccccucaguuuucacaauuauuacacagcuucaaagauuauacuuguuuguacauuuuuguauguugaucucauuguuucuccagggcaaauauguuuaaaaguggaguugguaugccacgaagguuguuuuuugucuuuguuuuuuugagacagaguuucccucuugucgcgcagacuggagugcaguggcacgaucuugguucacuguaacuuccgccucccagguucaagcguuucuccuaccucagccucccgaguagcuggaauuacaggcgugugcuaccaugcccagcuaauuuuuguauuuuuaguagagacgggguuucccuauguuggccaggcuggucucgaacuccugacugaccucaggugauccacccgccuuggcuucccaaagugcugggauuacaggcauaagccaccacugcuugcccaccaaggguuuuugacauauuaccaaauuguccuccuuaaugguucugcaaacauagaccgccacuagcaguuugugagcauauguuuccccacagccuuggcaacaacuaaacauuauuaaacauuaaaaaaaagcuuugcuagucugaucaggaaagagcauuuguuucucccuuguuuaaacugugaggaaagaaccuucuuuguguuuuuucaaugcuagugaaguuggaauacaugcauacauaugcuacacacagggacagacacacacauauaauuugcauuucuuuugguugccaguuuguguccuuuguccauuuuccuauucaggugucuauuuuuuucucuuauagagauuaguugaauggacgcaugaugguuuacuuaaucccuacuaaugggcauuuaaauuaucccucaguuuucacgguuaucacacagccuaguaacuugaaaagaugaguaacuaaucuuuucagauuaaaguuauuaaccucuuagucacaaaugcuacauuuucccuccaauuuaaaaaauuggcaccaaaaguggggagaggggcaagacagaacugaccgcuuagagacaagcaggccauauccacaguuuuguuuuuuguuuuggccuaaaggguauaucuuagaauuugaaucaauuauuagugcuuaaacauuagaagauagucagcaauuuuagaaaaaucagaagcucugaugacauugagccugcucucccugugguuacuaugcuggagcuuaguagguguggccagcaucaggcugggaggagcucucuaggucaccacagugcuacugccugucauauccugucuuuauguugaggcccuuggggcccagucuccuuaugcauauauguuacccaucuggccucugaccguguugggguggugguuaugacuuuguuacccuguccuaggcuguguuugagagucuggaaauguaaagaauauuuaauguuaaacugccuguagagcaucuucgugucucuccucuaaccuucuuuauaaggaaauaggauccuagacauuaacguaacugucauaggucaccugugcuaaguauagauugauuuaucucaaggcuuuucuguuagauaccccagauaccaauuguuuaaacauguaaauuuuguggguggcaucagaggggaauuuuacuauggcaacuaauuaacaaguuuguguauguguguguuuuuguaaagauacuccuguccuuacgaggauuacaguccaaggacauauugaugcuuucuugcaucaaaauaguugaguuagcauuagagcacauggaagucuggaccuguucuguccaguaugguagccaauacccacuuguggcuauugagcacuugaaauguggcuaguucaaauugagauauguuguaaguauaagauauuuacuggauuucagacaugagaaaaaaguaaauuauuucuaauuuuuaaauuaauuacuuauugaaauaauaauuuggauauauuggguuuaauaacuacauuaaaauuacauauacauguuccuuuuuauuuuuugaaauguggcuucuagaaaauuuacauauguggcucacauucauugcuugcaguauauuucucuuggacaguguugaucuguggaggguaggagggaugaagugagaggacaaccuuaaacuaauauggcacgaugcaguuuagauucugugugugugugugugugugugugugugugugugugugugugugagagagagagagagagacagagagagacagagacuguuagggggcagggaauaguguuuuaagcuaucuuuauuuaacuuugaggaaaagugauuuuuuucccauguucccucagauaaaaagugagaaaguugggucuagaaauuucuuuugauucccacuaaccuuccuuuuuucuaaaagaugaaagcuuuguuaguuuguauuuuuaagcucuuauuugaugcuacagagaaauguuuucucauuacuacccaucuuaugaaccuaagugacaaaagcucagcucuaauagaguauacugaguggagccugaccauaguucauuuguuauuuaaaagaagcuuuaagauuuuguagaacgcuuuuauaucaaauucccagaagauuugaccuagcagagugaaccagaagaccuuaacagcuuuagggccggcacuacuacuuuuagaaacuuguguuacggcuucagugauuugaggaaaccaguuuuuuaaagaaguaagaguccucaugggauaucauagauauaguuaaucaacaaaagagaacagaaaaaugaaccugauguuuuucuacuuaaacaagaaaauuggcagaugagaguaaugguaaacaugggaauuagugcuucuuccuaaagauauaaugcaauucuguuguuuuuuuucccugccguuuccucaagcucuuauucuucagucuuacguuacaaauuagucccugauacuuucacuucuggauucauuaaucuauauuaugagccuguuauguucaagggacuauuauaguugugugugagaggggaaggcauaggaacaugcauaaaaauaauguucagggcacaaaaauaguauauuugaagagaagccuagauaaagggcuguggaaguugacaggagaaaugcuucugauuggccaaacaagacaaagcucuccagaaagguugcaggaaagcuccucugugcaaagcaccaagggcaaucuggauaguuggagauuggggagggaagaaagagcacaugggaaaacaaugggaaggaugucgggaaaagcaaaccuccaucgugguuauguauagaguucucagcacagcuggaaacauuuguugaaggcaaauugcagauggucuuacaugccauguccuuuaguaauaugaauuuaucaguaguguguaugauugacugaaaagcuucuagauuagaugaaguacccuguaaagaaaucaagauacugguucagacaguuaguaauggggauacugaacuggacaucucuaagaguaagauugaauuuaacuuggaagcaaagccaggaguaaaauaucauaggaacaucuauaaaaguuaaauccgauauuuuuuugcuuuucagucagaugaagcucaguaucuuuauuacuauuugaaguaaaguuauauuagcauguaggccuuugagaguaauacaguucauucagaggacacagggcucaggaaggucaacccagucccaaaaggccugaagaugggacuugggccuuaaaggacccacagaagagccuccuaagaagguggggucuccaaacagcaugaacauguuccagcaaaccaggaaaagcaaaagcauuuugcugaauuauuuguagaacagauacugugcuucauuugacugcagagaaaaacacuggauuuaauuucucccuguacucagcagauacacaaauaucugugacagaagaaaacggcaguaguuuagugauagcagauuggacauaagcaguucucaaacugaauggucucaggaccacuuuauacaccuaaaaauuauugaaggcccaaagagauuuuguucaugugaauuguaucuauugaaauuuaucauaagucaaaacugagaaguuuuauaaauauuuauuaaguuaaaaaucaucacauagugaaagaagucugucuagaaagacuauauauguuguaugaucaaacuguaugacauccuggaaaagguaaaaugauggagacaguaaaagggucauucgcugccacugaucuccucaagagucuuaauaucgggaagcuaucaagcucaugguggccaaaacaccauuuuccaaauucuaauguucaccuaaaagcuugcauuuuaucauuggcaacaaguacugucaauuguuucucuugaggcgacaggcucaacuucauuuucaauaaaagguuuaccuaguauccaaauugaauaacaucccuugucugucagugauucucucaaguaagaaaggugguugaugaaaaagcagcugcuucaacucacaguucagacauucccauagaugcuuuuccucuagacauuguuguacuucuguaugcagcgggaauggcgugugcauacuucccauuucaucacacagaauauuaaaaagaugcacucaggcuugagauguaggaaaauuaauauuucuucuguguccucaaggacuuccuuaagugaaacugucuucucuauuuuacugcaagugcacacugguaaagaauaaggugccaggccaggccugguggcucacgccuguaauccgaacacguugggagguugaggugagaggauugcuugaggccuggaguucgagaccagacugggcaguauagcaagagcuuguguccacaaaaaacuuuuuaaaaauuagcugggugugaugguaugugccuguaguccuagcuacuugggaggcugaggcaggaggaucccuugaguccaggaguucaaggcugcagugagcuaugauugcaccacugcaccccagccugggugacagagcaagacccugccucuaaaaaaaaaagaauaagguuaccucaaauauaguuugauuccucugcuucgacuuauguaggcugagcugccaguagauuuacucaccauuauuuguuuacaccauuggugaaaaugccaacacacugaaaaggacauaaugucuuaguaugauaaugaaaacaguuuugacucuaugguccccuuaaagagacucagcaguccucaggggcugcaggcuacacuucguguauauuuuaaugguaauacagacauuuuaagaauugacuuuuuucuggguuuaaccaaauggaaauuuagcaugcuugcauuuuuggcucugggauuuuuauuuuauuuauuuauuuguuuauuugagacagucucguucuggcagccaggcuggagugcaguggcaugaucucagcucacugcaacuucugccucguggguucaagcgauucuccugccucagccccccaguagcugggauuacaggcgugugccaccaugcccagcuaauuuuuaugucuuuaguagagauuggguuucgccauguuggccaggcuggucccaaacuccugaucucaggugaucugcccuucucgaccucccaaagugcugggauuacaggagugaaccaccgugcccagcugauuuuuauaauuuaaacaauggaaauucuguuuagaaauuaaaaucaaauaugcaaauugaggauaaaagaagaauaaaaugaaaaguucagcauuugaaauaacugucaaauccauaaaguaucauauuuaaaauuuaauuuuacaccugagugcacagaguucauuuuugcuuaggaaaugcagugucuuaagacagucuugcucuguggccaggcuggaguacaguggcacgaucccagcuugcgcaaccuucgacucccagcuucaagugauucuccugccucagccuccugaguagcugggacuacaggcgcccaccaccaugcccagcuaauuuuuuuuuguauuuuuaguagagacgggauuucaccauguuggccacaugguuucaccaugugaaaccccugaccucgugaucugccugccucagccucccaaaaugcugggauuacaggcgucagccaccaugcccagccuuaaguaaauauuucauucccguuuucagaauauuugauuauguuauugcucugugguaauugaauguucauuaaucugaagaaauguuguuuucuuguauuauuugcauuguuguauuaucugggggaaaaccacauuuuugcauuuuuauugagacuucucucuagaugagugcuguaccacuuaaaggcagcauugcuaguauuuucugucaaaugcuuuuugaaaucaguuuacugagucaauuucuggaguagagcacucaagauugagaucaauacaugagcccuuugucucuagaaacucaaagauugugcuuuucgggcaagaucauagaacuuguauguauggacuuuuuucaccacugcucauugggugcacugagaggguaaauaacucucugaucccucugugagugcuuaagacaaggcaugcaaccaacauauauccuugaagaacuugaacauagaauuacuccugugauuagaugaaauugagccacauugaucuauucucacauuggccaaaagagggggacauagacuaaggaaugugacuauaguaguuagaauguuuacugacauuguauaggccaggguggaacagugacacuuggaaacagaacagugguaugaaugcuuuuauuuuuguugacuucaccacaauucuaauacauaaaguauaauccauaugcuuaacagcuaugaucuuacccaaacucaggaugaaccugugauaguguaaaagugaaagcagguugaauuaaugucuauaauuaaugccugccaauuuguauugacaaagaugcccagacuucuaugaauaugaguagaauucaagcuuagagaaagaaaagaauguucuugaaacuuuuacagcuuuuacaugaagagccauugccuaguuuucaguuugguuggaauauguaauaaaucauuuagucccaaauucuagccuguaaaaaauugucagauauuaaguuuauuucucacagacaccugccagaggacagaaaaguacaguauuucugaugcuuauguagcagugacauuggugauucugucuuuaucuuuucucuuuucuagcucaaaagcuaacuguuuaguacuuaggaacguauuucuacauguguuuaagugcaagaaacagucaaaaaagauaaguggauauguaaauaaagucuucguacaauaaguuacuucuuguucauccacgccaauaaggaacugggauguuuugacacaauaucuaauaacucagaguuaaacuugauuuacugauuuuuaaagaaugagaaaauaaauaaguuuuaacauuaaaauggcaauaaaaugauucugaaagcuguuuggaauccuaagagcacaugaagguuaucauuuauaauauucauuaccagaaaaaaaguuuauuaauggaaauaaauuacauuuugaguuuauuuggguaacuaugucuuuuucucuauauuuagcucaguaaauguugaaguuuuuugagaucaagaucccuucaauuccaacauaugcuuaguuuccuguaauaacuuugaaacaaguuuaauuuuagcuuuucuuuacaaauuuaugacucauuacaaagugaaauuuuuauuuuugaugaaaacagaugcaaagcaauaaagugacauagggccuagagaaaauggagacuagaauccuaaacauuguucucucuguagguuuucaggcccugauagcaucagggguuuguuuuuuuaauaacauaaacuaggcaaaauggcagcuguguucaacaaaugaugcauauuuacuaaacaaagcaaauggaaauaccagcucugaaggaacaagaacagguuccaugacugaaggugucauauaacugccaaauccaauuugauugguaauuguauccauuucccuucaucaucccccacauuucuuuucauaauuacuaaccuaaaaaaagacuuucuauuuucuccauugauuuuuuuuucccccagccuagaaucaaacagaaguacuaaugaguaaugaaauaaccuaaggcagacaacaggguagaaaacaaugaaguugauuaaucaaucuguccugaauaaucaagaggcuuuaauauuaucugugauaaaucuaaaugguaggaacuuuuuucauuaaagcaagacuuaauuuuaccuaaccaaaagaguguacauucuaauugacuuugggagcagugucucuuggaaaagacguuaauuaccacucugcacuguccuuugugauuaccuaucauuugccaaaacuuccaaccaaguucaaauauaaaaugaaacaauugccaccuuaaaaaccuuuucucuuucagggccauugcaccaucauggguuuuuuaaaaagucuucuccacuuaccuuugauuguggacuucugcaagacucuguggcuuucauuuauuccuaugcucacaugagacuuaguucuaucuguugguuucacuuaucccuuguucugaugcccaaaucuauaucccuaggucuaaugcuucacccaggcuguaagccuucauucucuccuuuuuuugaggucccagacuccaaaccuuaucauccugucuuauacuuacuucuuaaccaccacacucugauuauucuccuuaguggugccucucaaauuucucucccaccugauuucuguggugaccacucaagucuggguccuggccaucuggcaggaaugccugacauuugucaucuuccucauccagcuggacuccugcacuggucuccugacuguuguuccugccucuacuccuugccggcuucagcuuauucaucacacugaagccacagcaguguuuucaaaacguaaaucacaccaugacaaacccuuccucaaaaccaaagaagaaacgaucccaaccuccuuuccugggcuuaucaugcccugcaugacuggccaaccccaaguucuuugaccagucuucuaucucucuguggcucuugcacucugcccuggaccauuguaguagauugccaacuggucuuuucguccaaauguuuuuucuuaauucauuuuuuuuuuuuuuuggucaauuagaucaagcugguacuucucagucuauuaaagaauagaccuaauauuuuguaccuuuauuuacuacucacuauaccaaugcucaacuuuaguaaugucccuuucuucaccguccuauuccuuccauucguuucugccuccucccccaacauacaucuuacugucauaauacuguguacuucuucaccuccaugccucuuuccucauuguguuuuuccaccugaagcaccauuuccauucguuuuagcacaaagaaaauagacuuugacuuucccuuucccugaguauagcuuuaaaaccuaccuugguuucugucuuuaaauucuuacauaugaauugucucuguuuuaugcuaauaaauucuuuugcagugaacucuuauuugccaguugcuucuagcguacuugucaauucuccagguauuuuaaggcccucgagaguggaauagugucucaugcuugucuucugguaaacauacuauuuaauguaagacuaggcagacaguaacuguugauuacuugauugaaaacuugaugaauguuacuuaacauuuuuuucaagccuguguuuuuggaauauuuaagccuucuguuuuuuuuuuuuuuuucucuucuagaaagucauuuuuuaaacaacacucaacuuugugaaccccugaagauuuuuugaccguuccaagucuuaaugccacaccacuauuccagcgaauuuaugcuacaacugguaacaaugaccagaagccugaagaauuaaaaugccaacaccaaaccuuuccuuaccagcucuggucuauauugcucccaugcauuuaauauauuauuuuguuuuauaaccacuucuaaauauucucaguucuuucuuuuuguuguuguuaauuaagggguuuugguuuuguuuucuguuuacuuugugugcaacuaccugcuuuuaaugacucacuuugaucaaaugacagugaacaaagccagcccaagcugguaaggugcuguucacuugaacaggugcuguugcgcagaaaggaaacucugugacuaauuuagauaguggcuuuccuucuucuggauucuuuucauugaauucucacaguaaauauuuacggaguuuucaaauugcagcaaauauacuguaugagaaaauauuaauacagauuaaaagccuuucuuacaucuugaaaauuuucuaauauuugagaauuucacagggauguuuuuuauauuggacccuuuugacuuuccaguccugugacuuucuacuuuuaguagagagucagaaucucuggacuggagaauaaugaagaaguucacugacugugcacugugcuuagagacccugccgcaccacagugccaaugcuugucagacacaugcccuucggcagcauuccagaacaggagggaagagaaagagaaaacuuucuucccuucuacuaaaagauucaggcagcuuaaaaccuuagugcuuucuuucuuaacauacccacauuucaauucuuuccauuauuugaacacuuggguagaacucuugcuuuguauuaaaccucuuugucuacacauguaaaacuuaccuuuuguuauugagcaggccuaucucuuucagauaguuuuaugauucacacagguuugaggaugcuggggagagggggagggggcuguggugguguucuguugguuacaagaaaguuauaccauuuaaagcuggcaccagagacccgauagggacuuauuaacuauauugaacauuuuuuccuuugccuuugacccuauguauaguuacgaugccagauuagauuuauagcagccucaaguuguauuaaaugauauuuugcuuccuguaauacuauuauaaaauaaaguuuguuuauucucuaaac

SEQ ID NO: 16221 - RNA, 1125 nt, Homo sapiens
caggauugcucuuuaaagggaccagagcgacauacugaugccuauugaggcaucugagaugcaccguguuggggguuagccucaaugccagccucugguugucuaggugagugacaucaccauaaaaacacauuguguaccauucuggacucaggaucacaaaggcagaggcaaccaaucuuuuuuuuuuuaaaaccuuccuuaaagauucuuugaugcuuugcucuaucacuguagaccugguuuuuucccccuaguuuuuucuuuuuuacauucuggguugcuauuuucagauuaacaauuugaugaccccaucacaguaccaaaauaucccccaaaaugaaguucaaauuugaucaaaacauaaaucagagugagugaguaaaauuauaaaggccaggcagcaggaaaagucacccucaaccaccaucugacuggucaggucucaccugugccaaggggggcaggaagaggagaaaccuauuauacaugcaacacugaacuggggaacauggcuuggggccuccagaacaguucagguccccaagcuaacccacuaguucccagagaguugcucguacaguuugggcacauagucgucccacucagccugguaacacgugccagccaccggggccccgagcucguacuuuuuacggaaggacaccaccucaaauuugccacgguggucuccagaucgguugcugaggaugggcucgucacacuuuaguggccuguccugcucauaaaccagccagacauagcgguggagaccugugcccuugggaggccccgagcccacauaaucggagaggagugugucacugcugaugucauugcccuucauguugaccaccaggaaaugaugccauucucuguauuugggauccuuccugcugggagcaucagggucugucaggaccaagguguagagcuucccugaaucaagaccaucccacuaaaugcuggugggucuauucuuaaccugggugggcgucagcacuuugcccagcucguccaccaccgcccgggcguaggugacaugcagcaggugcugugaccgcucguccauuucucgcaggcucaagggcccggaccacuugcugagguccaccggcauggcaa

SEQ ID NO: 16222 - RNA, 630 nt, Homo sapiens
uuuuuucaguugucaaaugauccuuuauugaaauauuuuccuuugugcuuaacuggcugggcauuccacagcaccacuguugaugucaucgaugaugucaugaggauggcggccaucaacauuacagcccacagacugggcaguccccaggaucucuuuaaugguuccagagaguucucuggcuaaggaucggugccgcaucugucgaacaauguugacgaucucaucaaaagugauauucccacuguguuuaauguuuuucuguuucuuucugucucuuggugguuccuugagggcuuugaugaucagggcagaggcagaaggcaccaccucaaucugggccugucuguucugaauggucaguuucacuguaauccucaggcccuuccagucacccguugccuuggcaaugucaucaccaaccuuuuuuggagacagacccagggggccgaucuugggggccagggcagaaguggcaccgacuucaccuccggugcaccucagguauacgacuuugaucucguuggggucgaacuucggcggcaugguggaggcggcugguguuggaugaacccggauucgggacgaccgaagaaaguugcaccuuggccuccuccgagccgaaagccg

SEQ ID NO: 16223 - RNA, 626 nt, Homo sapiens
uucaguugucaaaugauccuuuauugaaauauuuuccuuugugcuuaacuggcugggcauuccacagcaccacuguugaugucaucgaugaugucaugaggauggcggccaucaacauuacagcccacagacugggcaguccccaggaucucuuuaaugguuccagagaguucucuggcuaaggaucggugccgcaucugucgaacaauguugacgaucucaucaaaagugauauucccacuguguuuaauguuuuucuguuucuuucugucucuuggugguuccuugagggcuuugaugaucagggcagaggcagaaggcaccaccucaaucugggccugucuguucugaauggucaguuucacuguaauccucaggcccuuccagucacccguugccuuggcaaugucaucaccaaccuuuuuuggagacagacccagggggccgaucuugggggccagggcagaaguggcaccgacuucaccuccggugcaccucagguauacgacuuugaucucguuggggucgaacuucggcggcaugguggaggcggcugguguuggaugaacccggauucgggacgaccgaagaaaguugcaccuuggccuccuccgagccgaaagccg

SEQ ID NO: 16224 - RNA, 2960 nt, Homo sapiens
caugcccuaccaauauccagcacugaccccggagcagaagaaggagcugucugacaucgcucaccgcaucguggcaccuggcaagggcauccuggcugcagaugaguccacuggugcgggcaggagacagaauggguggagggugcaggguugggaguggcaggcugauccccuaauucccaugugacacucccagggagcauugccaagcggcugcaguccauuggcaccgagaacaccgaggagaaccggcgcuucuaccgccagcugcugcugacagcugacgaccgcgugaaccccugcauugggggugucauccucuuccaugagacacucuaccagaaggcggaugaugggcgucccuucccccaaguuaucaaauccaagggcgguguugugggcaucaagguaaggggagggccuccggacgugagguuugagauggaaguggaggaaggaaauccagguuagugaggcagggaaugaaugcuggauugguggccuagagacuugcauggagccugcuucaggcuuagggcauuuacucgacauuuuuaauccucacaauucugagagaacaguaucauucccacuuuacacaugaaaaucucagaagcucagggaagugaaguguuuugcucagaguaaguggcagagccccagucugacacccaauucacucaacauuucuguugucaaauaacaucccaguguauccugucucagaggauuguuacuaagugaacuaagugaaaauauuuuaauuuaauuguaacuaaguauuugaguaacuaaacauuuuaaguaaauuuuuuuuuuuuuuuuuuuugagauggagucucgcugucucccaggcuggagugcaguggugcgaucucuuggcucacugcaaguuccgccucccagguucacgccauucuccugccucagccucccgaguagcugggacuacaggcgcccgccaccacccggcuaauuuuuuuuguauuuuuaguagacacuggguuucaccauguuagccaggauggucucgaucuccugaucucgugaucugcccaccucggccucccaaagugcugggauuacaggcgugagccaccaugcccggcuuaaguaacuaaauauuuuaauuguaacuaagugaaaauauuugccagcccugagaugcaguuuaagggauuaaguaaaugugggggaagacuggggcuaaagaagaggaaagaggggcacgcccagcuaccuaggaggcugaggcgggaggaucacuugaguccaggaaguggaggcuucagugagcugagauuccaccacuguacuccagccggggcgacaguggaaagggugcuagaggucauuuccugugucuuaauguuguuacccugaccccaacagguagacaagggcguggucccccuggcagggacaaauggcgagacuaccacccaaggugagaacuguuugauucucugcccuacgaacccaaccagagcagguuugggugcugggaggaguggaaaccacaugccccuccccaccgugcucugaccccuuccucuucucuuaggguuggaugggcugucugagcgcugugcccaguacaagaaggacggagcugacuucgccaaguggcguugugugcugaagauuggggaacacacccccucagcccucgccaucauggaaaaugccaauguucuggcccguuaugccaguaucugccagcaggugggccugcagguccucaauaggcaaccuccuaccucauuugguuccaguguuguuaauuugccuauuaccugccaugaugccuaccuccccaaaagcaagcauuagcuuuggcccguggaggacacucaagggcuguugaaggcagaggggccaaggagggaugguggguggaucugaggcggcucuugucuccuguaaucugagggcuuugaagccugagucccuggcaucaucaagauacggucuugaccaguggcuguggagagauguaggugggacucuggguuaggaggccucacagugacccugucccucgcccugcagaauggcauugugcccaucguggagccugagauccucccugauggggaccaugacuugaagcgcugccaguaugugaccgagaagguaaauggcuaccugccugaccagugcaagguggcuggccggggacccuggggcuaaccccuauccucuccuccaccccacuacccaccgugcgccugcucugcuccaggugcuggcugcugucuacaaggcucugagugaccaccacaucuaccuggaaggcaccuugcugaagcccaacauggucaccccaggccaugcuugcacucagaaguuuucucaugaggagauugccauggcgaccgucacagcgcugcgccgcacagugccccccgcugucacuggugaggcccacacucaucuugaucucuaugcaguagauaagcuccacccacaacccuaugcccauuuggacggauuuccauggcaacuuccaccagcuccugccagcuuccugggucucugaccacagccccucucgccucaccccugcucuacagggaucaccuuccugucuggaggccagagugaggaggaggcguccaucaaccucaaugccauuaacaagugcccccugcugaagcccugggcccugaccuucuccuacggccgagcccugcaggccucugcccugaaggccuggggcgggaagaaggagaaccugaaggcugcgcaggaggaguaugucaagcgagcccugguaaggauaggcaggaggugggcagggugccuggguggaugggacucggagaagagcccuucucacuccaccccucucccugcuuaggccaacagccuugccugucaaggaaaguacacuccgagcggucaggcuggggcugcugccagcgagucccucuucgucucuaaccacgccuauuaag

SEQ ID NO: 16225 - RNA, 14845 nt, Homo sapiens
cugcagguauuuuaugcauggugugugucgggaaggaagucagugccuauucucacaugacuuggcaaacagcaaaccguccaccaucugcaaguacuaccagaagggcuacugugccuauggaacucggugcaggcaaggacucugcaacagauuccagcugugacacugauuucauuuggagaaugggucuugauaagggggaaauuuuaauguaaaaguaauauggcaacaucacaaaaaguauggcaaauaaguuuaaaaccucaguuucaguacccuaaaacuaauuuucuuuucuuuuuuuuuuugagauagagucucucacuguugcccaggcuggagggcaguggugcgaucucaguucucugcaaccuccgccuccaggguucuccugccucagccucccaaguagcugagauuacaggcaucugccacuacgccuggcugauuuuuuuuuuuuuuguauuuuuaguagagaugggguuucaccauguuggucaggcuggucucuaacuccugaccucgugauccucccgccucagcuucccaaagugcuggaauuacaggcgugagccaccgugccuggccuaauuuucauuuuuuaaaacuacuuuucagccuuauucuuaugaauauauaguuauaaaauuguacacaauuccggaaacuuguucaugcuuuuguagcaaagagccgaucuuuucuuucuagacugcaaagcuuccuucccuccuuuuucucugcagugcagugggagaugauggaaguaggcccacguuggucuuccccugucaaugagugccaagagagacagucagggagagaucauuggcccuugucagcauuuuggggacuccugcucaaaagaauacugggucagucaggcaucaggagauuuuagcucaacaucuguuuggaacuuucagguucucuguguggucuggugcugugugucugucccacucaagucccacagagacacuuaagcauaggugauagauagcaaaugucccccucacaaugaauugccaagcaucuguuaauaaucgauaauccuguuagaguuuaaauauuggaaaagauggccgccuucuucaccucaacaagugcagcagaaggagggccauuggcaucuggggagugugggagauguguguggguggcaugucuguaaugcaucugcuguguguuuuguuuagauaugaccacacgaggcccucugcugcagcuggaggugcugugggcaccauggcccacagugugcccuccccagcuuuccacaguccucacccuccuuccgaggucacugcauccauugugaaaacuaacucacaugaacccggaaagcgugaaaagagaacauugguucuuagagaccgaagugaguaagcggaagccuuuuguugcgucuuuuugcauagcacucuuguuaaugcuuggugcuccuuucuagccuccucuugucaagaggacuccuaaccuaauacaccuccagauugucugcgcggagagacuucagaacuguucugaagaggcuccauguggcugcagaucauucaaaugauacauucgcccucgugcccaaggcuggguugagcuccaagacuggccugguaaaacauaaaaacacaaucuuuuugucaacauguaacuuccaucuucauauggugguuguccagcuggugagaagcaucaagcucuucauuucaaacguaaauauuuugucuggguaaaguggcucacaccuauaaccccaacacuuugggaggcugaggcggguggaucaccugaggucaggaguucgagaccagccuggccaacaugguuuaguagaaacccugucucuacuaaaaauacaaaaauuagccggguguaguggcaggugucuguaaucccagcuacuugggaggcugaggcaggagaauuucuugaacccgggaggcaaagauuguagugagcugagaucacgccacugcacuccagccuggaugacaagagugagacucccucucaaaaaaaaaaaaaaaaaaaagaaaacuaaauauuuugcuaaagagcauguuucacuguuugacuuuuaggccagugaauggucuuaguuuuuaugcugacaguguuugacaguuuagauugcaccuuugggaaaagaauagcacacuaggguuuggggcauggucugugccuuaaaacaggguuugaugaggaagaaagcuacaaauuguaaaaguuuuuuuguuguguuuuuuguuuguuuuguuuuuguuuuuuuuuuggagauggagacucgcucugucgccuaggcugcagugcaguggcaugaucuccaccucccggguucaagggauucucuugccucagccuucugaguagcugggaauacaggugcccaccaccaugcccagcuaauuuuuguauuuuuaguagagacaguguuucacuauguuggccaggcuggucucaaacucuuggucucaugauccgcccgccucggccucccaaagugcugggauuacaggcaagagccacugcaccuggccauaaaaguuguuuuuauuggcugguccucaccaggugaagagauuucuaguucuuggaauuggcuaccaugagguaggcagauucuguccucagcaaaugaguaauccugugagaauacgugaccucuaaacaagcucggaggugugcagugggaaggcagcagcuccuggcgugagaaggggugaccauggggcaguuuacacuggccucaggacccacagauuugcucuagacaucuauucuaguucacuuaaaaugauuuuaccuuugcugguaugaaggaaacacuguguucuagugcucucacuguuuuuuuguuuguuuuaguguuaacugguccauguguuaacauuuccauauuugccauuuuaaacggcuuuaguguucuuuuguauaaguauauccuauuguuuugcuauuucccugucuugccauuuuuguuuuuuguuuuuuguuuuuuuaaguaauuauaaguaaugucacuaugaacauuuuauacuauuccuuuuauuuuuccccuucgguguguuuuuuuugccauauguucucaagaguggaauucuuaggucagaguagcuuaauauguuaggcuuuggcuaacggcauaccagaaaaauggggccauuuucaugugcaugugugcuguguguuguuuucagaucucucuggcauggcugaaaggaagacccagccgagcauggugaguaauccaggcagcugcagcgacccccagcccagccccgagaugaagccgcauuccuaccuggaugccaucaggaguggccuugaugacguggaggccagcagcuccuacagcaacgagcagcagcugugccccuacgcagcugcuggggagugccgguuuggggaugccugugucuaccugcacggggaggugugugaaaucuguaggcugcaagucuugcacccauucgacccagagcagaggaaggcucaugaaaagguaaagucacaaaccuuugcaugaacucauguuaagaaaucugaaauguacugaacaggacacggaaggccauccauauacacucaagaaaucugaaauguacuaagugacagaauuguugguauuuccacaggcaucccccugccaguaauacccauauuauguaucugguauauuuacauccuguuuucagguucuuuuuccugcagucauuuugccauuuuuuuuuuuuaauggagucucccucucacccaggcuggaguacaguggugcaaucucggcucacugcaaccucugcuucccuggcucaggugauccuccugccucagccccaccgaguagcugggauuacaggcgcccaccaccacacccggcuacuuuuuguauuuuuaggaaagaugggguuucaccacguuggccaggcuggucucgaacuccugaccucaaguuguccgccugccuuggccucccaaagugcugggauuacaggcaugagccaccaugcccggccuauuuugccaauuuuuaauuacucagaauaaagagaaaaagaagucguaucugaaauauaaaaucaugcuaaguucaaagaacagaucuagcucaggaccaugguaugucgucuguguguaugucucuaucacaugcagauacagcauccucccucccuggguucacacuuccucaugguugggauccagcuaggugaaguuuuggaagauuugagcccaaaucauagaaucugaggagccacuuguuggaagggccuuuuaaagucauuaaugucugcaguguuuugggaggcuuugccuuaugcuaggcccuaugcaugaugcagaggguacgaagcuggauaagaggcgggggagggccaggcauggugacucacaccuguaaucccagcacuuuggcaggccaaggcaggcagauugcuugaccccaggaguuugagaccagccugggcaacaugguaagauccccgucucuacaaaaaaaaaaaaauacaaacauuagccaggugugguggugcacaccuguagucccagcuacucggcaggacugaggugggaggaucacccgagccugggaagcagagguugcagugagccaagauugugccacugcacuacagccugggcaauaagagugagacccugucucaagaaaaauaauaauaaaaaaauuuaaaaaugccaggugugguggcuuggcuaacuuuuaaaauuuuauuuuauuuuggcugggcacaguggcucacgccuguaaucccagcacuuugggaggacgaggcaggcggaucacaaggucaggagauugagaccauccuggcuaacauggugaaaccccgucucuacuaaaaauacaaaaaguuaacugggugugguggcgggcgccuguagucccagcuacuugggaggcugaggcaggagaauagucugaacccaggagguggagcuugcagcgagcugagauugcaccaccgcacuccagccuggacgacagagagagacucugucucaaaaaaaaaaaaaaauuauuuuauuuuucagaggugaggucuugcuauguugcuuaggcuggucuugaacuccugagaucaagcaguccucuuaccauggccucccagaguaaugggauuacaggugugagccacugcaccuggccuaaggcauguuuaaauggacagcguauuccuagauaaucaagagguaaauuaguacugacuccauguggcagcggacaaggagacacucuccauugucuuccagggaagcagaggguuagagcugucuucuuuaugcaagugugugaggucucugcggugaguguuggcuugucucagaucuggacagacugagcuuacaagggcugggccuaggucuucucacucuugcucaaaugccagcacauagaaggaauucagggcaugccuagugaaugaaugaauucauugaaucauuuucuuggggagaaguggugcuucuuacauaggacuaggcugccagccucaagccucaugguaaggacgagucagcaucucugauguagacauggcucagagucgggggaaacagugcccagaggagcugggggacuagggccgcaguccuuacggacucugacuccacugcaguuuaaccuuuuuggaucuccguguucucaguccuaaauggguggugaccaugucaccuccuaggaaagcaaggggcuggaccagugaugguuugaaguccuuuguguggucugagggagaugucaguguccugacuugggggagccugggccuuugcucacagcagucgcugucaguguuccuuccugaucucagcuguggcaguguggcugcagcuacuccuagggcuccugccacuccucaguggcccacaaccaaagccuuccuuccugucugugcuucagaucugcauguugacguucgaacacgagauggaaaaggccuuugccuuccaggcaagccaggacaaagugugcaguaucugcauggaagugauccuggagaaggccucugcuucugagaggagauuugggauucucuccaauugcaaucacacguacuguuuguccugcauccggcaguggcggugugccaaacaguuugaaaacccaaucauuaaguaaguacagccaggggucuuagcugugggagcuaggagaauguuugauuugagacuuuauuccguccacuuuuaagcccuccguuacccucaagaguaacuggugaguucuggccccuggcugcaugaacuucagcaagucauuuacucuuccugagccuaagugccuguuccuauaaaagaugggcaacaauuccuaccaagcuuucuggguguuggggaggaacucagcaaagaugaucuguguaaaaagguguuaaauggcacugaccuguuuucaucuccuagccuuguguuugaaauccaguaguaccugccuguagcccaguugccuguuaaucauuuugagcuucguuuuuuccccccaccaaaaacgaaaauaggguuauuugaggaugaaguggaauaaugcauguaaaacauucugcaugaugccuggcacaugggaugugcucaauguggccaacauaggagucucaaauucuccagcaggacaggggaagagcuggcauguggagagguuacugcacgcguucuacuguucagaacuccacaucuguccgcucaucucauucccucaaagacccuccucaguuacagauuaggaaacaggccuggggugcgggggucaaguaauuugccuaaaaucguguggugaaacaacugcucuauugagauaaaagcccacaauuuaacucaccacucauccgcuuucugucucuacagaguugccuauucuggacacuucuuauaaauggaaucauagaauuuggggccuuuugugccuggccccuuucacugagcauaguguugucagaguucaucccgacuguagcaugugccagaguccccuucuccuggcggaauauguuccauuguauggacgcagcacauuucccuuauccauuccucagcuaguggacauuuaggcuguuuuaacuuugcaacuauuaugaauaaugcugcugucaacauuugugaacacagcaugugggcauguguuuucauuucucuuggguauacaccugggcgugggauugcuagguuuuaugguauaauaacucuacauuaaacuguuggagaaucugccagacucuguucaaaguggcugcacccuuuuacauucucaccagcaauguaugaggguuauuucaucugucuuuuuuguugaggaaaccauauauguguguguguguguguguguguguguguguguguguguguauuuuuuuugcuuuaaguucugggguacaugugcagaauguguagcuuuguuacauggguauccaugugccacggugguuuucugcaccucucaacccaucaccuagguuuucagccaugcaugcauuagcuguuugugcugauguucucccuccccuugccccugcaccgacaggccccggugugugauguucccccacauguguccauguguucucauugggaaacccuauuuuguuaauaguaaauaagguucuuggaugauugugauuucaucuuuuggaauuucuggugaaggaaaugccuguaguggugaggcaguugagcaagagguuuagcagagagugugcccaggcuucguaacaugacuucucccuuaguaaucuaauucuuauuucaggucuuguccagaaugccgugugauaucagaguuuguaauuccaaguguguauuggguggaagaucagaauaaaaagaacgaguugauugaagcuuucaaacaggggaugggguaagugcuuuugaguuucgacgugccccugcugccugccuggcucugcugucagcccguguccucguucuccuucccaggaguguggucuuaggggccucuuccucucuuccuucucucaggcaccaugcugggcucugggaugcagcaaugagcaaggacauggugauguggaccuguuuaguuuugguguuuuuuuuuuuuuuuuuuuuuuuucggugagauagggucucacucuguugcccaggcuggagugcaguggugcaaucucagcucacugcagccucagccuccugggcucaagcaggagccucuugaguagcuggggccaccaguagugugcgccaccaugcccagcuaauuggcuaauuuuuuuugguagagacaagguuucgccauguagcccaggcuggucuugaacuccuaggcucaagugauccuccugccucggccucccaaagugcugggauuacaggcaugagccaccgugcccggccucaaauguuccucuuuauccugguugucagcauguugauauuuugccuaggaguggagugguuuuucucuacgcuuaugucacuccccaagaugagcgaaauuuuagcuauuguuucauuaacuuuuuuucugucuuguuuuuuucuuuuccugcugggacucuacuuccguuuaugauaguuuuuuuauauuguucauagaucucuggggauauucauucuuuuucaaucuuuuuuucuuuucaucuccuugaacauaguuguagcagcuacuuugaaauccuuguuaucuugaaguugaccucuguugucuuuuaagaauggaucacauuuuccugauucuucguaugucuaguaauuuuagauuuuauccuugacauuguaaauauuacauuguagagagacuuaggauucuguuaugguuuaucuguaaagugaugauuuuuuuuuuuuugagacggaguuucacucuuguugcccaggcuggagugcaguggcacaaucucggcucacugcaaccucugccucucggguucaagcgauucuccugccucagccucccgaguagcagggauuacaggcaugcaccacugcaccuggccaauuuuuuguauuuuuaguagaaacgggguuucaccauguuagccuggcuggucucaaacuccugaccucaggugauccgcccaccucggccucccaaagugcugggauuacaggcaugagccacugcgccuggccaaguguugcuguuuuuaacaggcagguaaauuguuugaacucaaacccagguagcaguucagaucucaguucugguuuugcauucguagcugacuuugucgcauuccugugugguuugggaguuagucagauuugggcagaguuuauacacagccuuugagcacuuuuucacaggccccuuacuuugugggauugcuuccucacuuuccaauggcugugauuuccuugaacucuugucuuuuaguucuucaggccagaaagauuggauuuccccuuggaguuuuagccaccccaugugguuaugauuuuggccugcuccaggauaagagcuacuucuuuuuuuuuuuuuuuuuuuuuuuuuggagauggagucuugcuuuguagcccaggcuggagugcaguggcacagucucagcucacugccaccuccgccuuccagguucaagcacuucugccucagccucccaagaaggugggacuacaggcgcaugccgccacgccuggcuaauuuuuguauuuuaguagagacaggguuucacuguguuucccaggcuggucuugaacuccugagcucaggcaauccaccugccucggccucccaaaaugcugggauuacagaugugagccacaaaagcuaccuuuuuuaaaaaagguaacuuagccuuugccauugcuauucuucuuuguguuuacuccuccaaagaaucuaacugcguuuguucauucucuggugccuucaggucuucuugaaauauuuguguuaagacuuaucugcaggaggguuggguauggcaggcguuuacuugucauacuaaaagugaaacuaugcauuaccuuuuuuaaugguuccuuuauguugcauauuaguuuacuaaagcuugauuuuuuuuuuuuuuuuuuuuuuaccauuuuuuccucauacaaucuuccuguguguccacaagagggcaaggcguggcaagcagaggggucccagcuuguagaaaagggccccagccuguagaaaagggucccagccuguagaaaggggcucugcugaaaagcagucuggagauuguuauugcuauuuggaucuuuccuugcuuugcuuuccuuuaaugacuguguuuuuugcaauccacaaacauuuacugaguacucacuaugggucagguaccuucuagcuaagcaccacugggggauguagagauuaguaagacaauuucuuuuuucuuucgagucucgcucugucacccaggcuggcaguggcaugauuucagcucacugcaaccuccgccuccaggguucaagugauucuucugccucagccucccgaguagcugggauuacaggugugcgccacgacacccagcuaauuuuuguauuuuuuuaguagggaugggguuucgccauguuggccaggcuggucuugaacuccuggccucagaugaucuacccaccucagcuucccaaagugcuaggauuauaggugugagccacugugccccgccaaguaagacaacuucaugggaaacugcaaaagggcaauuaugauacagguuugcuggugaccaguucuucaugagggaccaucuaucacaacagagaaagcacuuggauccaccgggggcugccaggggaagcagcaugggagccugaaccaugaagcaggaagcaccugucuguagggggaagugauggaaggacaugggcacagaaggguguagguuuugugucugggggacacugggaguggcuccuggcauugaaacagguguguagaaggauguggugggaccuacagacuggaaucuaagggacacuugaaucccagugugaccauggucuuuaagaacagguuggggccaggcgcaguggcuuaugccuguaaucccagcacuuugggaggcugaggagggcagauugcuuaaguccaggggagacauagggagaccucaucucuuuaaagaaaaaaaaaagguugggaagcuccuccgugcugcucugaagguggaaacuggugggagugggagggaggccagugaggaaguggcccuggcaggcaggccccagaggcuuccacaagugugggaacccaaaggaaggggagauugggaagugauuuguaaacagaaugaacacaguugggugugagagccgaggacacagagugagucagagugaacuggaggcuuuuggccuuggugaccagauaagccugggggaggaaaaagaguaauauucuugugagagugggggaccaguauauaauguguuugaccugaucgaguucauagccagugugcuaggaugcucuggaguuguccagcaggcucuggugagagcaaacugcucacggucauuugaaguccgcucagaacuccaggcaagcaggggccuggaggaugugucguccacacaccugcucuccagccaccugugcucaaaucagaucagcuggccagggagcuuguucucucuccccccacccuacccccccgccaccacccccagugagacgaagucucacucugucucccaggcuggagugcaguggcacaaucuuggcucacugcagccuccaccuccuggguucaagcaauucuccugccucagccucagccucccgaguagcugggauuacaggugccagccaccacacccagcucauuuguguauuuuuaguagagaugggguuucgcuguguuggccaggcuggucucaaacuccugaccucaagugauccacccaccuuggccucccaaaaugcuggaauuacaggugugagccaccacacccggccagagggcuuuucuuuaugcugcuaugaagccguccucagagaacuucaccaccggccugcggccaucccaucugacaagacggaaaaccacuggauucaggagccuccuuucccuguucuugucucccgcugucacacaccccagcugccccugacagcagcgugcccuuucuguuguuuggcuuuauuucugugacuuuccccuuccucuguacuccgagauggcccucuggauucuuggguaucuuuuuuuuuuuaacuucaguuugggauccuuuaugauuggauaaaccagaguucauuugagcaaaaugggaauucauuugauugaguuuccuugggcaggguucuuaacauagaggucuguggggagaaugguagaauuaagagagagggaaaacauuuugaacuguuuggucacuguaugcuguagacccauguuuuaugcauugaaaaacacuguucagagaagggguccaaagcacauaaggcgugaagaagcccucccuggugccgagguuggagacaggaaaacuggaaggagaccuauggcuuuaggcaguugcuaaaacccucugcuuucccuguagccaccuugacagcacugcggccaggaggaaggggagaguuggcuuggugggguaccuagggaacuuugagcagagacaaguggcccagcuucagagcuuagugcccagaggagugaccaggccuggcuuagcucuguggugacccaggaggugcucuggagcugccggagggccuguggagcacugcagucuccacacagcaaguccccaggcagguuaauauccuuugcaaggcugcagguaaguggggauacuuccuauccugcuuggaaaucagaaucccagcugugugugaccugagacaaaucacucaaccucucccagccucagcugccccaccuagaaugugaggcugaccuaccucuggcguaagggugguaaggauggaggcaggcaguggcccaguuuggaccccucauuuucccaccagccucuugacuuuuucuuucugcuuuucaggaaaaaagccuguaaauacuuugagcaaggcaaggggaccugcccauuuggaagcaaaugucuuuaucgccaugcuuaccccgaugggcggcuagcagagccugagaaaccucggaaacagcucaguucucaaggcacugugaggguaaggacuuuagccaucucuaguuggggacacuuagcagcugugggcauuuccagguaccguuccuggcagagaaaugggguaggcaaaagaacgaucaaggaacgcagccuuccuguugcucuuagcaguaaccaggcauguccacuggcuguuuuugcaguucuuuaauucagugcggcucugggauuucaucgagaaccgagaaagccggcauguccccaacaaugaagaugucgacaugacagagcucggggaccucuucaugcaccuuucuggaguggaaucaucagaacccuaaagaguagaugguugcccugcaucuugggcuccaucggccgaaacuuucccaagccagggugugcggagcuucccuguacugcagccaaggugacgugugacuuggauuugaguggaguugggcuuagccuuagucucauucaaucuccauuauuacagccauggggaagagugaaagauauaaaguaaccuaauuaaauguauggaauugcuauuuuuauagcugauauaguuacaccucaagccccucagggguaacaacuaacaaacacccaaacuguuuggauugauugcuuuaaaaaacaaaccuggcucuuaccuuugaucuuuucuuccccagaaauaguaaacuugcagcugccccuaaugcagcauauuuuucuuaccaaaggagucuucagcccuauaaaaggauuccucuauaguguauuucucuaguguauuuagugugucgucaaaauuuugauuuauacagagcuuucaagaacacacaaugcaaagugagcgcagcauagcuguuaacaaacauacaacuuuuuucuagggcuuuaaggguggucauuuuuuucaaguucucucaagugucccaaaucaggguagcaaucuuguugccacaugugcagcaaacaaaguggaaguauagaucuucuucucccuuagggaggcucuugaaggagcaggagguacaguacuggguagcagucuggcccuccugucgucugguugguguuggggccuccagccagggcccucuaggggaaccaagccucugcucucaccuguggguucuugcccaucaggguaauuguauugagaacucaaauauacgugcacuuacaugugugguucguacucaagugaucuauuaucuagcugcaaagccuggcuuugauuugaaauuuuguaaaaauuucauggcacccaagguuucugauucugacccagcagugguccugaagagagcugauggcaagucuuguagucauuuugauuuuaauugaagggugagcauaaccuugugaaccagcacuagcuuguuccaagcuggaauuuaucuaaucuauuuuuguguuuaaaaaagcuguaccuaccaaauaaauaaauaguuuauaaaauguauuacuuaagguauuagcugaguuuagaguacuuucugcuuaauuaauuuuuauacuuaacucuucaguagagguuuacaaagaguacaaagguuaaauuacaaauucauucccagccuaggcucugggcacauuuccuguucuugaauucugcuccugaagagggugaacaaauggggcauucaaguugugagcucagaauuacuuuaaaaggagguaacagccagccauuacaccuaaauuuaauuuauuuuauuaaaauaacauaauugagggaccaucagauaacuguauuuugucaggugcaauaaaaacaaaauuaaaacccaaaucaucaagaaaa

SEQ ID NO: 16226 - RNA, 14845 nt, Homo sapiens
uuuucuugaugauuuggguuuuaauuuuguuuuuauugcaccugacaaaauacaguuaucugauggucccucaauuauguuauuuuaauaaaauaaauuaaauuuagguguaauggcuggcuguuaccuccuuuuaaaguaauucugagcucacaacuugaaugccccauuuguucacccucuucaggagcagaauucaagaacaggaaaugugcccagagccuaggcugggaaugaauuuguaauuuaaccuuuguacucuuuguaaaccucuacugaagaguuaaguauaaaaauuaauuaagcagaaaguacucuaaacucagcuaauaccuuaaguaauacauuuuauaaacuauuuauuuauuugguagguacagcuuuuuuaaacacaaaaauagauuagauaaauuccagcuuggaacaagcuagugcugguucacaagguuaugcucacccuucaauuaaaaucaaaaugacuacaagacuugccaucagcucucuucaggaccacugcugggucagaaucagaaaccuugggugccaugaaauuuuuacaaaauuucaaaucaaagccaggcuuugcagcuagauaauagaucacuugaguacgaaccacacauguaagugcacguauauuugaguucucaauacaauuacccugaugggcaagaacccacaggugagagcagaggcuugguuccccuagagggcccuggcuggaggccccaacaccaaccagacgacaggagggccagacugcuacccaguacuguaccuccugcuccuucaagagccucccuaagggagaagaagaucuauacuuccacuuuguuugcugcacauguggcaacaagauugcuacccugauuugggacacuugagagaacuugaaaaaaaugaccacccuuaaagcccuagaaaaaaguuguauguuuguuaacagcuaugcugcgcucacuuugcauuguguguucuugaaagcucuguauaaaucaaaauuuugacgacacacuaaauacacuagagaaauacacuauagaggaauccuuuuauagggcugaagacuccuuugguaagaaaaauaugcugcauuaggggcagcugcaaguuuacuauuucuggggaagaaaagaucaaagguaagagccagguuuguuuuuuaaagcaaucaauccaaacaguuuggguguuuguuaguuguuaccccugaggggcuugagguguaacuauaucagcuauaaaaauagcaauuccauacauuuaauuagguuacuuuauaucuuucacucuuccccauggcuguaauaauggagauugaaugagacuaaggcuaagcccaacuccacucaaauccaagucacacgucaccuuggcugcaguacagggaagcuccgcacacccuggcuugggaaaguuucggccgauggagcccaagaugcagggcaaccaucuacucuuuaggguucugaugauuccacuccagaaaggugcaugaagagguccccgagcucugucaugucgacaucuucauuguuggggacaugccggcuuucucgguucucgaugaaaucccagagccgcacugaauuaaagaacugcaaaaacagccaguggacaugccugguuacugcuaagagcaacaggaaggcugcguuccuugaucguucuuuugccuaccccauuucucugccaggaacgguaccuggaaaugcccacagcugcuaaguguccccaacuagagauggcuaaaguccuuacccucacagugccuugagaacugagcuguuuccgagguuucucaggcucugcuagccgcccaucgggguaagcauggcgauaaagacauuugcuuccaaaugggcagguccccuugccuugcucaaaguauuuacaggcuuuuuuccugaaaagcagaaagaaaaagucaagaggcuggugggaaaaugagggguccaaacugggccacugccugccuccauccuuaccacccuuacgccagagguaggucagccucacauucuagguggggcagcugaggcugggagagguugagugauuugucucaggucacacacagcugggauucugauuuccaagcaggauaggaaguauccccacuuaccugcagccuugcaaaggauauuaaccugccuggggacuugcuguguggagacugcagugcuccacaggcccuccggcagcuccagagcaccuccugggucaccacagagcuaagccaggccuggucacuccucugggcacuaagcucugaagcugggccacuugucucugcucaaaguucccuagguaccccaccaagccaacucuccccuuccuccuggccgcagugcugucaagguggcuacagggaaagcagaggguuuuagcaacugccuaaagccauaggucuccuuccaguuuuccugucuccaaccucggcaccagggagggcuucuucacgccuuaugugcuuuggaccccuucucugaacaguguuuuucaaugcauaaaacaugggucuacagcauacagugaccaaacaguucaaaauguuuucccucucucuuaauucuaccauucuccccacagaccucuauguuaagaacccugcccaaggaaacucaaucaaaugaauucccauuuugcucaaaugaacucugguuuauccaaucauaaaggaucccaaacugaaguuaaaaaaaaaaagauacccaagaauccagagggccaucucggaguacagaggaaggggaaagucacagaaauaaagccaaacaacagaaagggcacgcugcugucaggggcagcuggggugugugacagcgggagacaagaacagggaaaggaggcuccugaauccagugguuuuccgucuugucagaugggauggccgcaggccgguggugaaguucucugaggacggcuucauagcagcauaaagaaaagcccucuggccgggugugguggcucacaccuguaauuccagcauuuugggaggccaagguggguggaucacuugaggucaggaguuugagaccagccuggccaacacagcgaaaccccaucucuacuaaaaauacacaaaugagcugggugugguggcuggcaccuguaaucccagcuacucgggaggcugaggcugaggcaggagaauugcuugaacccaggagguggaggcugcagugagccaagauugugccacugcacuccagccugggagacagagugagacuucgucucacugggggugguggcggggggguaggguggggggagagagaacaagcucccuggccagcugaucugauuugagcacagguggcuggagagcagguguguggacgacacauccuccaggccccugcuugccuggaguucugagcggacuucaaaugaccgugagcaguuugcucucaccagagccugcuggacaacuccagagcauccuagcacacuggcuaugaacucgaucaggucaaacacauuauauacuggucccccacucucacaagaauauuacucuuuuuccucccccaggcuuaucuggucaccaaggccaaaagccuccaguucacucugacucacucuguguccucggcucucacacccaacuguguucauucuguuuacaaaucacuucccaaucuccccuuccuuuggguucccacacuuguggaagccucuggggccugccugccagggccacuuccucacuggccucccucccacucccaccaguuuccaccuucagagcagcacggaggagcuucccaaccuuuuuuuuuucuuuaaagagaugaggucucccuaugucuccccuggacuuaagcaaucugcccuccucagccucccaaagugcugggauuacaggcauaagccacugcgccuggccccaaccuguucuuaaagaccauggucacacugggauucaagugucccuuagauuccagucuguaggucccaccacauccuucuacacaccuguuucaaugccaggagccacucccagugucccccagacacaaaaccuacacccuucugugcccauguccuuccaucacuucccccuacagacaggugcuuccugcuucaugguucaggcucccaugcugcuuccccuggcagcccccgguggauccaagugcuuucucuguugugauagauggucccucaugaagaacuggucaccagcaaaccuguaucauaauugcccuuuugcaguuucccaugaaguugucuuacuuggcggggcacaguggcucacaccuauaauccuagcacuuugggaagcugagguggguagaucaucugaggccaggaguucaagaccagccuggccaacauggcgaaaccccaucccuacuaaaaaaauacaaaaauuagcugggugucguggcgcacaccuguaaucccagcuacucgggaggcugaggcagaagaaucacuugaacccuggaggcggagguugcagugagcugaaaucaugccacugccagccugggugacagagcgagacucgaaagaaaaaagaaauugucuuacuaaucucuacaucccccaguggugcuuagcuagaagguaccugacccauagugaguacucaguaaauguuuguggauugcaaaaaacacagucauuaaaggaaagcaaagcaaggaaagauccaaauagcaauaacaaucuccagacugcuuuucagcagagccccuuucuacaggcugggacccuuuucuacaggcuggggcccuuuucuacaagcugggaccccucugcuugccacgccuugcccucuuguggacacacaggaagauuguaugaggaaaaaaugguaaaaaaaaaaaaaaaaaaaaaaucaagcuuuaguaaacuaauaugcaacauaaaggaaccauuaaaaaagguaaugcauaguuucacuuuuaguaugacaaguaaacgccugccauacccaacccuccugcagauaagucuuaacacaaauauuucaagaagaccugaaggcaccagagaaugaacaaacgcaguuagauucuuuggaggaguaaacacaaagaagaauagcaauggcaaaggcuaaguuaccuuuuuuaaaaaagguagcuuuuguggcucacaucuguaaucccagcauuuugggaggccgaggcagguggauugccugagcucaggaguucaagaccagccugggaaacacagugaaacccugucucuacuaaaauacaaaaauuagccaggcguggcggcaugcgccuguagucccaccuucuugggaggcugaggcagaagugcuugaaccuggaaggcggagguggcagugagcugagacugugccacugcacuccagccugggcuacaaagcaagacuccaucuccaaaaaaaaaaaaaaaaaaaaaaaaagaaguagcucuuauccuggagcaggccaaaaucauaaccacaugggguggcuaaaacuccaaggggaaauccaaucuuucuggccugaagaacuaaaagacaagaguucaaggaaaucacagccauuggaaagugaggaagcaaucccacaaaguaaggggccugugaaaaagugcucaaaggcuguguauaaacucugcccaaaucugacuaacucccaaaccacacaggaaugcgacaaagucagcuacgaaugcaaaaccagaacugagaucugaacugcuaccuggguuugaguucaaacaauuuaccugccuguuaaaaacagcaacacuuggccaggcgcaguggcucaugccuguaaucccagcacuuugggaggccgaggugggcggaucaccugaggucaggaguuugagaccagccaggcuaacauggugaaaccccguuucuacuaaaaauacaaaaaauuggccaggugcaguggugcaugccuguaaucccugcuacucgggaggcugaggcaggagaaucgcuugaacccgagaggcagagguugcagugagccgagauugugccacugcacuccagccugggcaacaagagugaaacuccgucucaaaaaaaaaaaaaucaucacuuuacagauaaaccauaacagaauccuaagucucucuacaauguaauauuuacaaugucaaggauaaaaucuaaaauuacuagacauacgaagaaucaggaaaaugugauccauucuuaaaagacaacagaggucaacuucaagauaacaaggauuucaaaguagcugcuacaacuauguucaaggagaugaaaagaaaaaaagauugaaaaagaaugaauauccccagagaucuaugaacaauauaaaaaaacuaucauaaacggaaguagagucccagcaggaaaagaaaaaaacaagacagaaaaaaaguuaaugaaacaauagcuaaaauuucgcucaucuuggggagugacauaagcguagagaaaaaccacuccacuccuaggcaaaauaucaacaugcugacaaccaggauaaagaggaacauuugaggccgggcacgguggcucaugccuguaaucccagcacuuugggaggccgaggcaggaggaucacuugagccuaggaguucaagaccagccugggcuacauggcgaaaccuugucucuaccaaaaaaaauuagccaauuagcugggcaugguggcgcacacuacugguggccccagcuacucaagaggcuccugcuugagcccaggaggcugaggcugcagugagcugagauugcaccacugcacuccagccugggcaacagagugagacccuaucucaccgaaaaaaaaaaaaaaaaaaaaaaaacaccaaaacuaaacagguccacaucaccauguccuugcucauugcugcaucccagagcccagcauggugccugagagaaggaagagaggaagaggccccuaagaccacacuccugggaaggagaacgaggacacgggcugacagcagagccaggcaggcagcaggggcacgucgaaacucaaaagcacuuaccccauccccuguuugaaagcuucaaucaacucguucuuuuuauucugaucuuccacccaauacacacuuggaauuacaaacucugauaucacacggcauucuggacaagaccugaaauaagaauuagauuacuaagggagaagucauguuacgaagccugggcacacucucugcuaaaccucuugcucaacugccucaccacuacaggcauuuccuucaccagaaauuccaaaagaugaaaucacaaucauccaagaaccuuauuuacuauuaacaaaauaggguuucccaaugagaacacauggacacaugugggggaacaucacacaccggggccugucggugcaggggcaaggggagggagaacaucagcacaaacagcuaaugcaugcauggcugaaaaccuaggugauggguugagaggugcagaaaaccaccguggcacauggauacccauguaacaaagcuacacauucugcacauguaccccagaacuuaaagcaaaaaaaauacacacacacacacacacacacacacacacacacacacacauauaugguuuccucaacaaaaaagacagaugaaauaacccucauacauugcuggugagaauguaaaagggugcagccacuuugaacagagucuggcagauucuccaacaguuuaauguagaguuauuauaccauaaaaccuagcaaucccacgcccagguguauacccaagagaaaugaaaacacaugcccacaugcuguguucacaaauguugacagcagcauuauucauaauaguugcaaaguuaaaacagccuaaauguccacuagcugaggaauggauaagggaaaugugcugcguccauacaauggaacauauuccgccaggagaaggggacucuggcacaugcuacagucgggaugaacucugacaacacuaugcucagugaaaggggccaggcacaaaaggccccaaauucuaugauuccauuuauaagaaguguccagaauaggcaacucuguagagacagaaagcggaugaguggugaguuaaauugugggcuuuuaucucaauagagcaguuguuucaccacacgauuuuaggcaaauuacuugacccccgcaccccaggccuguuuccuaaucuguaacugaggagggucuuugagggaaugagaugagcggacagauguggaguucugaacaguagaacgcgugcaguaaccucuccacaugccagcucuuccccuguccugcuggagaauuugagacuccuauguuggccacauugagcacaucccaugugccaggcaucaugcagaauguuuuacaugcauuauuccacuucauccucaaauaacccuauuuucguuuuugguggggggaaaaaacgaagcucaaaaugauuaacaggcaacugggcuacaggcagguacuacuggauuucaaacacaaggcuaggagaugaaaacaggucagugccauuuaacaccuuuuuacacagaucaucuuugcugaguuccuccccaacacccagaaagcuugguaggaauuguugcccaucuuuuauaggaacaggcacuuaggcucaggaagaguaaaugacuugcugaaguucaugcagccaggggccagaacucaccaguuacucuugaggguaacggagggcuuaaaaguggacggaauaaagucucaaaucaaacauucuccuagcucccacagcuaagaccccuggcuguacuuacuuaaugauuggguuuucaaacuguuuggcacaccgccacugccggaugcaggacaaacaguacgugugauugcaauuggagagaaucccaaaucuccucucagaagcagaggccuucuccaggaucacuuccaugcagauacugcacacuuuguccuggcuugccuggaaggcaaaggccuuuuccaucucguguucgaacgucaacaugcagaucugaagcacagacaggaaggaaggcuuugguugugggccacugaggaguggcaggagcccuaggaguagcugcagccacacugccacagcugagaucaggaaggaacacugacagcgacugcugugagcaaaggcccaggcucccccaagucaggacacugacaucucccucagaccacacaaaggacuucaaaccaucacugguccagccccuugcuuuccuaggaggugacauggucaccacccauuuaggacugagaacacggagauccaaaaagguuaaacugcaguggagucagaguccguaaggacugcggcccuagucccccagcuccucugggcacuguuucccccgacucugagccaugucuacaucagagaugcugacucguccuuaccaugaggcuugaggcuggcagccuaguccuauguaagaagcaccacuucuccccaagaaaaugauucaaugaauucauucauucacuaggcaugcccugaauuccuucuaugugcuggcauuugagcaagagugagaagaccuaggcccagcccuuguaagcucagucuguccagaucugagacaagccaacacucaccgcagagaccucacacacuugcauaaagaagacagcucuaacccucugcuucccuggaagacaauggagagugucuccuuguccgcugccacauggagucaguacuaauuuaccucuugauuaucuaggaauacgcuguccauuuaaacaugccuuaggccaggugcaguggcucacaccuguaaucccauuacucugggaggccaugguaagaggacugcuugaucucaggaguucaagaccagccuaagcaacauagcaagaccucaccucugaaaaauaaaauaauuuuuuuuuuuuuuugagacagagucucucucugucguccaggcuggagugcgguggugcaaucucagcucgcugcaagcuccaccuccuggguucagacuauucuccugccucagccucccaaguagcugggacuacaggcgcccgccaccacacccaguuaacuuuuuguauuuuuaguagagacgggguuucaccauguuagccaggauggucucaaucuccugaccuugugauccgccugccucguccucccaaagugcugggauuacaggcgugagccacugugcccagccaaaauaaaauaaaauuuuaaaaguuagccaagccaccacaccuggcauuuuuaaauuuuuuuauuauuauuuuucuugagacagggucucacucuuauugcccaggcuguagugcaguggcacaaucuuggcucacugcaaccucugcuucccaggcucgggugauccucccaccucaguccugccgaguagcugggacuacaggugugcaccaccacaccuggcuaauguuuguauuuuuuuuuuuuuguagagacggggaucuuaccauguugcccaggcuggucucaaacuccuggggucaagcaaucugccugccuuggccugccaaagugcugggauuacaggugugagucaccaugccuggcccucccccgccucuuauccagcuucguacccucugcaucaugcauagggccuagcauaaggcaaagccucccaaaacacugcagacauuaaugacuuuaaaaggcccuuccaacaaguggcuccucagauucuaugauuugggcucaaaucuuccaaaacuucaccuagcuggaucccaaccaugaggaagugugaacccagggagggaggaugcuguaucugcaugugauagagacauacacacagacgacauaccaugguccugagcuagaucuguucuuugaacuuagcaugauuuuauauuucagauacgacuucuuuuucucuuuauucugaguaauuaaaaauuggcaaaauaggccgggcaugguggcucaugccuguaaucccagcacuuugggaggccaaggcaggcggacaacuugaggucaggaguucgagaccagccuggccaacguggugaaaccccaucuuuccuaaaaauacaaaaaguagccgggugugguggugggcgccuguaaucccagcuacucgguggggcugaggcaggaggaucaccugagccagggaagcagagguugcagugagccgagauugcaccacuguacuccagccugggugagagggagacuccauuaaaaaaaaaaaauggcaaaaugacugcaggaaaaagaaccugaaaacaggauguaaauauaccagauacauaauauggguauuacuggcagggggaugccuguggaaauaccaacaauucugucacuuaguacauuucagauuucuugaguguauauggauggccuuccguguccuguucaguacauuucagauuucuuaacaugaguucaugcaaagguuugugacuuuaccuuuucaugagccuuccucugcucugggucgaaugggugcaagacuugcagccuacagauuucacacaccuccccgugcagguagacacaggcauccccaaaccggcacuccccagcagcugcguaggggcacagcugcugcucguugcuguaggagcugcuggccuccacgucaucaaggccacuccugauggcauccagguaggaaugcggcuucaucucggggcugggcugggggucgcugcagcugccuggauuacucaccaugcucggcugggucuuccuuucagccaugccagagagaucugaaaacaacacacagcacacaugcacaugaaaauggccccauuuuucugguaugccguuagccaaagccuaacauauuaagcuacucugaccuaagaauuccacucuugagaacauauggcaaaaaaaacacaccgaaggggaaaaauaaaaggaauaguauaaaauguucauagugacauuacuuauaauuacuuaaaaaaacaaaaaacaaaaaacaaaaauggcaagacagggaaauagcaaaacaauaggauauacuuauacaaaagaacacuaaagccguuuaaaauggcaaauauggaaauguuaacacauggaccaguuaacacuaaaacaaacaaaaaaacagugagagcacuagaacacaguguuuccuucauaccagcaaagguaaaaucauuuuaagugaacuagaauagaugucuagagcaaaucuguggguccugaggccaguguaaacugccccauggucaccccuucucacgccaggagcugcugccuucccacugcacaccuccgagcuuguuuagaggucacguauucucacaggauuacucauuugcugaggacagaaucugccuaccucaugguagccaauuccaagaacuagaaaucucuucaccuggugaggaccagccaauaaaaacaacuuuuauggccaggugcaguggcucuugccuguaaucccagcacuuugggaggccgaggcgggcggaucaugagaccaagaguuugagaccagccuggccaacauagugaaacacugucucuacuaaaaauacaaaaauuagcugggcaugguggugggcaccuguauucccagcuacucagaaggcugaggcaagagaaucccuugaacccgggagguggagaucaugccacugcacugcagccuaggcgacagagcgagucuccaucuccaaaaaaaaaacaaaaacaaaacaaacaaaaaacacaacaaaaaaacuuuuacaauuuguagcuuucuuccucaucaaacccuguuuuaaggcacagaccaugccccaaacccuagugugcuauucuuuucccaaaggugcaaucuaaacugucaaacacugucagcauaaaaacuaagaccauucacuggccuaaaagucaaacagugaaacaugcucuuuagcaaaauauuuaguuuucuuuuuuuuuuuuuuuuuuuugagagggagucucacucuugucauccaggcuggagugcaguggcgugaucucagcucacuacaaucuuugccucccggguucaagaaauucuccugccucagccucccaaguagcugggauuacagacaccugccacuacacccggcuaauuuuuguauuuuuaguagagacaggguuucuacuaaaccauguuggccaggcuggucucgaacuccugaccucaggugauccacccgccucagccucccaaaguguugggguuauaggugugagccacuuuacccagacaaaauauuuacguuugaaaugaagagcuugaugcuucucaccagcuggacaaccaccauaugaagauggaaguuacauguugacaaaaagauuguguuuuuauguuuuaccaggccagucuuggagcucaacccagccuugggcacgagggcgaauguaucauuugaaugaucugcagccacauggagccucuucagaacaguucugaagucucuccgcgcagacaaucuggagguguauuagguuaggaguccucuugacaagaggaggcuagaaaggagcaccaagcauuaacaagagugcuaugcaaaaagacgcaacaaaaggcuuccgcuuacucacuucggucucuaagaaccaauguucucuuuucacgcuuuccggguucaugugaguuaguuuucacaauggaugcagugaccucggaaggagggugaggacuguggaaagcuggggagggcacacugugggccauggugcccacagcaccuccagcugcagcagagggccucguguggucauaucuaaacaaaacacacagcagaugcauuacagacaugccacccacacacaucucccacacuccccagaugccaauggcccuccuucugcugcacuuguugaggugaagaaggcggccaucuuuuccaauauuuaaacucuaacaggauuaucgauuauuaacagaugcuuggcaauucauugugagggggacauuugcuaucuaucaccuaugcuuaagugucucugugggacuugagugggacagacacacagcaccagaccacacagagaaccugaaaguuccaaacagauguugagcuaaaaucuccugaugccugacugacccaguauucuuuugagcaggaguccccaaaaugcugacaagggccaaugaucucucccugacugucucucuuggcacucauugacaggggaagaccaacgugggccuacuuccaucaucucccacugcacugcagagaaaaaggagggaaggaagcuuugcagucuagaaagaaaagaucggcucuuugcuacaaaagcaugaacaaguuuccggaauuguguacaauuuuauaacuauauauucauaagaauaaggcugaaaaguaguuuuaaaaaaugaaaauuaggccaggcacgguggcucacgccuguaauuccagcacuuugggaagcugaggcgggaggaucacgaggucaggaguuagagaccagccugaccaacauggugaaaccccaucucuacuaaaaauacaaaaaaaaaaaaaaucagccaggcguaguggcagaugccuguaaucucagcuacuugggaggcugaggcaggagaacccuggaggcggagguugcagagaacugagaucgcaccacugcccuccagccugggcaacagugagagacucuaucucaaaaaaaaaaagaaaagaaaauuaguuuuaggguacugaaacugagguuuuaaacuuauuugccauacuuuuugugauguugccauauuacuuuuacauuaaaauuucccccuuaucaagacccauucuccaaaugaaaucagugucacagcuggaaucuguugcagaguccuugccugcaccgaguuccauaggcacaguagcccuucugguaguacuugcagaugguggacgguuugcuguuugccaagucaugugagaauaggcacugacuuccuucccgacacacaccaugcauaaaauaccugcag

SEQ ID NO: 16227 - RNA, 2636 nt, Homo sapiens
aagucacagaagaugcucaguaaauaacugaccuccuuccauuccuuggcuuugccuuaaccaccuguaaggcugugcuugacuaagcacacagcugaaccaggccauaaauguugggccacaugcuacaacagcaguagaccaauggcuuuggaguuugugaucagggaaaggaaauucuuuuggcucugccauguuguccaugaugccaaggagacaaagcugugaacaccaccagaacaaaugucuauugacugugcccugcauuaucuuuacuguuucugggcaaauucugaaaauauccccaaagcaauaaucauuuuggugucucugguuucuaucucguuuucuuuucuuuuuuuucuuucuuuuucuuuauauuauuauuuuuuaaugaagucaacuucucaaacaaaacaacaaaacuccaacacugaauuaugccugguuuugcugucagacccuuguccgagccaugcacuuggaaacagucaucaagcugcgaagcugcguguuauccuaacuccccuuuguuaacagcuucguguuggccccucuccaguugcugccgccagcagagugucucuguuuucagaccaugucauccgggacuugccagccuucagagacaucaucuucucugguuauuggagacuuugaaggaacacuuuuccuuuuguuuuucaagacaguaacuguggauaugaugugagagguugacaguagugauaccuuugguuucuguagaugaagguuuuuuuuuuuuuuuuuagguuuauugaaacaaaugagaaucugucagcagaaauguccuuuaaaaucacccuuacuuuugaagagucacauagaagaguuaagauauggcuacuuuccaacuggucucccggggaggguuuggagcaguuagaggguccugugaaagcagaaugacaugaaucaaaauaaaaccaaacauacaaaugacacauuaaauaguagccaugggcuaccuuuccuuuucugauuucucugguuagaaacuaaaugcaggaaagagauaaguaucuggagacagugcuugaggugugcuucccaucagagaaccaaggaauuuucacuuuuuggcuuucuuucugggacucccauaucaggaucaagagacgaguugguuccuauagugguuuccaguuugcugugaguggugagaguucagagaacuucggcagugugcuagacuugacuuugcagcacagacacccucuucucuucuugucuuucauuuugcccccucccauauaccugguacucucacacauuucucuuucuccaaacuugaauaaaaaugacucucagauuuuacauucauccuaagggagaaauauuugcaaaaucagauggacucaugagaucagaaaccugaaaugaagaaauaaaacuccauaggcagaauuccaggaaucaucccguuagugggaggguuuugagugguuuucucuccuucccucucuuuucuucugccuuucuuucauaucaaaaagucacagaccuacugcuuauucuccagaaauguacaucuaguuaaugacaccauccuacauaaaccaaaugugagcaauaaugacaauauaauagcaccauguauucagcauuuacugaaacaaugugccaagcaacuuaaauaugucaucucauuuaauucugaaaauaacaauucugugaugucaguaguaguauucaccauauuuuuacagauggggaaacugagguuuagagagauuaagagcuugccuaacagcacacacuuaccaagugaagagucagacuggucugacucccagccacuacgccauucgcugugccuggcaggccacagugauuuugauuguaggagaaugaaagaaaaggucagugaggaaggcuuuucggaguuggugggaccugagcuggucaugaagaacauguggaagaagggagcaagugagugucauguauggccuucuuacgcccucaacucugaucaguucuuuccuucagaaguaacaguucuucuccucccacacgugagccuuuggaugcaguaguuuuccacucucagugaaaacugguuaucauuaaucacuguaugcagcccuguuuccuugggggggugggggugcuucuuuuggaugcugauaaaucuuucuaauuagcuguaaaaaucaugaaaaagucgacaucguguuuuaaucauaaaccacuugggccauuggcauucauguccuggcuugaauucuuuuuauuuuuuuuuuuuguuuaccaaauugcuuugaguuuaugacauuuuuaguagaucuccuguaaguccacagagcuugggauuauaaaagcuauaaauuguuuucaguaacucaaucagagaaaagcaaagcaaaaacaaaaacaaaaggcauugacacauugucagugauuuauuuucccauguguugguggaauauuaaagaucuuugagaucuuuuuagauaauucagugcaggccugguucuaagaauauaagcuggcacgaugaucagcgagagaguaaauggguuugcuuugcuuuuuuuuuuuuuuuucucucaggagcuaaagugaacucuuccaagaaucgggaagaagaaugugggauuagaagucacacu

SEQ ID NO: 16228 - RNA, 1303 nt, Homo sapiens
uuuuuuuuuuuuuuggcugagcacaggguacuuuauugaugguauaugacaagguggggcucccuaggccccuccccucuucaaggggucuacauggaaacugugaggaggggagauucaguguggugggggacugaguguggcagggacuccccagcagugagggucucucucuuccucuugugcucuuacuggggcuggugguccaggggucuuacuccuuggaggccaugugggccaugagguccaccauccuguugcuguagccaaauucauugucauaccaggaaaugagcuugaaaaagugguuguugagggcaaugacagccccagcauugaagguggaagaguggguguugcuguugaagucggaggagaccaccuggugcucaguguagcccaggaugcccuugagggggcccuccgaugccugcuucaccaccuucuuggugucaucauauuuggcagguuuuuccagacggcaggucagguccaccacugacacggcaguggggacacagaaggccaugccagugagcuucccguucagcucagggaugaccuugcccauagccuucgcagugccaguagaggcagggaugauguucuggagagccccguggccaucacgccacaguuucccggaggggccauccacagucuucuggguggcagugauggcguggacuauggucaugaguccuuccacgauaccaaaguugucauggaugaccuuggccaggggugcuaagcaguugguggugcagaaggcacugccgacaaucuugagguuguugucauacuucucaugguucacacccaugacaaacauuggggcaucagcagagggggcagagaugaugacccuuuuggcuccccccugcaaaugaggcccagccuucuacaugguggugaagacgccaguggacuccaugacguacucagcgccagcaucgccccacuugauuuuggagggaucucgcuccuggaagauggugaugggauuuccauugaugacaagcuucccauucucagccuugacggugccauggaauuugcuauggguggagucauauuggaacauguaaaccauguaguucaggucaaugaaggggucauugauggcaacaauauccacuuuaccagaguuaaaagcagcccuggugaccaggcgcccaguacgaccaaaucuguugacuccgaccuucaccuuccccauggugucucagggaugugguuuggcugacgaugcaaaagaagaugcggcugacuguagaacaggaggagcagagagccgagccaa

SEQ ID NO: 16229 - RNA, 2123 nt, Homo sapiens
uguuccucccacuauaccagugaaaccagcuuuaauacagagaaaucaaaacaaagaaaaauacagaaaagugggcaacagcuuuugaguauuuucuuaaaauuuuccauuuuucgacuuagcgcaauaauauaauaaaggaacaugggauccuuuauuauuguuaccauaguuuuuaauaucauuuucauaaagcuaaccauguuuauuuagccauuuucuuagcuuuugccaucaugguucuuugaaaauuuucuuuguaauugcugcaaugauuuuggagaucacagaugcaugcuacuugcucaaguuuauucuuggaagucguauuaccaaauuaaagguucucaacauuucucgggguacugcaauuuuuacauugcauaugauaauuguuauuacugagaucuacauuccuuucaucaauucacaaauacacaaucacagacaucuugagaucuaucauacguccagcugcguucauuucacaaaaucagaaguuaagccuaaagaucugaaccgagaagccggaccuccggucuauuucucccuccuggauccaccccgacuuauuaagcaguuagaccgacccuuccauacucauucaaggcagugcagagcuuuugcuccccugcccaguggaaucuacacuggucccagccucucguccaacucccguaggacgccaagcaauacggaguucgagaagcucagaaaucuccugagccccaccaguccacacuagguugcaagcccgcagcaccuacgccacggcgucaaaccggaaaccagaaaaggugaaggcaucggacgccccucgccccagcccggccaccagcgacacuauccuucacugacgcgcgaugccggccuuucagcccagacucaucgagcgaggaugcagcgcugagaggcuucuaaggcucaggcccugcaaagcccaggagccggcuguagguguccuuggcgaaugccagaccgcgcgcaccgucccagcaagucccgagcgagugugggacaggcagcaaaucagugcccccuggccaggcagaacgagucgaacguggaaguagggagcaggcggaggccggcgcggagcugcaguuaagcaagccgggucuggcuuugggcccugggccuuccagccggggacucugcgccugcgcccgccuggccgccgcccgcucucccggcgcggcagcugucugggcugcugcgcgccgccuaggugucugggcgaucuaugggcaagagcaagggccacgaugacagauuacggcgaggagcagcgcaacgagcuggaggcccuggaguccaucuacccugacuccuucacaggugacucccgcggccgcaagccuguagccgccccgagguggaguaggacgggcaggagcugccgcagcucugggccucauagguugggguggagaaggggaccuugaggccgcgcggccaccuugcccuccacuccucaaguucuucagucacuuaccagcaacccagugacuuuuucuccuucucugcuuguucccggaaaucuaaaaguccgggugauguuggagggugucaggccugaaaauugagucgggauuacuuugguuucuguguaaccuacagcaaccugagauuuauaauacauuaagagaaaaaauacuccaagugcgauucguuuuuccacagccgcaagaauguuaguuuucacauuuuuagcuuuauuaagguagaaacuguuuuucauacgaugcuguuuuaguuuauaggauucagagugcuguuuucaguuacucaaaucgguuuugagaguagcauagucccugaagucugucggguuucuuuucuuaugaaaaaaaaaaaaaucuggcauucagcagaaugccuaauggauaauguggcccaaauuuccguucugcuauaaauucauagguuguuagauuggaagggagauuaaacaucaucuauccuggggcuccugcuccaagccaaggucauggggguucaggaaagcuaaguggcuugcucuguacuguccgccagcgaguuagcggcagggcugguacugaguuauacguccagaacgcuugccuguucuuucacuuuccagacauaugggacuugggauu

SEQ ID NO: 16230 - RNA, 17225 nt, Homo sapiens
aauccaaaccacauggaaagaagguuaaaauggagcccgugcacuuugaauuuauucucagcauuuaggcugcaguaucacagcccaauuuccaccaguaggaggcauuaucuaaacauguugagaaauauucauuccuaaggaaugacauuguuuccuuaucuggcucaauucagucugagaaggacuguuguuucugaugaagaaagagcuccacccucggccacugccacagcugcucugccaauaacaaaggcacagcauuuucccucugugcaucuccaacauggaugcuuuucagggcauuuuaaaauucuuccuuaaucagaaaacuguuauuggcuacagcuucauggcucugcugaccgugggaagugagcgucucuuuucuguuguggcuuuuaagugccccugcagcacugagaauaugaccuaugggcugguuuuccucuuugcuccugccuggguguuacugauccugggauucuuucugaacaauaggucguggagacucuucacaggcugcugugugaaucccaggaaaaucuuucccagaggccacagcugccguuucuucuacguccucggccagaucacucugagcucauugguggcuccagugauguggcuuucuguggcucugcucaauggaacuuucuaugaaugugccaugagcgggacgagaaguucaggacuccuggaacugauuugcaaggguaagcccaaagagugcugggaagaacuucacaaaguaucuuguggcaaaacuagcaugcuaccuaccgucaaugaagaacugaaacucucccuucaggcccagucucagguaagaaaagacaaacucgccuuuuucucucagcaugagcucgaaguauucucucugugcuccuuucagccagggcugucuguguccugucagaauauuuugaaacuaaauggaaacugaaacaugaugcagcauugagacuaucucaggaaaagcuuuugaaaggcuggguggcucaauaaaguugcugacuggauuaucucuuuuccgguucugaaaagaaaauauccacuggauuguccacauauaaauacuuaaguacuuuaaaacagucucucugggucuguaaauaaauaaugccuaacacuaaaucauaaauugaguguuaauggcagagcuguaauuagaaauuacugccuucuaucaauuauuuacauucaaguuguuuucucaaacacacacauguauuauucaucuauuaaaauguagcugaaugaaaugaguuauuacuuuucaaaguugcauguaauauaauuaguguggagauucucuugaaugauuucuggcaacugcuaucucuguguauaaauauugucaagauugagaagaauuuuccuuguaugguaggaaucagcaguuuuuaaauagccuucugugaaaaagugacuguacucucuagggagauuauguuuuauacucuuugugcuguacagcuaaagggguucuuaauuacuucagaagcucaagauuugggcauuguuuuauuuaacagaaggaaaucauaucuuuaccuaauugaugcagggaaguagccugucauuccuccaggcacaugaacacaaauccagauguacagccuuaggaaggacuaacuucccauuuauagguaguaagaauugcauucccaaaagcaaaacaagugguaagaguugauaagcagauccacaaauugucaggaaugcuaucuguuucagaauaaaggcacagaaauagcauuauuuuacuuuuucgacaaggauuugccuugguaacaacaaaucaaggcaaaaucuguuuuuaaaaucauacacuccaaagcugguuggcaguaaagucauacucuucauaaauugauaagucaaaaaauacuccaaaacaaaaucuuuucuuuaaugcauaaagcacaucuuagauaaaacauaucaggcucccaaaugucuugugucuuuuauugaagaaggguauaacuuacaacucuuaugacagaaugauugauuuaugguguauguccucagucaccaggcuccauucagucaguggcaggcccaaacacuuaucauugugugagcuucuccucucuaaacacagguacaaggaaaucuugcacaucaugucauagcuuaggcugagcacacugaccugcugauucuucaucagaaugagaaggaccuggggcugauuccugugggaagaugcauaaggaaugugggcaagagaacuuguaucaauagcaggugcugacuacagagguucagauaggcaggaggcagcauauaguccagaccaacaauagguguacaugugccuggaggcggaaaagaacauucauccauggguggggcagauaaaaaaucuagcuggaugacucucuauucuuaaggaagauagaauggaguaguggaaagagcucagucuuggaauugucuggcguuggguuuguaugcugaugcuaccaaucaccagcuaugugaccuagaacuagugguucgaccucuuugagucccaguuuucucauaguuagugguaauaucacuuacuuuggagaguugucggaagauuuagagaugauagauacaaaugggcauaaagcuucugguacacaguauuuguuccaagucaaugaggaaaacugccaugguuugggggaggacauaugcaaaauaagacacuuuugagggcugguauggaagcauccaccaagcucuaguuugacucuggguacugugaauugagggaaagcaucggucaaugcaaacgucaugugaaagggggaaggggaccugaagcugauggaauaguuuauaauucagcuggaacuggcucagguacugagaugagauggcguacagaagccucagcuguggaaaaagaggaagacagacgaugaaggaaggaggaacauauaagguagccaaccacaauccauucagggacuuucacuugaugguaguugugccucacucauuaauuauaaguacagaaagauauuaugaguucaguaacacauuuacauaaguguauauauauuugaagaauagcagcauauaauauuagcuaaaacuuaaugaauacauguguccaguaucauuucauuagguccaucaaauuacccuucaaggugaguaacccucguuucacaagugaagaaacugagauaaaaagaauacgcauaguaaggggaaaguuuagauuuaaaccugaguagugccaguccagaguuggcauuggugcagagguugagacccuucacaaacacucuauaucugagucaaagguugggaaccacugauuuaaagcuuauuugugguuuuguuauggucugaauggguucauuuguagauuauuauuucuauuuucaaauaggcucaucugcuaaagaauauuaaggaucauuuaaacuaaaugucaagagacacuuugaaaaagauguuaguuuuccaaacauaaaauuaauuucaauugugaaaacagaguuagagccaaaaaaguuagaagauaauuuaagcuauuuaaacuucugcuuuuaagauccaggggagaaaagcugaaccauuucauauucaggaaagaguuuguuuuuucuaauuaccaaaaaucaagacaaaucauuuucaagguuuuaaugauccuaauuuuuucucagccuuuaaauucuuauagcuucagcuuccugauuguaucgucugucucccuuuuccauggacaguaaguaaugacagaaaaaaauuagucucuagccauguauauacauuuaucaaugccuaaaaaugccuggcugaagagcuggucauuuacucaaaugaccacauuuacuuaugcacagaauauuuuccuaucagagcuaauacuauuugagcuugauuucuguaagucuuauguaaucuauacuuuguacucuuuucuaucugccugccuucugguuauuucuuugcaccagcaauguuggggaggagaauagagauuagguaaacccuaacuuuauuuugaguuuaccuaauaaauucaaaaagugaguuuaaaguguuuaaaaauuaagaugaaugauuucaaaugagguaugucaaagacugugguaauaauuuagcuauacacuucucaauaauaccccagcucccuaaauggcuuugcuuucacguguguacucaauauuucuuucuucuuaagauucuaggauggugccugauuuguucagcgucuuucuucucucugcucaccacauguuaugcucgcugccgaucuaaaguuagcuaccuucagcugaguuuuuggaagacauaugcacaaaaggagaaggagcaguuggaaaauacauuucuggacuaugccaacaagcugagcgagaggaaccugaaauguuuuuuugaaaacaagaggccagauccuuuucccaugccuacguuugcugccugggaggcugcuucagagcugcauucuuuccaccaaagccagcaacacuauagcacccuccacagagugguggacaauggucugcaacuuagcccugaggaugaugagacgacaaugguccuuguggguacugcccacaauauguagcucauccaccaucaaugacucaugguguugaguggcaugcucauucugugauccuccuaacguaucaccagcaaccugugugucucuguauuuucuuacauuuggaguauguuuacaagacaauaacacaaaggaaacugcuuugaagcucucaaguggaacaucaggaugugcucaaauugaugcugaggggugacaaaggugcucuugcauugguggagaggggcucaguaggccuaaauguugcuccaagaucuaagauuuuaucauucaacagacagacucaugugagagggcucaucagucucuguaaauauugguugcagaauuuaggggcagaagcaauggcuugugagugagcaaguuacucuuaacauagguugcccuacacaguggcuccugcagugugaucagcaggagucucuguccuacaaaucuacacuuuuaaggauguaugaaauuguggaauucauucccucaggaucugaagaucucaguucucaaaaaucacaaguugcaagaauaugauaccuaaaauugaaaguuuuucacauguuuucacuguauacugaaaauacuccccuggaagcagggcugcaucauaauuuuugugggcuuuauguacuuuugccuuugcgaaccauuuccuacauucaaaauaguaguaacaaauauauauauauauauauauauauauauauauauauauauauauauauacacacacacagaaauauauauuuauaacugcauugauaaaaggugaauauauuagcauuuucuucaaccuaaaaguuuauguauuuucuucugauuuuaaaagaaauuaaaaacauuuuagugggcccuuacaaguauuaugguccuuaggcacagugcuuacuaggccguggguaugucuuagugcguuugggcuacuauaacaaaauaucauagauagguggcuuauacaaaauagaaauuuauuucucacaguucuggaggcugggaaguccgaggucaggcugccagcaugcucagguucuggugagagcaauuuuccagguugcaaacugcuugcugacuucucaguguccuuccaugguggaaagugcaaauaagcucccuugagcauuuuuauaaggcacuaaucccauuccuggaggcuccaccuucaugacccaauuacuucucaaggcucugcuucuuaguacuaucagcuuggggguuaagauuucaacauaugaaauugggggagacacaaacauucagacuauaguaggguaaauugaccuuggcuaaaggucuggggacacuguccaaagcaguacuggcauaaaacugcauugcagucuuacauuuaucagaaauaaugcaaaucuugcauucuacaauguacuauauccauguuaguauguacauauauauguguauguauauauguacauaaauucuccuuaaaucucugagaagaauugugcuuuaaaaaagaacuauguuuugugcuguggcucauaccuuacagugguagucuaugucucuuaguuugagaaagcugaauauuaacuucuuauuaacaugaaacaugauggcaaacugaauccuacaaguauaggacccagaacauaucuauguuauugucauuuacaagaagaaauauguauuuggucuuucuuccuauuccuggugcagagcuccuaaaaccuuugggaccucccaagugaugugucugguaguacgcgaaugagaugacugauaguuaggggcuucugaauggccucagaauagggucugguugccacgggaaccaaccauguguuuagaggguuggaacuuucagccccacucccagaccuuggggaaggaagaggggcugaagguugagucgaucacaaauggauaaugauuuaaucaaucaugccuaagaauaaagcuucccauaaaaaucuaaaggacaagguucagagagcuucugcauugcucaauacaugaggaguggugagcccaaaggggccguggaagcuccgugccccuucccccaaaccuguuccugugccuccaucuggcuguuucugaguuauauuauuuuauaauagacugaugauaguaaauaaagcccuuuccugaguucugugagcuacucuagcaaauggugaaaucugagaaggaaaucaugggaaccucugcuuuguagccacgucagauagaagaugugaguaacuuuggaaccuacugcuugugacuggugucugaaguugggggagaucuuaugggacugagcucuuaaccugcuggggaucugcacuuaaugccgauuaaugccagaauugaauuguaugauauccaguugguauuggagaauuggccagugugggagaaaacccacacaguugguggcaaggaguguucaguguugagugugaaugucaauaaaaaaagguuuguuuuuucuacguacaauaucuuugggaacuuggaggugcagggucagacgucuguguguguauguggcagggacagaacagggauuagggaugugaggggguagaguuuucagaauaaagggagagaaaauucagcaaagaguucuccuucuuaaucuuucuugacuuaaaguuugucugcccuuaagugucuucugagcuggaaaaagacauauaggaacuggccgaugccgaugccucuuuugcagugugugagaggcugaaacagaaguucuacagaaguagguuagcuguaaggagcugaggauugaggagucauaucugggggauauuccugccacccucaaguccagggacuuucugcacucaaaaaacuuacgcucaugacaaugacugccucauucaagaaaacccaagcugacuggcaagaagccagcagccuggguacuuguugcugcagcuuaguaaguagcagaagagcucauccuccuccucuggaagaagccacuuaacagguucucauccugacuccuaaauuccuuaacaguccuuuacucaggaauaaaacaaguccaagaaaacuuaucugucccacaaauaguccuggaggcaguggaguaagauagggagagcaaauuggugucugcucuugaguaucuugagggaauggguaucuagaggcagcaggaugaacuggcuuugauagcagagacuuuaaaauguguggaccauuaguugucuuuggaugugcucccuagaggcugcgccugacacagggagcuguguauacaugauuuauuaaaaggaaauccucuuaggagaaacauauuagcaggauaaacacaagaaagaaugcaguuacaaguggagucucaaucaaucccagaggaaauucugggacuucagccucagcuugaccuaugggggggcucuggaaugucagauuucuccugaucccaagugugcucuggggcuuccauugcagccaagagagagcauuccccagaaaacuccaggugaggagucuccaguggcccaagggugauccuccagaggagguuacacugccgaacugggacauuggcacccuggauuugaauaucuagagagggcacccaauggucauacuaauguuugccauaacagucucuucuaggucuagacuugaagcauauggaaggguccuugggcuagagccaacccaagcccaggcugacucccuuuuaauacuucuaauuuucccugaagaucuggucuucucccuaccaccacuacccuauuacauaagagaaaaggauuggagaaugcucuugaaaagaaugugaugcuuucccauacaaggaauauacucaaggaaaaauuucauggcacaaaaugcugauucuguccaauuuaucccaugaauaaauuguguacacauauauauaugauucuuuuguuuuuccugugcaguuccuuccuuuuuucaggcucaaccacuuaauucagcuuuaggauacauucagcuuauucauaucaaauauaaagugggagaaaaaaagguauguaacaaagauuacaaaaauaaggcauggcagacaaaucacuacauaauucuaugcauuauaccuuaaaguaauguauuguaaaauauauguguccaaagcaacuuuuaaaauuuuuguaugguuuucuacuugagaccuuuaaagcaucacuaaaaauguauacauuuaaugagaaaacgaugacauuauugauucaaauuaguuguuucaaagccugaugauccacugauuuacucuaaaaacugguuaaagcaauccagaagucacuggguagcagaaaacugcuaccgcuucucacaugauauauuucaaguacuucaacuauuaacuauauuauucuauuuagacuuuggugguuccgaauucucuaagguaauuaucuuaauuuucuaauauuucccucucauuuuucucucuuauuuuaaauauccccuguuguacaagccagaggauauuaauuuccuuuguggguagugcuuggacuucucugauuuuagaucccaaaaucauuaagaaaaagcuaagagguuggcaugagagguuggauggaaagcaucuaucuguguuugucaguagcucucgauguuggcugcaaauuggaaucaccugggggccuuugacaaucacaaugucuggacccauuuccugagaaccugauguaacuuuucuggguuagggccugaacauugagauuucuuuuaaaagcuuucuaagugauuauaaugugcagucauggugaagaacuacugauuuuauauggggagucagugaagguggugaggggcugugagguugaaauauuggaaauguuaucuggauuucaaacaguagaguaugauaaaaauuuaaaaacuggcucuccaggaaaaaagagacauccuaauaugauguauuugccaauauaccauggguuuucuugggcugggaugaacuuucagaaguuuuacagugagcauuuuuuuuuuuaugaauuuaaauugguucuagcuaagcaauuuuggaguaucuuugauguaccugggucucucauuuuaauaaacauaacagugguauguuagucaggguucuccagagaaacagaaccaacaguacaacaguauauauacauacauacauauauaugugugugcauguguguguguguaugcguguauauauauauaugcuacauauaugaaaggggauuucuugugggaauauauauuauauauaacaaaacaugacaaauauauaacaaaauauaugugcuauauauauuguguguguauauauauaugaaagaggauuuauuguggaaauuggcucaugugauuaugaaggcugagaaggcccaugacgugccaccuguaagcuggagaaucagggaaauguguaggguggcucaagucccagucugagggccugagaaccaggggaguugaugguacaaaucccagagccaaaggcaaaggaaccugaaguuuuuauuuccaagggccaauagauaaggagaauauuggugacccaacuccaggagacagagaaaagauuggugacccaacucgaguggagagagagggagagagagagagacagagagcaaauuugcccauccucucccuuuuuguccuacccaggcccucaauggauuguauggugccugcccagguuaggugagggcagauuuuccuuacucaguccacugauucaaaugccaaucuuuuuuggaaacaccccuacauacauacccagaaauaaugcuuuaauaacuaucuggcuaccccuuaauccaaucaaguugacaucuaaaauuaaccagcacaugugauaaauuaaauaugguucaauggcuccuucuggcagauguagucguguuauccucacuuugaaucugaccuuaugaaccaauaaaauauggcagacaugagguagauuguuaagcaguaucacaguuuaugccuuggucucuuacaauguugcaaugcucaacagucugguaaaagccacuauguaagaacugcaauuacucagggacuaccaagcucugaagaggcccaagcuagccagugggaggagagagagagagauaaaaagagagagagagagagaucccaauggcuccaauugucucagauauucuagcuuaggggucaggcaugugaaugaaggagccauuuuaaacauucaggccccaguguacacgacauggagaagaaccaggaaguccaaccaacagugagaauaaaaggccccagaucuauggcccuaaucaaaucauugcagccaucuccaaacauuugacccacuccaguggaggcugcaggcuuuguagagaaguccuugccauguccuauccaacuccaugaccccaaaaaucaugagcuuaaauaaauguuuguggcuuuaagccacugaauuuuggggcaauaugaagcgacagaaccugaacacuaacaugaaaaucagaauuuauaaaaagacaaaaauuacaggcaaauuguauuuauacauuuauacauucucccuaugcauagagagcauuuucuucaaucauguuuucuuuuucuuuagguuccaguuagcaguauagcaucuacagcaugauuugauagaugcugauaaguaggucucuaaaaucucuccaccaaagcuggagauucacuuucaauuauuuuugguuaauuuuuguuugaaaggaauacaaacauauuauugggaggaguaacacauuaaacuauuauuugucauuaauaucuacgaaaaaauagcaagugaggguuucagacuaggcuggccuucaguaagcuggaaagagauuguucuucuagucgucucucaaaauguuaucuucagacugucaacaucaguaucacgaugaagcuuguuagaaaugcagaaucagacaguaucuaaaaccuguugagucaagccugcaguuuaacgugauccuagcugauuccaguucaagcuaaauuugauaacacuaaggcagugguucucaaacuuuaguccauauaaaaaucaucuggagggcuuauuaaaauguggauugcugaacuccacccccagggugucugauucaguaggucuggggugaggcaagauaaucugcauuucuaacagguucucaggugauacugaugcugcuggucuagggacuacaucuugaaaauaacugcucuacagcacagagcaggcuauucuggggaaggcaggcuguaagaaacucagaauccuggccugcacuccagaucuacugaaucggucaucagcccguccaagauuuuggggugccuuuccauucauucaaggauaccuuucuauucauucaaggauauauuuuguccuuuaggaauauuuuaaaguuuacuucacauaaguuuuacauguuucuuguaaacucuauuuguagguguuuucuuuguuccuguuguaaaugguuucuuuuuuccacuauaucuuucuaagugauuguugucugaguacgugaaaagcuauugucuuaugcuuauuaauuuuaucucucuacuaauucuuuuauuguuuguagggcuuuucagaauuugaaaguaaacauuuugcaaccuuugaugacaaaauggaucuagacaauaaauaaugaauucuaaacuauuaggugaaagcagaauggggucagaccuaugcaauuugaagccacucaucuauauuagcaucacuaaaaaucaaagcagaugcuacgugccuuaugaugcaaggcaagaauaaguacauaguaucacaugugaaauauuguuuccuaagaagcuaaaccuaaucaaguauuuagacauuacugcuaguuuauaggaaacauaagcaacaaaaaacaaggcaauuagcaccacaaaaaaacaaccagguacaucuagaucuaacagaacauuccauuuuacagaugacucagucuccccacagauuaacaguauuaagaaaggagaauaaaggagauauaagugacuuaauaaccagauaugcuauauagaccuuauuuguauccuguuuccaacaaccaacuguaacaagauaucuuugagauauuuaggaaaauaugaaugaauauuagaugauuuuuagagaauuauuaauuuugcuaugugugguaauggugugccgauuuauguuuuuuaaaaaguucuucaguuagagauguauauuuaaauauuuaugugugaacugccaugaugucuagaaguuucuuuaaaauacucuagaaaaaagaguuuagggagaaagcugaaagaugaaauaagauuggcaaaauauggaaacuauugaagcuggaugguagguacacggaauucauuacauuauucucuuuacauuuguauauguuugaaaaauuucauaagguacacaacaaaauaaaugacauggucaccucaguuauuuugcugaaguuuugucaaucacccccugcuuagcuggaguuuaccuucuaguaucauucucagcaaaggcucacaggaaugcuauucucugaauucuuacauauucagccuguuggccuguucucgaauugaaggacagcuugucugguucauacuuucucuacaugaguguauuguaagcauuacuucauugucuuuugucauugaauauugcugagguggccacagccugauuucugaugccaucucuauuucuuucuuuauuacuaacaagauguuuuauccuauauucucauugguuucuuuaucuuucauguccaaaaauguuaaauaggccuucagguaggucuuuuuggaacgauuuuuccugcuacaaguuuacucuuucauuguggagaaucauuuucuuauauuucaauaaaaaaguuggaaaauuuucaacuuauuuuccuuucugugcuauaucauuuucaagaaacuauauuguuuugaauuuaaaacuaaaccacuccuauauuccuauuggaauuucauuaauuuaauuuaaaaaacuaaguuaacuugaagucuuggcucuuguuucaucuaaguuucacaagcauacugggaggcagguauuaccuuuucuauguuuauaaauaaugcuagaguccaaaaaggcuaaggugguuaugccacuguuaaguuauugaacaucaauuuggaccuacaugugucuaauccuaauuuccaucacacaaauucugccucauuuuaguauauucuugaguguucauauaacuuuucaaaguauguucccucauuuguaaaaugaggauguugaauuaguacaucucaaagucucaacucuguuguccuaaaucuuacagccaguggugugugaauucccagccaguuguauucuuaauauccucuugggaauagaggucuaucuccaaguuuccuggccucugucugggccccuggauucuuucccauccugaacagcuuuucaccuuggguuucuaaauauuuaggauaguuaugcucaaacuaugcuccuacuguaucaaugaaguaaacuuuccauuuuauuuuuuuaaaaauuuccuuagauaaaaaugacaauugauauagaaggaauuuuuagcaguggaaaguuuauaaaagauuucaaauaguccccaaacuuuaauuuuuauauauuuuagaguccaccuuucugucuggccagcuaucuuuuuauaauuuuggguuuccuguaccuacagccacaacaaugccagagagaaaucuucacaaguuuuaaauugcaaugaaaacuugagauuaaaaugggaaaaugaauuaauuacuucaccuaaucacauucacugggccauuucaagaaauaggauuaagucagcaaaguaagaacucaugauauuaaguaacuuugcuuaagaacaguaccuuaagauauaugcauuauucggcaguuuauaaccuauaaaauggugacuaguugcauuguaaaaacauucugugccuauauuuuaucauaaagagaugugcuucugcaaucauaauaauugcugaugguuucaacagaacacaauuauuucucccagggguuuuguugguauuugugucacggaggaaacaugagggauaguaaucaguguuuuuaaaaggguuacuuccuuaaacaguuggcuaacuaugaguggguuucaccgacccuaugcaugaagucaagcaauuaaagaaauauaugcuuacaaacugauccauuuccaccuuauuuugagaaauguccucaaaaacacagccuccuucccuaccucuuucccuauagacaaguuuguugucccaacuaaaggugagauggacuuuguuucaaucaaaacuguuccacuuugaucauaucucucuaguguuuuccacuuuuuuuccaaauggauuuuuauuuuauuugaagcauguaaaagacauaaaaagagagguaacuaggagaagaauuuggauggagggucuggaggcguggcagccuuaaccugcagccucacuucuauaggaaucacccuagaguuccacagaacaaaguuaggaaacucuuguucuaaacaguggaggccaauuaggaucacuuggagagcauuuaaaaaguucuaaugccugugccuuauucccagagaccacaauuuauugggucaaaaguaaguucugaaagucaggauuuuuuggaaagcuccaggugagucuaugcaggagcuagaauugauaacccuugcccgggaguaccacugagaggucacggcaagucugaacaaaaucuuacuucugacacaaacuaaacauuacaccaggcagggauggccugggauuugguguuccugaugugucucugaauccuuagacccagacagaucuugcuuuagaguuuuguuucccaggguauuuacuccaugguuuuuuuucuuaauaaagaauuuuauuguaaauaguuacauuaauaaauagcaaagcuauugcuauuuucaguccacuuagguuuguuuuaaaggacuuaagaaugugccacuccaaaauauugccacuuugacauacauauucauuauuuugaguuauaggcacuugaaaagcagcagucacaagauugcucugaccuuccugcuguuucuuaaaggcaggagaagaaauucccaugugaaggauauccucccuguacuagaaagaaagcaacacucuuaacaucaaggagggacaauugaggcugagaggauucuguacagauuuuauuaaaauaauucuugucuucuugccuccccaaauaauuuaguugccuuuucacaaauuacuauucuuuguccaauucaguagguaaguguucaacuccuugggucuccauuucuuuauuaaagauucccggcccggcgcgguggcucacgccuguaaucccagcacuuuggggggccgagacggacgaaucacgaggucaggagaucgagaccauccuggcuaacacgcugaaaccccgucucuacuaaaaauacaaaaaauuagccaggcuugguggcgggcgccuggucccagcuacucgggaggcugaggcaggagaauggcgugaaccggggaggcggagcuugcagugagccgacaucgagccacugcacucaagucugggcgacagagcgagacuccgucucaaaacaaaaaaaaaaaaaaaaaaaagauucccaugcuauguguuaaguaaauguguaugcuuuuuuucuguugaucugucucaugucaauuuaauucucaggacaacuuuaaaaaaaaauccuaagaggauagaggugaaguuuugccuucccuacaguuucauaagucaguuucacaugaguuucauccaaauaacuuaaacagcagaaauaaaaccaauaaucuucaaugcaaaggcagagcagccuagauauucaugugcugggauacccggaagauucaaaacuucuccccuaggagggagagcauuuggaccaaugccuaaugcaugcagggcuuaaaaccuagaugacagguugauaggagcagcaaaccaccaugacacauguauaccuauguaagaagccugcgcguucagcacauguaucccagaacauaaaguaaaauuuaaaaaaacuucucccuuagaguauuuuuaguaauagagcaaaaaugacaucuacaugcagccagauuucuuguaaguccugauuaugaacaaaaauggaagauggacauucauaaggaaggugagaggcagugcuaaguuauuuagugacuugcagaauuuacuaagaaucaaccccuaagagauucuucucugugaugaaagaaaaaauaauauuaugcaaaugcagucauaauaaaaguuuaaggguaauuccucugcaggugcuuugccuucauguuggaacucugccauaaacaguggauguggccuucuggguuugauccaaucagucucaaaauccacaaagcuuguggcuguacacauaugcuuuuccacaaaagaaaauuuccuacauuuuuccuuuuucaccccucccagagguacaaagcggaauagaccaaaugggugagugauuacauaaggcaguucuugccuauucaguggggagaaacaagccuaagugguuaugcuuguuuaaacaaguuucauguuuuuaauaaucuaucugccauauuucuggcccaaauuguaagaugucuuaaaauaauuuauaaauuguuuuugcugugaauauucaucauuuuuuaaauauugagaauuuuauuaccacaaagaauuuuucuuuccuuu

SEQ ID NO: 16231 - RNA, 4169 nt, Homo sapiens
gagaguaaaggagggguggugcuagacguuucgggcagagcucggccgcugcggaggacaaggaacucucccucucccacuagucugacuucuuccaaaaugagcggccuggaugggggcaacaagcucccucucgcccaaaccggcggccuggcugcucccgaccaugccucaggagauccggaccgagaccagugccaagggcuccgugaagaaaccgaggcgacacaggugauggcgaacacaggugggggcagccuggagaccguugcggaggggggugcaucccaggauccugucgacuguggccccgcgcuccgcgucccaguugccgggagucgcggcggugcagcgaccaaagccgggcaggaggaugcuccaccuucuacgaaaggucuggaagcagccucugccgccgaggcugcugacagcagccagaaaaauggcugucagcuuggagagccccguggcccugcugggcagaaggcucuagaagccuguggcgcagggggcuuggggucucagaugauaccggggaagaaggccaaggaagugacgacuaaaaaacgcgccaucucggcagcaguggaaaaggagggagaagcaggggcggcgauggaggaaaagaagguagugcagaaggaaaaaaagguggcaggaggggugaaagaggagacacggcccagggccccgaagaucaauaacugcauggacucacuggaggccaucgaucaagaguugucaaacguaaaugcccaggcugacagggccuuccuucagcuugagcgcaaguuuggccgcaugcgaaggcuccacaugcagcgcagaaguuucauuauccagaauaucccagguuucuggguuacugccuuucgaaaccacccccagcugucaccuaugaucaguggccaagaugaagacaugcugagguacaugaucaauuuggagguggaggagcuuaaacaccccagagcaggcugcaaauucaaguucaucuuucagggcaaccccuacuuccgaaaugaggggcuugucaaggaauaugaacgcagauccucuggccggguggugucucuuuccacuccaauccgcuggcaccgaggccaagacccccaggcucauauccacagaaaccgggaagggaacacuaucccuaguuucuucaacugguuuucagaccacagccuucuagaauucgacagaauugcagagauuaucaaaggagaacuguggcccaauccccuacaauacuaccugaugggugaagggccccguagaggaauucgaggcccaccaaggcagccaguggagagcgccagauccuucagguuccagucuggcuaaucucuguccugugagaagcuucugcacaaguuuccuuaccaccuccucuuggaccuaugcuuggccaacagcaugcagucuuccaucugcuuucucuucauacuguggauuaucuuuuccuuugguucuaaaucuucaguaaucgguugcaagauuguuggcuuaccugccugugccauucuuccucugggccuucaugcuuuucugcauuguguuaacauguuucaagugcauggccuucuacggcuucuaugccaagcguaugauacuauagauauaguguaccauacugccuuucuuugcauggcuuggacccuaucugugaccaugcucuucucccaauuuaagugguucuguaccacaaagaaucuugauacauuuucacaaauaacugauugggcuucauacuuuaugcuggcuguguccugauacccauguacuuaugguaagcuauuuggguauuaccacugcaagacaaaacugauaucuuaacccggccaucaacccaaauuggacauuccagacuaccaccaacuggaucccagcugccuuccugggcuugugccauccacccuacugguuaucugauagaacaagcugguggcugaugggugacugcuaggcgugacugagguaauagaugaaaaguguucuauguuaucacauugguuuuccuguaccuuugguuacucuacgucaugaccagcugcuggugaguaugaagccugugcuauagcccaccccuacucacucucaccuucugguugaacuuugcuuaggccaccauugucugccucaucaggaacuaucuguagacguagcucccagggagcucacagcaacacccccuaccaccaggaugggcaguaauaugugacagagcccaaagcaaggcuggaacgcagucccuuccagcuuagucuuucugacuccuagccaacaaaccauccuuaaugugagcaacuucuuuaggcauuuccucuuuuccccgccugcacccacucugaacaugacaaaaguugccagaguuggggcauugaggaagagauauuucuggaaugugagacuuguuaugccucugucucuuucucucccuccuccuccccucucccucccccucucccucccaucccuuuucuucccuuucacucugaagcaguuuuagcuuauuaacagaaaacaaaacuggcaaagcaggcuuuuuguuuaauuugcucuuucccugauuguguucagagagaaagguuaugauuaaaugggcuccagaucucuuauugcccuuauuccuccaccccacuucuuuuagcaaggucugaaaguuucaaagggagaccuauagguuaauuguuuaguuauaggcaguguuaaauuaggcagauuuugacauauuuaucuuuuuaccccauccauucuaccaaaaccuguguauuucuugaguuuuuaguuugagaagcuggaaagagagagaagggccucacagugauggguucaggacgggucaaaggcaaaggccuuugugaugugagcaaaggcaaccaaaacuuagccucacuccacuuuucuaaagauggaaauucuuuuuugggccuuggacugcuucuaggguagcauuuuguaggucacucuucuccuuuguacuauuuuguuucugcccugaugucccuugggucuccauccuacugccuggcuuucuuggcccucauuucucagcuucugcauuuccuucccugcuccuaacaaaugaagaagcaggcugcagccugcauuguggaagaucuccagccuccuuguaggggauaaggggaugugcagcaucuguguggauuuucacggacaaguuccaguaggugggacagugaugccgucaaggcuuaguuaugaucauguguggugauaaagaccauccaccaucacccuuuuccccuuugguuuugaaggccuugcccuaagcuaccugaggguuuaggaggucugaacacacacaguggagagguuaaucuagguugggaaacugaguaaaaguccagagcaggaaugagccugcuguggcguggguuuggaaaggcucacaggaaagaaccugcaggaucaggggugggaggggaggccccugaggugcucuccagggaagaggggcugggguuuaaauagcaugcuuggaggaagauuuuccuucaauuuuuccuaaguccuugaauucaccaguagauuuuuguaaacaaaauguaagucgauguuuucucucaauuauccuaggagugaccuuuauauguguggaagauuaaugguauaugcuccuuaugucacuguuuuugaguaaaauccauuuccuuucucuguuucagccuaugacaaaauugauguuuacaggccugcuuuuugcuuauaauugacaacaugugcaaaaauaccaaauuuguguccugugcaguaugaagaauucagugaauauucauuaauguauuagcuuguuuugcucucuguucauauauggcucuauucuuagaaauauaauuugaaugugaucuuucaauagucugaauauuuuacaaauuauagcuaugucuugugaaaauaaccucaaaaagaaaaauacgacucuguugucuuacuugauauuucuugcccuaguaauguacuugacauuuauguuccuaagcaguguaaguaccaguagaauuucucugucaaacucaaugaucauuuaguacuuuugucuucucccaugugcuugaaggaaaaauaaagugucacuaccguauuucuuguuuucaucaaaaaauaaaaauaauuuaaaaaauucuguguugucuagguuaauuuaa

SEQ ID NO: 16232 - RNA, 4169 nt, Homo sapiens
uuaaauuaaccuagacaacacagaauuuuuuaaauuauuuuuauuuuuugaugaaaacaagaaauacgguagugacacuuuauuuuuccuucaagcacaugggagaagacaaaaguacuaaaugaucauugaguuugacagagaaauucuacugguacuuacacugcuuaggaacauaaaugucaaguacauuacuagggcaagaaauaucaaguaagacaacagagucguauuuuucuuuuugagguuauuuucacaagacauagcuauaauuuguaaaauauucagacuauugaaagaucacauucaaauuauauuucuaagaauagagccauauaugaacagagagcaaaacaagcuaauacauuaaugaauauucacugaauucuucauacugcacaggacacaaauuugguauuuuugcacauguugucaauuauaagcaaaaagcaggccuguaaacaucaauuuugucauaggcugaaacagagaaaggaaauggauuuuacucaaaaacagugacauaaggagcauauaccauuaaucuuccacacauauaaaggucacuccuaggauaauugagagaaaacaucgacuuacauuuuguuuacaaaaaucuacuggugaauucaaggacuuaggaaaaauugaaggaaaaucuuccuccaagcaugcuauuuaaaccccagccccucuucccuggagagcaccucaggggccuccccucccaccccugauccugcagguucuuuccugugagccuuuccaaacccacgccacagcaggcucauuccugcucuggacuuuuacucaguuucccaaccuagauuaaccucuccacuguguguguucagaccuccuaaacccucagguagcuuagggcaaggccuucaaaaccaaaggggaaaagggugaugguggauggucuuuaucaccacacaugaucauaacuaagccuugacggcaucacugucccaccuacuggaacuuguccgugaaaauccacacagaugcugcacauccccuuauccccuacaaggaggcuggagaucuuccacaaugcaggcugcagccugcuucuucauuuguuaggagcagggaaggaaaugcagaagcugagaaaugagggccaagaaagccaggcaguaggauggagacccaagggacaucagggcagaaacaaaauaguacaaaggagaagagugaccuacaaaaugcuacccuagaagcaguccaaggcccaaaaaagaauuuccaucuuuagaaaaguggagugaggcuaaguuuugguugccuuugcucacaucacaaaggccuuugccuuugacccguccugaacccaucacugugaggcccuucucucucuuuccagcuucucaaacuaaaaacucaagaaauacacagguuuugguagaauggaugggguaaaaagauaaauaugucaaaaucugccuaauuuaacacugccuauaacuaaacaauuaaccuauaggucucccuuugaaacuuucagaccuugcuaaaagaagugggguggaggaauaagggcaauaagagaucuggagcccauuuaaucauaaccuuucucucugaacacaaucagggaaagagcaaauuaaacaaaaagccugcuuugccaguuuuguuuucuguuaauaagcuaaaacugcuucagagugaaagggaagaaaagggaugggagggagagggggagggagaggggaggaggagggagagaaagagacagaggcauaacaagucucacauuccagaaauaucucuuccucaaugccccaacucuggcaacuuuugucauguucagagugggugcaggcggggaaaagaggaaaugccuaaagaaguugcucacauuaaggaugguuuguuggcuaggagucagaaagacuaagcuggaagggacugcguuccagccuugcuuugggcucugucacauauuacugcccauccuggugguaggggguguugcugugagcucccugggagcuacgucuacagauaguuccugaugaggcagacaaugguggccuaagcaaaguucaaccagaaggugagagugaguaggggugggcuauagcacaggcuucauacucaccagcagcuggucaugacguagaguaaccaaagguacaggaaaaccaaugugauaacauagaacacuuuucaucuauuaccucagucacgccuagcagucacccaucagccaccagcuuguucuaucagauaaccaguaggguggauggcacaagcccaggaaggcagcugggauccaguuggugguagucuggaauguccaauuuggguugauggccggguuaagauaucaguuuugucuugcagugguaauacccaaauagcuuaccauaaguacauggguaucaggacacagccagcauaaaguaugaagcccaaucaguuauuugugaaaauguaucaagauucuuugugguacagaaccacuuaaauugggagaagagcauggucacagauaggguccaagccaugcaaagaaaggcaguaugguacacuauaucuauaguaucauacgcuuggcauagaagccguagaaggccaugcacuugaaacauguuaacacaaugcagaaaagcaugaaggcccagaggaagaauggcacaggcagguaagccaacaaucuugcaaccgauuacugaagauuuagaaccaaaggaaaagauaauccacaguaugaagagaaagcagauggaagacugcaugcuguuggccaagcauagguccaagaggaggugguaaggaaacuugugcagaagcuucucacaggacagagauuagccagacuggaaccugaaggaucuggcgcucuccacuggcugccuuggugggccucgaauuccucuacggggcccuucacccaucagguaguauuguaggggauugggccacaguucuccuuugauaaucucugcaauucugucgaauucuagaaggcuguggucugaaaaccaguugaagaaacuagggauaguguucccuucccgguuucuguggauaugagccugggggucuuggccucggugccagcggauuggaguggaaagagacaccacccggccagaggaucugcguucauauuccuugacaagccccucauuucggaaguagggguugcccugaaagaugaacuugaauuugcagccugcucugggguguuuaagcuccuccaccuccaaauugaucauguaccucagcaugucuucaucuuggccacugaucauaggugacagcugggggugguuucgaaaggcaguaacccagaaaccugggauauucuggauaaugaaacuucugcgcugcauguggagccuucgcaugcggccaaacuugcgcucaagcugaaggaaggcccugucagccugggcauuuacguuugacaacucuugaucgauggccuccagugaguccaugcaguuauugaucuucggggcccugggccgugucuccucuuucaccccuccugccaccuuuuuuuccuucugcacuaccuucuuuuccuccaucgccgccccugcuucucccuccuuuuccacugcugccgagauggcgcguuuuuuagucgucacuuccuuggccuucuuccccgguaucaucugagaccccaagcccccugcgccacaggcuucuagagccuucugcccagcagggccacggggcucuccaagcugacagccauuuuucuggcugcugucagcagccucggcggcagaggcugcuuccagaccuuucguagaagguggagcauccuccugcccggcuuuggucgcugcaccgccgcgacucccggcaacugggacgcggagcgcggggccacagucgacaggauccugggaugcaccccccuccgcaacggucuccaggcugcccccaccuguguucgccaucaccugugucgccucgguuucuucacggagcccuuggcacuggucucgguccggaucuccugaggcauggucgggagcagccaggccgccgguuugggcgagagggagcuuguugcccccauccaggccgcucauuuuggaagaagucagacuagugggagagggagaguuccuuguccuccgcagcggccgagcucugcccgaaacgucuagcaccaccccuccuuuacucuc

SEQ ID NO: 16233 - RNA, 1566 nt, Homo sapiens
auuugcccucuagcacuuucacuauugugagaaccucucuggguuaacuggcuuauccaaggaggaggaugagagauauguagagcaaaacuaaacugccccaguggaguccagccuaauccccagcugaccucauccacagaagcaaaccagcuaagaucaucauaacuccucagccuaucccagccuagauuagcccacuccaaguggcccacagacccaugagcuagauaaaugcauauuauuguauguugcggagauuuuguguuuauuauccuggcuuuauucaaaauaccuaaaugaugcagaagugaaaucaucagaacugaacugaguggacaguauaggagaucucagcaucauacuuaaaauucucccuuucucugacuucuuaaauaaaauauuuuuggccaccaugacacauaugagaacuagggaagauacucuagcaagagcuggacaaauucaaccuacaaguauaacucauugguuaucauggggguuuuuaaaguaagcagcagcagggauucuaggacuuaaguggaauugaauagcacagcacaguucuuaauuuuccaagcaagugcuggauuuguuaaauccagauguagguguuccuagauuuuguuuuuguuguuguuguuguugagggaaagcuguugacauauguccccaauucuuuaccucuuccaguauccauguccacugcuaugugccuuuuaguuugacccaauaagaaggugggaugucuuucucuaccccuuuucuuuguauuugaccaugugacuuguguuguucaacucccagguuugucuuauuacacugacuacugaagaggguacuggcuuugcccacuugggucaucccccuaugcuguccccaauacacuccuaggaggguccuucuacugccugauucuuugggcuuuugugaugccaaauuagaauagugagaaugcgauagaaguggaauuauagguagaauaguagaggguaagaugaggagaauacuauccuuuuguagaagacagaaaagcuccaacagggacagaggagucugugaaagaguuuuaagugagaggacucagauaaagugagguuauagagagcagggauagagaaggaaagaagguuuuaacaaacguuucugcagguuuugcuaucugaauucccuuuacaagacuggaaacuguagguagaaaacuugaguuaauuuaauucacuauuauuuuuuagcaauaccaucucucuuagauugguguuuguggaucgcagcuuuaugguaaugauuuuguacaaauaaauuuaauauggaaugaagugauggcaugguggcuagaguggacagaauguucaggaccuauaagguuauucacugcccauaucacuuacuagcuguguaauuggacaguuaacuaaaccauucugaggcucauuuucuucauuuauaccauggagaaaauaauguauuucauagguucuucucaggauuaaauaauacgguggauguuaaaauaucuagcucauuuuuagacauaaauguuaggugaaauauuugagcacgaug

SEQ ID NO: 16234 - RNA, 30431 nt, Homo sapiens
ucgcgaguuggugccgcugccaccuccgauuccgagcuuucggcaccucugccgggugguaccgagccuucccggcgcccccuccucuccucccaccggccugcccuuccccgcgggacuaucgcccccacguuucccucagcccuuuucucucccggccgagccgcggcggcagcagcagcagcagcagcagcaggaggaggagcccgguggcggcgguggccggggagcccauggcguacagucaaggaggcggcaaaaaaaaagucugcuacuacuacgacggugagcggccgggccggugucggggugggcgcgcggggccgggcgcuggguuccgcggcugccgucgcgagugggcgccggggcugaggggugggaaggaggagggaccgacauuuggccgcaucuuaacccguucccggcccggcacaguuagaacgagacccucuuccuggcgcagcccccgcgguuccugcgggcgggaaucagggggcccgcccgucuugucuccugccucucccccuucggccgugcaguccgcagccucgaagguggccgccgcuggggacggcgccggccuaccccgccuuggugguggcggcggcgaagggggcggcccauucucucccuucucccgcccaccauucguggcaacgcagguuuggggugccccgcgucggccuccuacccccucgacccgucccccgcgaggcaaaauuucuaucccggccuugacucuacacaaagccccgcggccgcgagagcuccgccccucccguccccuucccuccuccucgccugcucgccuccccuacccugcguucggucuggccggagcgucuucuccuuccucggcuuacccuuuccccggaccccuccucccggugggcgcuggagaguaguuacugagggugggggcucaggucgcguguggcuuuaucacacccauguuuugcgugggcuccaacccucuccuuuguucgcuggguucuuugagcgcgucuuucucaggauucaaauggaagggcuucacuuccucaauaauaguucggguuuuccaguuucaggcagaaagacuucguaggaaauaagaggugguagggagauguggaacugcuacugcuuguguuguagaucagacuccauggguccuggcuugccucagagaggugguuaccacccacuucuuuguugcucuuuguucgaucaggaaauagacccugcuuuggggauuuagagagcauugguaucuugcaaaggcuguuccuaggugguggggaauccugguaugggaaaacuuugagaagugggagaagugcagaaguacuaaauauucuaaugagguaaauuugaggucaccguguagugaauuauaaaagucagauaauuuaauuaucuuaagcauucuauaauuuggaguaugagcaguaacauuaaaucuucgaauccuguuuccuguguuuucuugcucaauggaguaguaaccuguuauacagauuucacaaaggcuugguaaauaguuuauaguagguuacucuugagagaagggauuccaaaauuuaacagagaaucuauccuaggcuccuucuccugaaaguccugucugauuuguaggaagcaauacaaauuuuggaagcuguuuccuacaugugguguauuguaaaucacaaaauuuuagagaaguaagaccccagagcaccagcucagaauaaaucuacuuuaacuuguaaaugaccguacugucucuuuuuaguuaaaaaggauuaaucuuuuaaugacugauacauauaaaauaaccaccugugucauuuggggaaaaucugaaaucuuacagaacaaaucuaaauugaucugcgauagcuaggacagaauaauaacagcccuacuuuuaaaaaugauuuuucagaggacuagauaugcauuauauaaguugauuugaaauuaugccaucguggagggguggagauggaaauacauuuuaauuucaacaugauuuacauugcauauuuuggguuauucuugcccugcauucccugaucaaauuggaaaggaaguaacccugcguauaaguuaauuuguaaaauuacauuguuucuaaaguuuagagauuuauccuugucagggcuuggaguaaagaggaaaauuuugguuagggaaagugguacugagguccuucucgaagcugucaguugguguugguagugaugggcucugaggaaguaagcugcuuguaauuuguugucaccacaauggaacccuagaaccaggaggguacacuugaguagcaguuucugaacagcgcucuuguccugggcccauuuaugauaaccuucguugugggaaugggagcaggcacggguacccgggaaaggaugcaagcuugauaaguaggguggaaauauuugucuugugauugugacuuaauaugauacuuuauuguagcccauucaccugcuuacgugauggccagcaacaagugaauagcugauaguuuggaaaucucugguggguuauuuugucuuuugucugugacucguuuguuaaaguggaguuccuaguugcuuauguuucacauacucuuuuaauuuuugugggagggaauuaaaauauuuugcagagauuauuaauguuuauauuaugcuaauuauuaauaugugauagugugcugaccucauccaaaaacuuauauuuuuauuaccagagaacauuguuuugucagcuuacaaaaguagcaauacuaauucuuuuuuuauugugagaagagaaugcaaggaaaggagcuucuguaucaaagaaucgugacuuuaagguauauaacauggauuggauugggaauggguuauaucuguaguaauagggucugaauuaucugcuagccuagguuagaugguuuuaacuucuugguaaaggaaguagaaggaagaaagugagugaaaaagaaaaggacggaaguagcaaauucuauaaccauaggaauccuaccuuuaggcuuccuggggcuguuaggcacacggagccucuuggccacacagaaugucugccacugaggcuguuugcaucuuaaugaaagaacuuuuaaauauauacauauuguucucugcacguuauguaaucuucagguaacccuuuaggucacugaaacguuggucccaagggaaccuucagacauugauggauuagguauccuuaaaccuuugaagaaaaguaagagaaguuauuacuucucugacuguagcuauugauccaugccuccaaauucccaaaaacauacuucugaaucauguuccuucuuuauacacuagaagaucaucaagaaucuguaaaaugauacagcuaauuagauagucacuaagaucccuucugggccuuaaaacgaugugauuuuucucuacuuaaauauaauuagcagcuaagcuguguuaggcucuaguuauaccacucacauuuuuaauacuguaucuagacauguuuaugcuuuguuuugaauuaaucuugaggccaaacauauuuagugcuuguuuuuaugguguauacaguauaauaggguuuauauaccuaauuuauguaacuauacacaaauuucucugugcucuauuuuuuccuccucugagagggaugcauaaucaguuuuggagacaagugguccagaaaaaaacacucaaagacuguauacagauaaaacuauauaaauacaaaaguuaucaagauuaggccaggugugguggcucaugccuauaaucucagcacuuugggagacugaggcaggcaaaucaccugaggucgggaguuugagaagagccuggccaacauggcgaaaccccgucucuacuaaaaauacaaaaauuagccaggcgugguggcaggcaccaguagucccaguuacucgggaggcugaggcaggagaauggcuugaacccaggaggugcagguugcagugagccaagauagugccaugggcaacaagagcgaaacuccgucucaaaaaaaaaaguuaccaagaugauaccucccaacguacuccuucuucagcaaauuauagaaauucuacuuggcagccaacgauugucagauuuucuuagacuuguauuuaugaguaguaccaaagucuuuugcugaauaaccuuuaauacaacuacauggguucuuagcugugguauaaaucuuuauuauccgugaaauagguaauaauuucuuuggaggcaaauaagugcuaaauuaauuauagcagcaguucauaaauaccaguaauacuaauugcacaauaaaacaugacuaaauaagacugaaauuuuccuauacuucucuuuccccagaaaucuuuugccucucuuuucuuucaaauuuuaccucaucagagaugcuuucuccuauuaccuaagucccuguuauugccuuauuuuucuuccuuuugguuguaccauauaacuuuugucucucuccucacuauaacauaagcuucauuaggacagucugucuguuuugcuuguguuuguaucuucgccaacuacauuuaaaaacguagcuuuuuuuuuuaauuagugaugaauaaauuauuaauuccuuauacuuuuuuuuuuuuuuugagauggaauuuugcucuuauugcccaggcuggagugcaguggcgugaucccagcucacugcaaccuccacuacccucccggguucaagugauucucuugccucagccucccaaguaguugagauuacaggcacgugccaccaccccuggcuaauuuuuguauuuuuuaguagagauggggguuuuaccauguuggccaggcuggucucgaacuccugaccuggggugauccacccaccucagccucccuaagugcugggauuacaggcgugagccacugugccuggccaauuccuuauucuuauagauagaacgcuuucauauaacguucccucuaauucuugaaacuacucugaacuacauuuagguaggauggguggcauuuuggcauuuuugguauuguuuagaugaaaacagauucacauuuguuuggugcagucuaccacuuuuccuuuuccacacugacuguaguuuuaauguucaaggagaguucaacauccggaaucuuuauuuuucuuuuuuccuuuucaaaguguuuccucugcuaccaaacaaacaaaacuccuuaacaaaaacuuuaaaugcuucuguugacaaguccuuaaaggaaaacacuugggauuggagaaggcaucucuuagggaauguuaauaaauucaaacuuggaagaauucaaaucaagucuaaggauuuuuuuguacugguuauuaagccuuauuccucuguauuucaguagcagucugcuuauuguuacuuguucauuaagccagcuuuggguucagacauaucaaauaggcuuaaaguuccuacugugugccaaauagacaaaagauugcucaaguccuaagaaggaaauaaaagacugcagguauaaaguaagagagggggccgggugcaguggcucacgccuauaaucccagcacuuugggaagccgaggcgggcagaucacaaggucaggaguuugagaccagccuggccaacauggcgaaacccucucucuacuaaaaauacaaaaaaaaguuagcugggcauggugacgggugccuguaaucccagcuacuugggaggcugaggcaggagaaucgcuugaacccgggaggcagagagguugcagugagccgagaucaugccauugcacuccagccuggguggguggcaagagcaagacucugucucaaaaaaaaaaacaaaaaaaguaaaagagaggggaccuuugauaguguaaucagaaaagggaagaccugaaggaagagaaugggccagccuuaaaaagaguuuacuacauaagauauuacaaauagcaaagccagauaguuauuaauagaacuuggugcacuuaaugggaaggaagacaaggaaaauguggagucccauguuaggcaguaaaaagugggacugcacaaaacuguguaguaagaaauuugacuuuacccagagguggaaagccauugaaaguuucucaaauagaaugcauucucucaaaauaauugguaaggaguuguggaauauaggcuggaagcaagaauugaacacauauugguccauauaaaauguaaugguugcauuuuagauagaaauagacauauuuaagagagauuugggccucaaaccaauagaacuuuuugauggauuagaaauggaguuggagcugaggaaugguguuagagaaugaaggaugacuccuaaguuucuggauugagcaguuaggugguaugugguacuacucacuaagauugggaauacaaauaaagagcucuguuuugaacaucuuauauuugagauccuuauugaauucaagugaaaagacugagaagagaguuaaccucugugaguuuauaauccagagaggagagucuagacauagaaauuugggauuucucagcuuauaucaggugaaguauugagacugaaaaagauacagcauagacagacgacuggucccaggacuuaacucccgagagaagagaauuuagggcagaacuauuguucacugaugaacccaaacccuuagaacaguaccugcuuggcacaugguaggcucuugauuuauuaaaugaauggcugaacugaaaacccuugauguuuaaagguugguggaggaguggccuugggguacaaguaaaaucccaagaaaaugguauuauggaagccaaggcuccgaaugucucaaggaggaauaaccuccuugaaauauguauuaaagauguguuaauauguauaaaaaauggauagugggcuaaguagucuggaagaugaaaauaauaaacuuuuuucuuuucucuuguuuuuuuuuuccugagucucuuuuugcagucaacuuaucuuuguggcuaaagguacauuucacaguucugaaauccaaaaugaccugaaaauugaaaaaaauuuugguaacucauuuggaaucaaaaucuuaaccugaaucaaugugaggcuauuuaugaucuuuauuccucugugaauaccgugaauauucacacuuuuuugcuguagaaauauuaauguuugauuauaucaugccacccaaacucuaggcuauuacauaauauauggcagguguaccauauuaucucuacaaaaucugaaaaaguguaaaauuugaaacauaucuaauuugaaggaauauggauaagagauuguggaccuuaguagacacuuccauucuguuaguuucuugaagagugagcaauuuguaaaauuuugcagauaaauaauucuuuacaguaauuucuuugcauugacaauuaaaguuuguuguguucaaggaaccaccuugagcugauuuuucugaauguuuauuucauugguaaaguauuuuuauguacagguugaauauccuuuaucugaauucuugggaccagaaguauuucagauuuggggagguuuugcaauauuuguaauuauuuaccaguuagcaucccuaauucgaaaaucaaaaauuugacaugcuccaguuagcauuuccuugacuauuaaguuggugcucaaaacaguucagauuuuggaacauuuuggauaucaaauuuuuggauuagggauaaucuguauuuugaugcaaaucaguaacauuuaaaaugcccaaauuauuaauacauuacugaccauuuaaaugaugaauaaaaauuguagggucuuaaaacuucuuagccuuuuuauacuuuaugaaaaagugggcugggcacaguggcucacaucuguaaucccagcacuuugggaggcugaggcgggcagaucaucugaggucaggaguuugagacaagccuggcaaauauggagauaccccgucacuacuaaaaauacaaaaauuagccggguaugguggugggcgcuuguaaucccagcuacuugggaggcugaggcaggagaauugcuugaaccccagagguggagguugcagugagccaagaucacaucaccgcacuccagccugggugacaagagcgaaacuccaucucaaaaagaaaacaaaguggaugccuacaaaguagccaucuagagaauugugagauacagaauuagugggaaaaaguuggagaugguuauuuuauaacgccuuuauauuuuagaagaauucuuuuuuuuuuuuuuuuuugauacagagucucgcucugucacccaggcuggagugcaguggcacgaucucggcucacugcaaccuccgccuccuggguucaagugauucuccugccucagccuccugagcagcugggacuacaggcgcaugccaccacaccuggcuuuuuuuuuuguauuuuuaguagagacgggguuucacaauguuugucaggaaggucucgaucucuugacuucgugaucugcccgccucggccucccgaaguacugggauuacgggugugagccuccacgcccagcuagaagaauucuugguaaaccaaaaaauuaucuguagcuuggcugcccuguauacauguaucauuuagguucuuuguguauucuuugugggacuggggucccuaaauuucaacagagaaacuuguugaaagcuaugcguauucguauacgauuugaggacccuauuaguaaaaaguaaauuacucugauauauuagguacaguuucuuguguucauuuucuuuaaauuaaccaagacccuaagccuuuauuuaaaauauuuauauuucauauuaugucuuuuuuucagccuucacccugccauuucuagugaaucuguaaguguccuugacauucccuguuguuauuacuuaagaacauuagcugugagcugcccugccagaguuugaaucuagcuccuccacuugcuggcuaugugacuuaggcaauaauaccugacuugucuguuucucauccuucuuuacuauuauacaauaggaauaauguaauaauacccacaucauaagguuauugacaagauuaaaagauaugugaaguacuuaauagugccuucuaguaagcacucaacaaguguuaauuacugcuuuuuuuuuuuuucaaacacacuugcucagaaauugcuacuguagucuccaauuauuggggccuggggcuuuucacuggauuuucagugugcaucaaauaacuagaguauuugauguuaugaugugguagauguuagagacauuucauuuggguaauuguuacacagaggcagauagauggaaguuauuguuuaguuugugucuuuucuguuuuaggugauauuggaaauuauuaugggcagggucaucccacgaaaccucauagaaucugcauuucuagugaagacuagacuuucauuauuuuuacuuuaaugauuucuuuaguagugauaacuaagaaaugccuucccuuguauuaauuuaauuacaugaugcuuuguaauaacacuaguggguuuuccauaucuaagaaaugaugagaccaggcugcuuucaaggaacuauauaucccuuguauugucaccauguaagguagagcuuuaugguagauucuuucuuaauagguaguuuauuuucugcaaucauagccucuuaauuauaauugcagaggaauguugcaaagggccauggcccugcuuugcuaaacucuauauuguuucuuagccuuguuggcaccugcauuaaaaagguggcuuucccuuuaaaagacuuuguauaugaauuguuuucagaagagagcugugcugaaaaugaaguuaacuaaaauuagaggugugauaccaacaaaaucaaguauuuauguuauuagaagcauggauuuuguaaaagcugauuguuuaucccguacuguuaucaaauauguaggagagaggacaaaaaaguuuuugggguuguuuccauuaaacaaacaaaagguguauuuagggaggacuuugaaagauuuaguggauaaauugcauuuuuuauucuagcuuuuauuguaauauauaaacccguguugaaaugauagacuucaaaccauuaaaauagcuugacuguccugacccuguggggaauuaguuccaagacuuccacagauagcaaaauucauggguguuuaaguuccuucaauaaacugguauaguauuugcauauaaccuauguauaucuccccuuacacuuuaagucaucucuagauuacucauaauaccuaauacaaugcaaaugcaguguaaauaguuguuacacuguaugauuuaggggaagauuacaaggaaaaaaagucucuacguguuuccagcagacaccaccaucuauuuuuuaaaaauauuuucagucugcaguugauugaauccacagauacagaggguugacuuuauauauuugagaggcuucuuguuauuuacuauuauaggaaacacuggagcuuuaccuaaaaguauuaauuuuauugaaauuuaguugaugaaaaucugugauuuuguuauuuucucuuuuuuaaaucuuaugcauaaguuuaaagacauugugauauaagaugccguuuaaaaagacaggcuaggaauuacaacuuuuuagucaugaagaaugagacaguauuuuuauuaccuugaaaaauguaaugcugugucuuaguggagcaaaaccucauuuaggaccuaaauuucaguuaccaaaacuucccugaugggcuuuaauauggacacgguauguuuuaacaugcaaaacgccaauuaugagauuucugaaaugccagcaaaucauccaaaaagcaguauuugcugaaaaaauuuuaaaucauaccaauaaaacucagagaacuuaaaagcaugugaauuugccagagaauacagaaagcaggcaucauuucaaggaacagaaauuuuaaaaauuggggguagcuaaaaaucagaaaagcuugcuuuccuuaaucuacaaauaaauauaauguguaauaauggagucuucagcugguaaaagugugcguagcgucuuagucaucugauacaguuugaaaguugcaaaauaaaucuaaguugcuaagguuuuaaauaaauuuuguuaaguaguaaaugccuucuaaugauagacauacauaaauucaaauaguucauggagggucucuugucuguauuguuuaguuugugucuuuucuauuuuaggugauauuggaaauuauuauuauggacagggucaucccaugaagccucauagaauccgcaugacccauaacuugcuguuaaauuauggcuuauacagaaaaauggaaauauaugugaguauuccuuuuaauacauauucagcacugaucuuuuuuauuuuuuuuuagcuacugugaaacuuugucuauuauuccccuuuugagggcauuuagcagaugaaaagaucuggaagaaaacaaacuucuuuuuucguuuauucuuaggagaugaauaagaaugagagcuauacccucuuuuuccuuuuccuuuaaccauuuaaaaaaguucccccuacccuaggcuuucaugguucuggagaacaacucaguauagcaacaacucaguguagcauauuaaguauuuuuuuuuuuuuuuuuuuuuuuacaauaauuguuaaucugccugugcugcugaaaagaguugaccugggacuguuacaaaauaauaacacauaaaauuaaucccacaaauauuugcagggcauauaauacauauggaauacuguguuaguguggccaagcauaguacagauaacacaagugcaacagcugccuuaauguuuuuguagauaaagaugaggguauguauaaacaaauacagacacgacaauuagcuauuuggggagaaaagaaauauuuaaaacaauuaaugcuaggcaauauaugugaauaugugaauuauuuucaguuacauguagacauuuagagaagaggggaaguuagaauaagacucagucuggaagucuuguggaagaauugugucauacgugaaauugagcucuucggaacaaggaagauuaggauagaaaaaaggacgagaggucgugaacaaagauuuagaauugaaaacucuuguagugagugauuucauugaugaaaucacuggauguuuuaucauggaaaaggagagaaaguagaguuuaugaacauauggauuugacuuuuuacucgaacuguuuccacuaaaauaaggagugauuaaaucauaguugauaugccuguguaaugcuuuuaaaggaguuugaauuaguuuugagauugauuacuguuuucuaaaacacauauaaguuuggguuaguuuuggaauuuauauauuuuguucugguagacuugguucuuuugaggggaccgauaggggaauuuguauauuuguuugauaauacugauauaaccgguuguaauuccacaguucugacauuuauuucucuucacagaggccccauaaagccacugccgaagaaaugacaaaauaucacagugaugaguauaucaaauuucuacggucaauaagaccagauaacaugucugaguauaguaagcagaugcagagauguacguuucuaaguaaaaaguaguuuugcuuugauaaauguaaauuaguauuuuuaggagcuuagaaugaucuaaaucugaauauuuuuccuguuggucuaauauguuacaguuauuuacugauuugaaaagucauuuuaacacuacuaaagcuacuuaagaaaaaaguaaaccuaucugaagcuuauugguuugcaaaacugcuguuuggguauucuucuacuccuaguuugcuccccugauaacuuuggguuaauacauauugguagggagaccucacucccuuacucccucgcuucaaaaaaacaaaaacaagauuacacuuugauuagccuuagcuuggcauguacauaucucuugucuugucuuuguguacuucaguuaaccuggacuauaauacacaucucuuuuucuuuguuaagauauuagugaagcuuuugauucuacguaauguucucuuguacagguuaaaaguauuuuauuuuuagagauuaguaacaaauuggcuugaagguagaaugcaaaagucaaccuaaaauuauuggaacaguaucuuuuaaagcuugauaccaaaguucauucucauuaguguuuguauugacugacuucagugaugauuauacuaaauuaguguaggugcuagacaucucauauuuacaaccucauacacauuucugccauaucuuguuugauuuguuauaaugcuacaauguaacuagaacauguaguauuuaauuuuuuuuuuuucaaugaagauuccaacuuagaugcaaaagaggcaugaguagcccuugggcaaacaacauaacaggauugauuuaaaacccacauaauaaugaguucuauuaagcuuaugauccuggccaggugugguggcucacgccuguaaucccagcacuuugggaggcggaggugaguggauuaccugaggucaggaguucgaaaccagccuggccaacauggcaaaacccugucucuauuaaaaaaguacagaaaauuagcugggugugguggugcgcgccuguaaucccacuacucuguaggcugagacaggagaauugcuugcuugagccccagagguggagguugcagugagccaagcucacgccauugcacuccagccugggcgacagagugagacucugucuccaaaaaaaaaaaaagauuaugaucucucugugcaguaagaaacuaaaauucauuucuuauagugcuugugacuuaaggguauacaaagauauuaauauacaaaacaaggacccuuauucuugaagagguuacaauucaagggcauagggaaagacuaagaaaggguuacauacaucugccauauccuuucauucucucagugcuaaggaacuaaaugugugaucguuuaucuguaaauguuuuccuuguugucuuuaguauccuauguuuuggcucccaugaaccuaguuaauucuuagcaacuuucaagaucaagauuagccaugggaauaggcaaccagcuguuacaucuuuuugguuuaguaacuuacugacaugcauuucaaaguuacagauauuauagguauuuaaggaguuucaaagaaaguaaauuauaaagcaauugaaguugcuuuuagaauguuaacuuauuguaauauuaaggggaaaggccuagaaaauuuaagccuguguuuuaauuaaauaagaauuguuguacuuagacaacuauugaguucuuguuaauagacagaaauauuccacagauaauccugauaagauuugaugaucuuucacagauaacacuuuaauuaccuuggauaaaacaauaaauauauuuuaaaguuggaaacuuuauauuauacugugaaguguauguuugaugauugcaucaagcaaaaaaguauuugugggaaauaguuuuuguaagaaaaggcuuucauuaauuugcagaauguguugaaauuaaugaaauccaucuuccacaguuaauguuggagaagauuguccaguguuugauggacucuuugaguuuugucagcucucaacuggcgguucaguugguaagugcuaaugcaaucagauuuaaaaguugaucugaacuugguguguuaucuuucggguuauuuguguaaaacagaaguuuuaaugauugugaauuuugauaacaaaaggaaaucaguauguuuauaguaaaguacaauuuacuuucaaaccucuauguuuuaugauuaugacuuaaacgcuuuuuaaacuuauuuucacuuggagacuucauucauucccuuugucuucuagguaucauuguuacuaccacuuuccacauaaaccauuauuuaaucucagguugcagcucuaggagaauauuuuucuaaggaguaacuccuauuuguguuauagaugauuucuguuaacuuucaugauuuuaagcucuugcuuaugcauggcauacacuuguaguguuuuugucucauucuacuacuuuuuuaugauaaauguuuaaaaggucuaucuuguuucuacuucuuagcuggagcugugaaguuaaaccgacaacagacugauauggcuguuaauugggcuggaggauuacaucaugcuaagaaaucagaagcaucaggauucuguuacguuaaugauauugugcuugccauccuugaauuacuaaaguauguuaauuuauauugauacucuuuucagugauaaaguguuuucauuaaaacacaauaaauaaagucuauggcuuuaaaaaauauuagguaaaccauagguugaaauaguuaauggugaauuuucuaugaauucauuacaaaacaaugaagaaaugcaggaaauuugcccaauucuucaauuauuaagacuuagaaguguggccaggcacuauggcccaggccuguaaucccuccacuuugggaggcugaggugggcggaucucuugagcccaggaguuugagaccaggcuaggcaacauggcaaaaccccaucucuacagaaaaaaaauuagccagaugugguggcaugcaucuguagucccaacuacccaggaggcugaggugggaguaccugagcccaggaaguugagucugcaggaagccauguuccugccacuacacucuagccugggcaacagugugagacccugccuuaaaaaaagaauuagaaguguauaaaaggccagugccguggcucaugccuguaaucccagcacuuugggaggacgagguggguggauuaugaggucagggguuugagaccagccugaccaacauggugaaaccccauccuacuaaaaauagaaaaauuagccgggcgugguggcgugcgccuguaaucccagcuacucaggaggcugaggugggagaauugcuugaaccugggagguggagguugcagugagccgagauggcaccacugcaguccagccugggcuacagagugagacuccaucucaaaaaaaaaaaagaauuagaaguguauauaaaugucaaaacucccauuaaauacccuuuuuuaaaaguaguuuggcaauuuucauuuuaguuaguuucaacuaguaaaaaaugacaaugaccuuggaaguuuauauucuaguauuuuggauguuuuaaacugaagacaaaaauuugaagccaguguuaaaggaaauuuuuuuaccuauugaguuagucuaacugccuaacuuccauaucugaaugaggcuuuguucucuacugauggauauaaaauuaucucugaguuguugaaggaguuauuuuuccuuaucuguggcugcaguuugagagagagaucuauagagguacuuaggaauuuggauguucgcaauguuaguuauuuuuugccaucaguuaugacacaucuuagcagauucuacuuuguauuauacugagcuaguguuuuuugcuuguaguuauuccaugcaugcuauccauagaggcugacuuuucagucaacuuaaaauugauacugacuccucaaauaaacagugauugagcaguaucaguguaacaucuugccugcucaucaggagcaaaggaaaaucauuugcaaucauuugccuuguuuuuuaauugacuguugauguugguuccagugucuucaacucuuugagcaaguucuugcccacucagcuaauaguuuuaaacaacuuuaauuugucuggacacauuuuuuugggugguguaaucaaacaugauuuaauuaauugacuuggugcacagcuuuccuugcuuaucuaacacgugagccgcucagaaacuuuauuuugaucacagccucauuucuguuuuuuuaauuuugugaagaaauuuugcuguacuaugguaugcuguuuauaguguuaugagaauauucuuaugagugcuuagucuggaaauaucaauuuacauuguauuguuuuauuuagcacaguuauggcaccauuauauaauaaauacaaugcuuugccaucuaauaauaucucacuucacuauacuucaaaaggaugacaugagaaguccauuuuccccuuauuuugacaugaguauacacugguaacaaaaugucaugacauggugauucaugugacuccuaaacugcguuugaguuacaacugugucacuaaucuguggugcuccaagcaccaguuugaagucaugagaguaccacauguagccucugucacagcuaaucgauucugcaguucaaaugaagccauagguaauaaacaauugagcauggcugucuuucaguaaaacuuuuuuuauggacacugaaauuugaauuuuguauaauuaucacacgucagaaaauacucuuguuuugguuuuguuuuuaaaccauuuaaaaaauaauaaaaacuucuuaguucaaagcugaaaaaagaggcaauuggccaaauuugggccaugggccauaguuagccaaucccuauuuuauacuauugaagauuuacuacagagguguuuuaauuaacaaucuugaguaugguauaaucuucaguuuuuaauauauuagaaauaugugcuauguuuuugaagcauguagaauagaacagauuucacaaagaguaaauauauauuuuuuaaccuacauugggccacaaguggguauuuaaaggccugaggcucaaaccucagauauuugaauaaccucuuaggcugaauguaaaaggugauuaaacauucuggaaugcaagagcucaaaaauggguuuccugaauuuguggugcuucuucccaucuuagaaccuuuaaaggaaaaaccaaaacuuauggauuuguuuucagguaucaucagagagucuuauauauugauauagauauucaucauggugaugguguugaagaagcuuuuuauacaacagaucguguaaugacgguaucauuccauaaauauggggaauacuuuccuggcacaggagacuugaggguaagacuaaauucugucugaaaaaauauugugagaugaaccuaggagaucaguaauccuauacuugaaguaguauuuuucuccugaguuaauaauuugaaacuuguaugcagaauugaauuacuacguaugcaguaacauuugcuagaauucacuguugcugacuauaagcaaaaauuuagugaaaacuuaaggacaguuuuuuucucagcuguuuucuuugguugaauaaauguuuuugaauauccacaaagcaugaagcccuucucuugauguucaguuugaaucuucaaaacuaccugaugguagccuacguugcuauugauuguaaagaaugguggaauaaaauagacuaggucuuuuuagguucuucugcuccucucuuuugugauuggucuugauuuuuaguagaucuaauuuuaaucuuuuuuuuucuuuaagcuucuaaaauugguaauguauuuagguagagaaaggauaccauaguguaaccuugccugccuguuaacauuaaguguauuucuauuuuauuuguuaucuuuuuccauuugaugcucuugucuuuuaugacucugaaaaccacuggucaaauccuauuucuauaaguucauugaagguuuuuugccucacuacacuuuuuuugaaccuaacuauacaaaugucgaaauuuauucaauaauuuaaacagcuguuuuuaguucagccuggauuauaugggagauuuauauggcauugaacaaaguuuuaaacuauuuuauuaagauuauuuuucacaucugugguauaucauuacaguuuagcaaccaaaguuuaaagaguugccauaaaguauucuuaagcuguauggcuuuucuuuauuagaucacagugugauacuuucucaguaaacucuuugaguaaaagaguuaccuuacugaaacuuuuccauacuuacaaaugggugggaggucaaauguuugguuugaguuuaaauuauuuagcuuuuaaaauugcagauuuguaauuucaauuccuugccaguaaacuccuucaauuucucccuuuccccaccuggucuuaucuuacagaccagugcuucucaaacaguggcgccuaaacugaggaaagcagaucagcaucaccugggaacuuguuagaaauacacauucuuagggcccagaaacucugggugauucuucaccuuaaaguuugagaaccacugcuguaaacugauagaauacauuugucaacaaccauuacauccuaguggaagucaagcaaaagucuucucuguuuuaagcuuaaagaauaagacaguaucuuugcagugugaugcuaguuuaucucagaaguggaaaauggaagcuucauuuaauuucugacagguggaugucacuauggucucaucucaguuauuauucaaaauucuuacaguuugaaguuuuugaaaauauuagagaaugcuguuuuagaaggauuugagaauggcuuucaacaucucuuuuucucacuuaagauuuuacaaucgcugggccgggcgcggugucucacgccuguaaucccagcacuuugggaggccgaggugggaggaucacgaggucaggagaucgagaccauccuggcuaacacagugacaccccgucuccacuaaaaauacaaaaaauuagccgggcgugguggugggcgcuuguagucccagcuacuggggaggcugaggcaggagaauggcgugaacccgggaggcggagcuugcugugagccgagaucgcuccacugcacuccagccugggcgacacagcaagacucagccaaaaaaaaaaaaaaaaagauuuuacaguugcugauguuuucaggauaacauuugaauauuuuaagcauguccccauaacuucguaagagaauuaaaaucagucauuacauuauauguacagcuguuuuuggacuuucuguguaauucacguguaucuuuggauguuaauuuaauaaacacuccuuuuucugccugcuaauucauucucaugcugaaaagaaggcuacucugaguuuagcucauuguugaaacuguuugcuuuaauucaaguagucuaguggaagaaagaaagguggcauaguagcaguugcagaaugaaaccuggaagagagaaagcuaugucuaacaagggcagcagcucugaguugccagcuaguuaguagcaguuaggaugagaagugcugaccaacuuuucuguauucugaaaucuuagggucaaaauauauuucaucuguguuuuaacugugcaguaggacuguaaaguuuucacaauacuuuggcuuuuccauauuuguaugguuuguauuuaguuaaucuuaauaaaaacuuagacuucaagaaaaauugggagaggagguguguaauuuugcuugcuuucuccucguuggauguugggucucauaacucuaauauugaggguaaauuuugcuuuuguaaaauuggacugaagcuaagaucauuccaugagagguucagaagaacuugcacaagugcuaguaauccugaaaauucauggaucuucagacauuaucauucaacgcacauaagaauuaggcaccccccccccaccccacucaggcgcaguggcucaugccuguaaucccagcacuuugggaggcugaggcgaguggauuaccugaggucgagaguucgagaccagccugaccaauauggugaaaccccgucucuacuuaaaaugcaaaaaaaauuagcugggugugguggcgugcaccuguagucccagcaacucaggaggccgagacaggagaauuguuugaaccuaggaggcugucuuggcucacuggagugcagugagccgagaucaugccacugcacuccauccugggcgacagagcaggacuugaucucaaaaaacaaaaaaaaacaacaaagaggcacaccccaauccuuugguauugcaguuaaaauacuauuuuguaguaaugucuguacuauacaguaucuucuaggaauacguauacacacacagaaaugcauaugcacaccuacaaaugcauaacauauacaaauaaguaaguauauauaauauauguauauaucauuuaagaguauauguagcuggaaccuuugcgucuuuugagagagauuaaugccuggagugguacucauucaacaaguaggaacaaaauuuguuugaaguccaaguccaauuaagaacaaaucugaggcugggcaccauagcucacgccuguaaucccagcaccuuggggggccgagguggguggaucaccuagguugggaguuugagaccagccuguugaacauggaggaaacccugucucuacuaaagauacaaaauuagccuggcaugguggcacaugccuguaaucccagccacucgguaggcugaggcaggagaauugcuugaaccugggaggcggagguugcagugagcugagaucacgccauugcgccuccagccugggcaacgagcaaaacucugucucaaaaaaaaaaaaagaacaaaucuggugcuuuagucgguagcuguuaaaucuucgagaaagugugggucguucuuucaucauaaguaaacucauaccaacagauugugaaccacaagaaggauucugcagaugauuguccggcagggcuuuuuggcuuaauuuauuuuccacagguuuacucauaaaguugccuugucaucuuaaauauucuauuuaugauggauuuucugguuuaauguaauguaauuucauugccuuuaacuuguguuaaauuucuuuucugucaaaaauaaucacuacagauuaauugaaaaugguucuuguaugcuuuacaagcagucuauaaauauuggagcauauacuuauuuguuguuuauuauuuccuuucucaguuugauuguuccggucucaacuucuaagaugaauucaaaauuggauccuuaauacuuagucuuucagucuuuucaaaauguaguaaacaaaugccaaacuuuuuauuauagaauauucucuaagaucaguuuaauuauguauuuuaggauauuggugcuggaaaaggcaaauacuaugcugucaauuuuccaaugagagaugguauagaugaugagucauaugggcagauauuuaagccuguaaguauuauuguuuucacaauuggaauggaauuucagaauguuauuggagaugcuaacauuuguuaucuuguguguagauuaucucaaaggugauggagauguaucaaccuagugcugugguauuacaguguggugcagacucauuaucuggugauagacuggguuguuucaaucuaacagucaaagguaagcaauucaaagggugguauuuccagaaaaaaaugguuuuucuuccacccaagaacuccccguaaaaguucucauuguaguuucuugccugcuguuuuaacacuguacucugcauuuuucaugggguuuugucuguuguauguaugacuagaguuauucuuguuucauuauggcagauuuauauauacauuuauacaagacuaguuuuuuaagguuuauuguaguuugaacccaaggcagcuauuuuugaaugguuguugacucaguguaaauaaaacaugcauacuuuuuuacuuaauuggauuauuuauuucucauuaaggaagaagaggguuuagcucuccucaccauuuugcccacaacauacuuguacccuucccauaccucuauuuuuacaaaucagaauuugauugugauacuuaguguuuacggcagcaucuuuaaacacuuuucagcuuauccaguuguucuuugcugcauaauuguuccuaaguuucucauuugcuuaguuuucucuccacuuauugcugaacuacuggugucucaguaucuucauguguucagauucauugaauauucugucacuuucaccuucuugaaaaacagccuucucaucuguucauguuuggaugacuaucuuugguagaccuggcaggacacauagcuguucucugcuuuuuuucuguuguauugguucucccugguggcucuguucucuguccuuaauuuuuuucucauguuuugguggagugccuucugaaguagcuuccugauaaaaagugugugggggauuaggagugcugcaguacauacuaaauuuugaucauguguugaaaucagcauaugauugaaggcuaggccaaagcaaaauaucaccauucuggaaugaacuucuaggguguaagaauaaaucugaaauuuuauuuaauaagauauuauaauguauauguagauuagaaaugauuuuuaucaugaguguuuguguaugauuuuagagguuuuuuuccacgugaacuuuuagguagcaaguugacagugugcuuuguauucucuaagauguggagaauucucaaauagaacuuucuccagaacaauugcuggucuuaauggaauuggauaacuaaauacagauauuaaaagcuucuuuauuuaauguuaugauugcuacuauaccagcuauauuagaauuaugguauaaucuguuauucuauguuaaguggaaugauauuaaauuaauugucccuuuguaggucaacagugguugaaccgcaguuucauauuguaacuuaauguguuaauaaccaucuuuugccucaaaauguuuauaaacuuucuaaaaugaucuaccuaauguacucuuaaaaguguauauuaacuaucaguuuuccucuuugacuugaaaguccuuaauguuuuuguacuuaauauuuuuuauaaucauaaacugcagcaguucacucuuagaaaaaaauuuacuuuguauuucagcuaauagaguuucaguugcauaaagcguguaaggauauuuguaauuccaagucuuaaacuucauucugaguuucucugcugccagcuuugauucagcuuuuucagaucugcugaaguuaguuaucucuuuuccaucuccuugcugccaucagcuauguucuuccucuuguauugucucccauucuucauuuuuacaaauuuuggccuuuaaaaaaaucccuuucgagucauuuuugucaaguuuugggaugaaggaaaaguaaacaucuuuguuuagccagcuaucuuuacuuggaagccuguaaguuaacuuuuaguauguuuguuuuuucuuuaaaaauauccaaaugguuuuuaucuguuaaaagaaacuuuucuaguagcaauaauaaaaauugagugcuagaauuauguaaaucacauguugcaacuauugaagaaugcuuaaugaaaauucccacaguauacaguuacaugaagagaacagauaaacuuuguaaaauuaacucugaaauggaaggaaauauagaaaaacgauuuuugaauaaugucauuuuuaggugguuaguuuuuucauugucccuuuuuaauuuuuucccaaauacucuucaguaugcacaaaugucuuuuguaauugaaggauuuucuuuucuucuuuaaagauugaguuaugugccuaacugguaauauuccgagaagggaacuuacuggaaacuuauaaauguuuauugaauuaugacauuuauccacauaaaauauuuacuuuuauguuagguuuacuauuaauauuaaauuucuacacguagaaguugaaguuuuugaaaauuaauagauguuuuuaacucuuaaguuaggaaaacuacucaguaccacuaccuaaaguuaacucaggguuaaacuauguuguuuagcuuuccauaauuauuuuacacauguccauagggaaagaaaagucaauaaaaauuaauuuagaugauacauaauguuuuauuguaacaugaugaauuucaccauguaacccuacaugaacaucuuucuguguuaauaaaauagguguauauucauauuauaaucuuaauauaguuguguacuugacuuuuccaucagggacaccugcuaaaauagcuaguuauaucuuaauuuuuuaauauguauuauuguauaacguguuuggaaaggaguuuuagacuugacauuuuuuacauuuuuauuuguuuuuaaaauauuuagaaaacccauuuugguugaguaacauuugcacuuauuaucuuuuuaaaauuuauuuuucgaacuguugcaguaugcagauuuuguuguuacccaaaucuucuugucuuaggucaugcuaaauguguagaaguuguaaaaacuuuuaacuuaccauuacugaugcuuggaggagguggcuacacaauccguaauguugcucgauguuggacauaugagacugcaguugcccuugauugugagauucccaaugguaaguguucucauuacaauaucuuuauuguaugaacugucaauacagaugcuccucuaauuauguugcaauuagguccugauaaacccaucauaaguugaaaguaugauaaguagaaaauggauauaauacacuuaaccuaccaaacaugacuuagcccagccuacuuuaaacgugcucagaacaguuagguuaggcuucaguuggacaaaauaaucuaauacugagccuguuuuauaaaaauaaaacguugaauauuucauguaauguacugaauacaagacauugaaguugguacaaaaaagccagaaaacuguaagucaagccauugaaagucagagacugucuguauauagaaauagauggaugaaugauuagaguaagugccauucuuuauaaauaggagaacauucacuuuguguucacuuuuaaacauuuucuuaggaaauauuucaccaccuaaaucuggauucugugcaugguuuuuugugaaaacugagcuuguaauauguaacuuuauuuuauuguuuucauuagaguugccauauaaugauuacuuugaguauuuuggaccagacuucaaacugcauauuaguccuucaaacaugacaaaccagaacacuccagaauauauggaaaagauaaaguaagaaaucauugaauuguuuugauaaacauuuuaucuugacaaagauuuaguaugcuuuaaagggccaaguaugaugggucuuuuuaacuuuauuagauauuuuguuuuuuucuaaaggauuugaaacauuaaguuacugauuauucuuuuuuuuuuuuuuuaauuuuuaauuuuuuugucaggaugggauauugcuugguugcccaggcuggucucgaacuccuggcuucaagugauccugucaccucugccucucagaagugcugagcuuacaggcaugagccaccguauucagccauuuaauuucuucaguuaauggaaauaauuuuuuuuauuaguugaaauguauuuuaaaauugcaaggugcacuauaaguuauuuucauugucuggaacauuuuguuaaggcuuugucuccacaagcaaaguagagacauuauaguacauagcauggguuugagucaccucuguaccacaaacaagcuguaugauguuugauaaguucacuugccuuugugcuuauguuuucucaucauugaaauggcaggcuaaaauaaugccuccuuggccagucaagguggcuuaugcuuguaauccuaaugcuuuggaaguccgaggugggaggauagcuuuagaccaguaguuugugaccagccugggccauauagugagaccuugucugcaaaaaauuuaaaaauuagccgggcaugguggcauacacuuguaguccuaacgcgcagaggcugaggcaggaggauugccaggaguuugaggcugcagugagcuaugaucuugccacugcacucuagucugggcaacaaagagagaccuuuuaauauauagguuuagcuagaccaaagaugaaauuuuuugcuaaauauuuucucuugcauguaagaacugcaaagaaauuuaauuuugucuaauaaacuuugcauguguaauuuagacagcguuuguuugaaaauuugcgcauguuaccucaugcaccugguguccagaugcaagcuauuccagaagaugcuguucaugaagacaguggagaugaagauggagaagauccagacaagagaauuucuaguaagauaaugccuuuauuuuuccaauuugucaaaaugauaauugaaauggaagguuuuaguggccuaagaacuucacuauaaagucauguucacgagcacacuguuaauauugucauuuuugccacuuucagagauuuagcuuccugaugucucagaaccugauuugggugucagcaguuucaguuuguauggcuggauauacauauaugauugaaaguuuucaaaaauuagcaacuuuaguauauuuggaaauuaauaagacaucucauuuaucuaaaguagggugaacuaaauaacuaaacaucuguuugauuuuacaacuucucauuacacuuaaugugaugguuagauuguagcauaacaguauguguaaugguauagacugucuaacauauuugguauugguacuuuuuuuuuggucuacuucaccucucagcucugaaauaaaaugcuacuuuuuaaguaaugacauuauucccauccccuauuagaaaaacacacuuuuuuccuuuagaguuucagcauuuuuaaagaaaaagagauucccccaauuuuuauuauguguuuuugagccauuucuucauacaugaaagcaaaguuuucaauauuaaauaaaccauucauuccauucaaauuuuaaaaucauuaggcauguuacccuuuacguuuaaaugugguaacuaacugcuuagugcauuuguaugaguaugcuguaaugauuauaaaaccugugacuguuuuugucaaaauuuauuaaaauauucugugcaguucgagcaucagacaagcggauagcuugugaugaagaauucucagauucugaggaugaaggagaaggaggucgaagaaauguggcugaucauaagaaaggagcaaagaaagcuagaauugaagaagauaagaaagaaacagaggacaaaaaaacaggucagauuuguuucuugguaauuguguuuuaauuguaaauuuuaaaaauugggcugcauuauaauguuuaugcuaucgagaagucaguugcacagguaucaggaggaaguaugcuagguaggugacucuuuuuucuuacauauaagugguacuuagcucuuaaagcuuuuauauaaauguuauuguuccuauuugcuuuaguaauacaggaaaccuuauuuucuugauaacauagguuuaaaauagugaacauugcauugugauauagauugguuaagaaagaggacaaaguaauuaugaaucuauugguagugcauggucagaacugaacuucuaagguaauuuuuagcuaccuaaagcuuauuuaaugggagaaaacacaaagaagaguuacauauccuuagaccaguuuugccauuuugaaaaaggucaaauaauggauuuuguucagaaauugaagaaaacauuaaaaacucugaggaaagcuaggaggggauuugggaccuggguuagggaggaaaaaauacuuugauacauugccuuacuuuaaaacgcuguguuagcuuuaggcaauugaauuugcuaccggaaucuguuaccuuucaucugacuucccagaacacuuacacaugccucugccauuuuauuuaacacaucauauuauagcaccucacaggauuuugucucccuacuagacugagcugcucauggcuagggaacacaguaucuuaaauauuuguauucucagcacuugaugcauuuccuaaugcaaguaauggugaugagcacacguuuuaguuaaccuguuaauuuugauccuguaguaugugaaaaacugauuuagagauaaugauccaauuuuuccuaugucuaucaaauugaaguuaugugaauaagccagcuuuuuuuuuuuuuuuuaaacuagagaguuaguaaucuauaacaucugacacauuuaguucuguucuuuuacuuguggauucacuccucaauaggcuacauacagaaauuuauaauuuuaacuucccaauguauuacaaugauggcuucagucuauauuuguaacugauugacauccaaaaauucaagccaugacugaauuaaggacgacuuaacuuuagcuguaggauuuuccuaacuuuuuuucuuuucuuucauuuucacuauguuuucuugucugucuguuuuugguguucucauuuuuaaaagcuuuaucuuuucugugcuuaaaaaauaaacucucuauuuggugaugaggcucuuucgauagggccuugcaguuguuaaaauucuucagccuacugaaaaaugaaauacuaccacagaaagcuuuuuuuaaaucuauaggucaaaaccuagaguuagggccaccuuuucucccucugcaccccaauccagugacuauucauagcuuguacugccaucguuuaggaaacacccaacacaaagcuuauuuagaccgaauucauuaauaauaagauugcauaacuuuuuauauuuuaaaaauaaaguauauuuugaaauaauauauauacauuuuauauuucaaaauagguuuuaaucuuuucccaaucuuuauuuuuagacguuaaggaagaagauaaauccaaggacaacaguggugaaaaaacagauaccaaaggguaaaugauguuccuuaucaaguacuuuuuacauacuauaaaaauacuaaacauguuuauugguguguguuuguguacacacuucagaaauacuagacugaaccuuagaacaucauuaugaggugcucugaauuuuaguuuguauugguacauaagacaacauaugccaucuuaccuauugguuuaucaguauaacuauaucagucaguuuguauucuuguacguaguuuaucugagacccuuuuuugcuguuaucuuuuauauaugcacuuaaugguuuucaugguguucuuauuucuguguacaugauuuuuuuaguguugugagauagguaaauuuaagaaacaauuuuaaguaaaaacaguugaggauuuuagugucagaaagcauguaaauguuugggcacacauaauuuugugccagccuuuacaggauaacuuggaauaguuuauuaaaucacuagaaaaauuaaggcauuaauuacuccagaaacacuuaagacauuaucaauuaauguguuucuuagcaugagccuacaggaccugaucaauauaauaggucagugcauuuaaaccaagauugugccauuuuuaauauuucacauugccucuuuuaacagaaccaaaucagaacagcucagcaaccccugaauuugacagucucaccaauuucagaaaaucauuaaaaagaaaauauugaaaggaaaauguuuucuuuuugaagacuucuggcuucauuuuauacuacuuuggcauggacuguauuuauuuucaaauggcuuuuucguuuuuguuuuucuuggcaaguuuuauugugaguuuuucuaauuaugaagcaaaauuucuuuucuccaccaugcuuuaugugauaguauuuaaaauugaugugaguuauuaugucaaaaaaacugaucuauuaaagaaguaauuggccuuucugagcugauuuuuccaucuuuuguaauuaucuuuauuaaaaaauuguacuuggauuaucu

SEQ ID NO: 16235 - RNA, 6625 nt, Homo sapiens
uuagcaggcuugauuauaucaacugguaaaacuuuauuuuacaagcaauaggaauuggaucaaaugauuauuauaacccagaggaaguauuuuguaaccacagcaaaugccauuauacauacugccaauacagauuuaauagacaauacugaacuguacaagaguuauuuauuuuuccuuaaucucaaagcuauuuuuaguaauacaaaaaagccauauuaacauuuuuuuccguuagaaaacaugauguacaaaacuuuggaugaaaagauacgucaaauuucauuuaaucacuuggaggaaaauccaccaacuccaucaauaccacccaaaguguuuuaggcagugaauaaaaucaaaauaaugcaucuuaauaaauuccagcuguuaaaagaacaaacuuagcaauauauaacaguuugcuaacaggauuuuugacuauucacuuugggaguuauuuuuaaaaauccacuuuuuuacugagucuuacuacauaccaggcacuguacuuggccaucuagguaacuaagaaaacguugguuaagauaggaaagacccauaaaucaguccuuugguuaccaaauucaauuuuuaacuuucaaacauccuccaagaucaagaaacccuaacuaaaaauacauacccuucuaaguguuauuugauuuuauuaguagcaaggguguuugguaaggucaugaaccacuauuuuugauccauuauuccaauuaagaaugcgugucaaaaccuaauuuguuauuuuucuaaugaguuuaagauuuggcauucaguuguuacacaugugguucaaugauuuaucaugaacccuaaacugcacacugcucaaaaacagcaaaacagaugugcauuaaaugaaauaauguuuuugauacauaucuuaaauuucaaucaguuuaggguccuuugaaggaaaagauauccaguuaucggguggcaaagagcagaggagguaaacuaguaaagauuauuaauauucagugaaguauuauugucugucuuauccuuugaguaacaagaugcuaacacacuuucaaaaaaaaaaaaaaaaaugaugcuuaaaacuaugcuaaaggcccaugaacugacaucauccauucaacaccauuacuuuguuacauaaaccuguuuucuuaagguagaacauauuaugcaauaauuuggaaauuagccaagcacuaagcaauuacaauagcagguaauacaccaucaauuuuugaaacacauuuggucacauuucaugacccaucugcaguauggauucuauagacucucacucaguuuaaaauuuguuucuggaccugaaugacaagagaauggcuuuaugaaauuuucucauaagacauuuaaauagucuuagguucacaccccuuuuguuguaaaugauuuaaucugacaugcuauauagcuacaauaaaaauaauuauguucaauucuuaaaugaaaacuaaaugccaauaaaugguaacagauuugacauggaauguuguaagaucuuccucuacguaaucugacacugcggauuaugaauuucagagcuugaaaacuucagauuaagaaccacaauaaaauuuacuccugauggcaugcaagaucuuccuaaaaauuaaccuaagaccuagaagucucaguauuauuagaacauaaaaaaacacaacaaauuuguacauuuuauucacauuuauuuuucgcuuuuagugugcucacagaaaauuagaacaccuuaagcaggaguuuaauagcaauuuuuguaagcaaaguuacauuccaucucuaagucaaauuggucaaagcuucuccaguauuuacaaaacaugauagacaagaugcuacacaaaaccauugcaucugaagauuuuuuuuuccuuuauucucaaagacgacuggaaaagaaagcauuaucugcuguaaucaaaaacauaccacaguauaaacaguaaccauuccacuuaucacagcuugguugaguuuaaaauuuguguuuuaaaagguccaagaugacugcaguuuuacaaaaaugggcaggguggaaaguugcaaacuucaugugcuucuggauaucaagauuuguuuuuauacaauagucacaguuaaaaacacccugcugguaauacauaauuacacuuuauuaaggucauaaaccagcaauaaacaauaaagccuauacaacuuguaguucuacuuaaucacugacugguacagcuaacaugagauaagugaaaaguuccuaugguuuaaaugaacuccuaagacuaugaucguuuuuuuuuuuuuaaaucuggguauugguguuuuuucuuuuuuccucuuuccuucuuaacucaagacuuguaguguuguaaaccugccucacaaaauacaugguaauaacuuuucuuuaaaaaaaaaaaaaaaagacagccuuuacaccauuucuaguggcacacuauuuuggcaauguuaugcaccacuucaauuuccccauugugaccccuaucacuucauuugauaucccuuuuugacccacccaucuccuucauauaugggcauguccauagauugacaaagaaaguuuacacuuuugaauaaagaugcaaaguaugcaaaaacauuaauacugaugcgaaaaaauaaaaaauaaaagagaaacaaggcagaggaagaagguguuuaagcucuccucgaccuguuggaauggugguuaacagaaugauuugagaugggaucuguggggaggggagaaaaaaaaaaaacaacaaaauuuggugcuuaaaaaaaaguaaaauaaaaaaagacaucuuuaaaaucaaucccugguuguagacaaguucuccaaaaccaguaccuggcaccacuccaacaaacaaacgggggagaaaaguucuucgauuaucucacaaaagcuugcucuuuuacucugccgccuccgcugggggggcuucuggacugcacucgggcugggccuccugugagggggcugcgcaggcugacgaggcugcggcggccgcgggcuccuccgcgggggcugccuccugcuccgggggcgcgccgggcccggcggcggagggggccucgcaggcggcggcgcuggccccggccuccucggccuuuuucuccuccaccuugcugggcuccucggcggccuuggucucgucgcuggcgggcggcuucucuggcgcgacagcggccuccuggggcuuggccuccugcgggucgccacccgccgcccccuccucgcccgcugccgccuccucgcccggcgccgcugccugcuccccggaggccgcgcccgccucggcggcggccgcagcugcgcccccggcggccucguccuugccgccuucggcagcgggcgccucagccucaccgccuucuccagccuccuucuuguucuucuugaaggagaagccgcucagcuugaaagacuucuugaaggaaaagcgcuucuuuuuuuuuuucggggucucguugcugggcgagggcguggccccguccucggccuugggcgaagaagucgaggaggcggccgacgcggccucucccuccgcggccgugggcgagccgggcucggcagccucgccuuccgcgggggccuccuucucuaccgggcuggccccggccucgggggcagcggcggcggccggcucaccuuucucggccgcggagggcgacgccgccccgcucccggcggccgcgggcuccuccuugucggcggccggggcgcugccguuggccugcagcuccuccuuggcgcccgacucggcggccgcgggcgaagcgucgccguuuaccuucacguggccauucuccuaaggggcagagaaagcgggagcgucacugaagcggccggggcgccgccauucccgcccccagcccuggaccgggagugccccgcuucccccuaaggccccuguggccaucgagaccccacccccgccguuguggggagggaggcgcggguggaugcccagaagagagccccacgaacgaggaaaugggcaccgcugccuggagaccccccgaaaacacaacuguagcccccaaguacggcaauggccucccagccauucagcaagugcccuaaagacgaaguccgaaacguagcaagcaaaggcuaaccaugccagcccucgcuuuaucgggggcuugggggaaaaaaggugccagggacuaguugacacagcaaacgcccuuuggaagaaggcacagagccagagcuggugguucgcgccuacguuucacaucccucuuucgcccuaaauacauaaaggccucuucaaaauaccaggaauucccagggggaucacagcacucgagccaggagcgcccgcgcggggcccuccgagcuccugcgcccacccaggccuuuggcaccggcagggggcgcugugccuccaccgcgccgcguugggcgcaggcaggcgaggaggggcggagucgccgggccaccccgcccugcccagccgggcccugcccgcaggccgaggcgcccccgagcccggaucgcgcagcccaacaguccgcaaacaaagcucaggugguuuccuggccugccggucgggcugaaaccaacaaggcagggggaaacccauuauuucugaggucucgccucugcuuccacgcccaccuuccccugcgauucugcgaagccugggcgcgccucggcggcucauuuugcauuuuuaacggguuuaaagccucuuggcagaccucgcuuuccccaguagguuagagcaggcgaagcgacacgaucucuucucuaggaaaagaggcguggugggugcccaguguuugcgaagcagccacccauggccgaccucucggguccacccaaucguggcuaucugccuggguccgggcagcgccgggcggccccucgcggguggucgaggcgccacgcacaagaacaaucccgaccgaaaggcacgaaccgccucuuuuugaccaucuggaaagguucuuaaaggacccaccgaguguucccaccccacagauaccauuuaaaaaucaaauggauguguaauuccacagacagcuacgaauaaagauuuaggacagugggaaagccucaucaaaagguaccgaagcccucugucuggccccagccagccaccuuuccaagaacccagggcacgccgccgcggcauacaauaagacagccuuucccuccucgccuuucuccaccaccauccccauugcgccccccuuucccgacucccccccccgccacacacaaucacaccaccaguucagaaaucucgaagacaauccagcuucgacaacaaacccgagagacacccaaacaccauugugcccccaaacacaaaugaaaccuggcugggggcgggggaaggagggcaccuagcuagucacguucugccaaucuccaaaccacgccauuuuagacgauuuaucacuccuuuccucccgucuacucaagaauucuccaggauucuaaggaaccacuccuuugguguggggggaccccggcuaugaaaaauccacaauuuaggcuauccauuuccauucaacuuucagacuagaauccagccacacuccucuccacgaaugagccuugggagccaccaggagggaaggagagaaagacacgaaauaaaugaccacaaccacagguagaauuuaccuguccguucgcuuuggaaggcgacgaggccacagccgccuccccaggccucuccgcggcggcuucucccuucgcugcggucuuggagaacugggcacccaugcuggcuucuucaacaaagaaacucaacagauccaagaggggaaacaaagagccucggguugguguaacgacggggcgagcagcagcagcggcggcggcaacagcggcagcggcacacacaccggagggaggggggugggggugguggagaggacagaacagaaccgauuaaauacacuccggauaaaaaaauuuuagucgaagagaucaaaaagcagcagcacaggagggagggaaaaaggguggaaaagucgagcacaaaaaaaggagcccaaguguaguucgaaaaaaaaagaaguaauaaaaaaaucccagauuuguagccgcacuguagacaagaggaaaauggagaaaucucccugguugcuaauaagaugcgggguccaacgcccaagugcacagaugaaugggcucgcgggcgcugacgcggcccccgcgcgcgucggccaauccgcgcgccgcacacaaagcagggggcggggucugcgcgccuggcgaacaauggagccgcgcuuugcaaacgguuugaaaaucagccucagaccgagaauuaauguccuccaaauaaauaaaucaauuaaaaaauacauggcacucgucucucucugcuugaaaauaauaaugcauuucuugauuggcuugcuuuguuuggaauuaauuaacacgggagggggguacuugugcaucggggcggagaaagcguuaacuugacucgcauugacucucgucggucuauauccgugugucucucucucuccacucgcuccccucccccaucuuuccguguguuuauguguauguguguguaugcgaguguuaaagacaaugguugcgauuuguguguuugcagcauguuuucuuucuuuuuuccauauugguuuuaca

SEQ ID NO: 16236 - RNA, 6625 nt, Homo sapiens
uguaaaaccaauauggaaaaaagaaagaaaacaugcugcaaacacacaaaucgcaaccauugucuuuaacacucgcauacacacacauacacauaaacacacggaaagaugggggaggggagcgaguggagagagagagacacacggauauagaccgacgagagucaaugcgagucaaguuaacgcuuucuccgccccgaugcacaaguaccccccucccguguuaauuaauuccaaacaaagcaagccaaucaagaaaugcauuauuauuuucaagcagagagagacgagugccauguauuuuuuaauugauuuauuuauuuggaggacauuaauucucggucugaggcugauuuucaaaccguuugcaaagcgcggcuccauuguucgccaggcgcgcagaccccgcccccugcuuugugugcggcgcgcggauuggccgacgcgcgcgggggccgcgucagcgcccgcgagcccauucaucugugcacuugggcguuggaccccgcaucuuauuagcaaccagggagauuucuccauuuuccucuugucuacagugcggcuacaaaucugggauuuuuuuauuacuucuuuuuuuuucgaacuacacuugggcuccuuuuuuugugcucgacuuuuccacccuuuuucccucccuccugugcugcugcuuuuugaucucuucgacuaaaauuuuuuuauccggaguguauuuaaucgguucuguucuguccucuccaccacccccaccccccucccuccggugugugugccgcugccgcuguugccgccgccgcugcugcugcucgccccgucguuacaccaacccgaggcucuuuguuuccccucuuggaucuguugaguuucuuuguugaagaagccagcaugggugcccaguucuccaagaccgcagcgaagggagaagccgccgcggagaggccuggggaggcggcuguggccucgucgccuuccaaagcgaacggacagguaaauucuaccugugguuguggucauuuauuucgugucuuucucuccuucccuccugguggcucccaaggcucauucguggagaggaguguggcuggauucuagucugaaaguugaauggaaauggauagccuaaauuguggauuuuucauagccgggguccccccacaccaaaggagugguuccuuagaauccuggagaauucuugaguagacgggaggaaaggagugauaaaucgucuaaaauggcgugguuuggagauuggcagaacgugacuagcuaggugcccuccuucccccgcccccagccagguuucauuuguguuugggggcacaaugguguuugggugucucucggguuuguugucgaagcuggauugucuucgagauuucugaacugguggugugauuguguguggcgggggggggagucgggaaaggggggcgcaauggggauggugguggagaaaggcgaggagggaaaggcugucuuauuguaugccgcggcggcgugcccuggguucuuggaaagguggcuggcuggggccagacagagggcuucgguaccuuuugaugaggcuuucccacuguccuaaaucuuuauucguagcugucuguggaauuacacauccauuugauuuuuaaaugguaucuguggggugggaacacucgguggguccuuuaagaaccuuuccagauggucaaaaagaggcgguucgugccuuucggucgggauuguucuugugcguggcgccucgaccacccgcgaggggccgcccggcgcugcccggacccaggcagauagccacgauuggguggacccgagaggucggccauggguggcugcuucgcaaacacugggcacccaccacgccucuuuuccuagagaagagaucgugucgcuucgccugcucuaaccuacuggggaaagcgaggucugccaagaggcuuuaaacccguuaaaaaugcaaaaugagccgccgaggcgcgcccaggcuucgcagaaucgcaggggaaggugggcguggaagcagaggcgagaccucagaaauaauggguuucccccugccuuguugguuucagcccgaccggcaggccaggaaaccaccugagcuuuguuugcggacuguugggcugcgcgauccgggcucgggggcgccucggccugcgggcagggcccggcugggcagggcgggguggcccggcgacuccgccccuccucgccugccugcgcccaacgcggcgcgguggaggcacagcgcccccugccggugccaaaggccugggugggcgcaggagcucggagggccccgcgcgggcgcuccuggcucgagugcugugaucccccugggaauuccugguauuuugaagaggccuuuauguauuuagggcgaaagagggaugugaaacguaggcgcgaaccaccagcucuggcucugugccuucuuccaaagggcguuugcugugucaacuagucccuggcaccuuuuuucccccaagcccccgauaaagcgagggcuggcaugguuagccuuugcuugcuacguuucggacuucgucuuuagggcacuugcugaauggcugggaggccauugccguacuugggggcuacaguuguguuuucggggggucuccaggcagcggugcccauuuccucguucguggggcucucuucugggcauccacccgcgccucccuccccacaacggcggggguggggucucgauggccacaggggccuuagggggaagcggggcacucccgguccagggcugggggcgggaauggcggcgccccggccgcuucagugacgcucccgcuuucucugccccuuaggagaauggccacgugaagguaaacggcgacgcuucgcccgcggccgccgagucgggcgccaaggaggagcugcaggccaacggcagcgccccggccgccgacaaggaggagcccgcggccgccgggagcggggcggcgucgcccuccgcggccgagaaaggugagccggccgccgccgcugcccccgaggccggggccagcccgguagagaaggaggcccccgcggaaggcgaggcugccgagcccggcucgcccacggccgcggagggagaggccgcgucggccgccuccucgacuucuucgcccaaggccgaggacggggccacgcccucgcccagcaacgagaccccgaaaaaaaaaaagaagcgcuuuuccuucaagaagucuuucaagcugagcggcuucuccuucaagaagaacaagaaggaggcuggagaaggcggugaggcugaggcgcccgcugccgaaggcggcaaggacgaggccgccgggggcgcagcugcggccgccgccgaggcgggcgcggccuccggggagcaggcagcggcgccgggcgaggaggcggcagcgggcgaggagggggcggcggguggcgacccgcaggaggccaagccccaggaggccgcugucgcgccagagaagccgcccgccagcgacgagaccaaggccgccgaggagcccagcaagguggaggagaaaaaggccgaggaggccggggccagcgccgccgccugcgaggcccccuccgccgccgggcccggcgcgcccccggagcaggaggcagcccccgcggaggagcccgcggccgccgcagccucgucagccugcgcagcccccucacaggaggcccagcccgagugcaguccagaagcccccccagcggaggcggcagaguaaaagagcaagcuuuugugagauaaucgaagaacuuuucucccccguuuguuuguuggaguggugccagguacugguuuuggagaacuugucuacaaccagggauugauuuuaaagaugucuuuuuuuauuuuacuuuuuuuuaagcaccaaauuuuguuguuuuuuuuuuuucuccccuccccacagaucccaucucaaaucauucuguuaaccaccauuccaacaggucgaggagagcuuaaacaccuucuuccucugccuuguuucucuuuuauuuuuuauuuuuucgcaucaguauuaauguuuuugcauacuuugcaucuuuauucaaaaguguaaacuuucuuugucaaucuauggacaugcccauauaugaaggagaugggugggucaaaaagggauaucaaaugaagugauaggggucacaauggggaaauugaaguggugcauaacauugccaaaauagugugccacuagaaaugguguaaaggcugucuuuuuuuuuuuuuuuuaaagaaaaguuauuaccauguauuuugugaggcagguuuacaacacuacaagucuugaguuaagaaggaaagaggaaaaaagaaaaaacaccaauacccagauuuaaaaaaaaaaaaacgaucauagucuuaggaguucauuuaaaccauaggaacuuuucacuuaucucauguuagcuguaccagucagugauuaaguagaacuacaaguuguauaggcuuuauuguuuauugcugguuuaugaccuuaauaaaguguaauuauguauuaccagcaggguguuuuuaacugugacuauuguauaaaaacaaaucuugauauccagaagcacaugaaguuugcaacuuuccacccugcccauuuuuguaaaacugcagucaucuuggaccuuuuaaaacacaaauuuuaaacucaaccaagcugugauaaguggaaugguuacuguuuauacugugguauguuuuugauuacagcagauaaugcuuucuuuuccagucgucuuugagaauaaaggaaaaaaaaaucuucagaugcaaugguuuuguguagcaucuugucuaucauguuuuguaaauacuggagaagcuuugaccaauuugacuuagagauggaauguaacuuugcuuacaaaaauugcuauuaaacuccugcuuaagguguucuaauuuucugugagcacacuaaaagcgaaaaauaaaugugaauaaaauguacaaauuuguuguguuuuuuuauguucuaauaauacugagacuucuaggucuuagguuaauuuuuaggaagaucuugcaugccaucaggaguaaauuuuauugugguucuuaaucugaaguuuucaagcucugaaauucauaauccgcagugucagauuacguagaggaagaucuuacaacauuccaugucaaaucuguuaccauuuauuggcauuuaguuuucauuuaagaauugaacauaauuauuuuuauuguagcuauauagcaugucagauuaaaucauuuacaacaaaaggggugugaaccuaagacuauuuaaaugucuuaugagaaaauuucauaaagccauucucuugucauucagguccagaaacaaauuuuaaacugagugagagucuauagaauccauacugcagaugggucaugaaaugugaccaaauguguuucaaaaauugaugguguauuaccugcuauuguaauugcuuagugcuuggcuaauuuccaaauuauugcauaauauguucuaccuuaagaaaacagguuuauguaacaaaguaaugguguugaauggaugaugucaguucaugggccuuuagcauaguuuuaagcaucauuuuuuuuuuuuuuuuugaaaguguguuagcaucuuguuacucaaaggauaagacagacaauaauacuucacugaauauuaauaaucuuuacuaguuuaccuccucugcucuuugccacccgauaacuggauaucuuuuccuucaaaggacccuaaacugauugaaauuuaagauauguaucaaaaacauuauuucauuuaaugcacaucuguuuugcuguuuuugagcagugugcaguuuaggguucaugauaaaucauugaaccacauguguaacaacugaaugccaaaucuuaaacucauuagaaaaauaacaaauuagguuuugacacgcauucuuaauuggaauaauggaucaaaaauagugguucaugaccuuaccaaacacccuugcuacuaauaaaaucaaauaacacuuagaaggguauguauuuuuaguuaggguuucuugaucuuggaggauguuugaaaguuaaaaauugaauuugguaaccaaaggacugauuuaugggucuuuccuaucuuaaccaacguuuucuuaguuaccuagauggccaaguacagugccugguauguaguaagacucaguaaaaaaguggauuuuuaaaaauaacucccaaagugaauagucaaaaauccuguuagcaaacuguuauauauugcuaaguuuguucuuuuaacagcuggaauuuauuaagaugcauuauuuugauuuuauucacugccuaaaacacuuugggugguauugauggaguugguggauuuuccuccaagugauuaaaugaaauuugacguaucuuuucauccaaaguuuuguacaucauguuuucuaacggaaaaaaauguuaauauggcuuuuuuguauuacuaaaaauagcuuugagauuaaggaaaaauaaauaacucuuguacaguucaguauugucuauuaaaucuguauuggcaguauguauaauggcauuugcugugguuacaaaauacuuccucuggguuauaauaaucauuugauccaauuccuauugcuuguaaaauaaaguuuuaccaguugauauaaucaagccugcuaa

SEQ ID NO: 16237 - RNA, 2302 nt, Homo sapiens
accacuuacccauggccaaauguguaugacaaucccuacuucaugagauuaucauaaagaugaaauuaaaugagacaauuuuuuuuuuuuuuuuuuuuuuuuuuuuugagcuggagucuuucucugucacccaggcuggagucagugguaaaaucucugcucacugcaaccuccaccucccggguucaagcaauucuccugccucagccucccgaguagcugggacuacaggcgccucccaccaugccuggcuaaauuuuguauuuuuaguagagacgggguuucaccauguuggccaggcugguaucgaacuccugaccucaugauccacccaccuuggccucccaaagugcugggauuacaggcaugagccaccacgcccagcccuaaaugagacaauuuaugugauuuuuuugcacaugggaggcacucaaaaaauaaaaguguccauuuccuucaccucugaauucauacucuuuauuuuaaaguugcagugucguguauacagauguaaaagagagcuuuggaaucagugaggccuggauccaaaccccaucucugcuuuccaccagcugugcgaccuugggcaaauguccuagucucucugaaccucacuuucuucuucuguaaaaggaaaauaaugguacuacuuugcaggaaugcugagguuuacaaauagcauaugccaaguaucuggcacauguuaggugcaaaauaaaugguuuugcuuacacuuagauaaaaugacuuuuguucuaugaaauggagcuaaugauuagguuuuauggaaaggcuuuauuuauuuauuuuaugauuagguuauacaaaaaugcuuuauuucaccuggaagcuuaccugggugucauuuuaugguugucucaucugaccauuuuuaaaccaugguuggaucuuguggaaauguuuagagcucguuaugaagccaauguaaacaaagguaccuaucagcuguugcagacacuaucccauccacaggggcaccccugacauagcuguagcccaacuucacccugaagucuuggaaagguuacaugauucagacagauguaguaggcaugagauuacaggccaagaggaagaggccggggcuguaggcaguauacuugacaggcucauacacugcaagccuuguuccgggccccuuacaaagcaccucuuuaggaugaaaacaagauggucuuuguaaauaaaaguucaugcauuuggguaaugaagucauuuuccagcgcugcagugaaagauauucuucucccaagcccucugggugaggacuggagggaggaagagggguggccagugaaucugaagagaagauauuagcacaaagagugcaacagucuaucccccagaaaaaacccgagaaaccuugcucaagaaagugggcacccugacccucugccuucagagaucaucuaccuuugguuccugcccuggaaucccuuuuccacccacuuuccugcaaacuagcgggggccacauaaaauaucuauguaaauauagauaagacauccgguaccuugacuacauaaauaagaguggugaggaagcgucacaaaagcugaauauucuucuggagcccuuggaggggcuccaaacugagaggggagggaagaccgcagggaaaggcggaccucagugucugaaaagccagcuuagagugggagggccugggaguagaagguaaaaagggaguggugagaaugaaugugagaaggaagccaggacagcgcaguccccagucccgaacggccagggagaggagguggccuagcgcuggcggggcucaccccaauccgucugccuuuugaugccguacuguaagcuccguccaucuguagguucuugagccagaaccucugcgggaaggagaaaaagugaaagagggagagggagagggagagagagggggagaaggggagagagagagagggagagagaggcuggaacucucccuuacucucgcacuuucccuuuauuuccuaagcugcugguugcgcagccaccucgggauacugcacacggagaggagggaaaauaagcgaggcaccgccgcaccacgcgggagaccuacggagacccacagcgcccgagcccuggaagagcacuacuggaugucagcggagaaauggcuuugagcucagccuggcgcucgguucugccucuguggcuccucuggagcgcugccugcucccgcgccgcguccggggacgacaacgcuuuuccuuuugacauugaagggagcucagcgguuggcaggcaagacccgccugagacgagcgaaccc

SEQ ID NO: 16238 - RNA, 2185 nt, Homo sapiens
cugccucgagacagggcuaucuugccuuucuggugucuuuucauuugagggugagaggaugaaauggaaaauugggcggugauagcagcguuuucuuugaucaaacugaaaagaguacggagcaaaguagaauccuguccugaaacguggaaacgcacaacaaauaacaaugaggaggagaaggagauuaggaucauuuuaucaguccccuauuucugcggacacucauuuauauuuuuuuucuagcaaaagucuggaggaaguauuacugaaauagggggaggggccaagcggcgacuaaggaaccugaaaugacagagauuuguucguacauuccccgccccacccccaaaaaaccucguuuaauuguagucauugguugucuuugguuucucauaacauucaaacuucucauguuuuuuuccccuucacugaaucugagcuuuugcucauauuucccuugaugaaauaauugccgguuuaguauacaguugggagugcaucggucuuuauuuccuauccagcuuuucuauggcaggauguaacuucauaaaaagaaacacuuuggcuuccugauuuucuuuauagguaauuccuguuuacugaaaguucugcuuuaaggcauacucagaaucgcucuccuuaaugauuuuggcaagaacccuaccuucccccucagcaaaucuaauguucuaagaaauuauaagugaaucagcuucugcuucugugcucaaaaucuauaauauugccuuuccggcccacuacuuguuuuuacuguaguuuaaaaaaaucugucccuuuugcugacuuuuuucuuuuuguacacacuacuuuuuaagaaaaguugcuaacauuuauuaaaugaucugcauccuauggaggaggaaacugaggaaaagaaaaguuaaguaacuaacucaaggugacaguauacagagguuacuggauuuuuuuccuuuuccuuaaacaaaaugacaaauuaaaccauguuuaaauugugucuggaaauuccauaaucccaagaaauggaaccauagcuaggacuaggauauuuccauacaagagaaagccagcuucauuuagccaagaauugcuuaucucaagagcagaggcucuucguccucagggcuaguccgcaauggcugcucuggguuuauuuggauugggaugcagaggcaguuggguagagcaaugguucucaaacuuugacauguaucagaaauaacugaaggggcuugcuuaaacaugaauugcuguguuuaaccaccugagguucugauuuaggggguuugggauggugcccaagaauuugcacauuuagcaaguucccaggugauguugauacagccaaucuggagacagcaccuugaggaccauaguucuagaauugggcuguccgaggagguagccacuagccacaugacuguuaaguacuugaaauguacuucaguauuggaaauuuggcuacugcaaauuaggaugugcuguaaauguaaaagauguauuagauauuucagaucaagcaugaaaaauggaauguaaaguaucccauuuuaauauugauuacauguuaaaaugauagucuaaauguacugugcuaaauaaaacauuauuagaguuaauuaaauuguuucuuuuauuuuuuaaaugcgucuacuagaaaauuuuaaauaaccuauguggcucaaguuauaucucuaucgggcagcacuggucuggaguuguuucugauuccagcuccacaguucacuguugggagcgcuuugaugaagcaagucgcuuauccuuuuugaaccuuaguguccucauacguaaaaugggaaaaauaguaaaacuguucucaaacuauuccggacagacuaagugucauaugcucucaagaaaaaaacacucuuaggcuauauaucuccuugaaaucucauguuuaguucaaucuaucuuacgcuaaaucuggaaaucuggaguaggugggauaaguccucucucucucucucucucucucucucccucucuccuccucucucucuguuucuucacgagaagucacuucuuagugucugcaacuguaauagcuucuugaucuaauuaguggacaaagagacaaugugauuaaaaugacagauuaaccugcucccaucaagacuucauccuguuuuuuguaauucuuugcuuaccuacuuuuuua

SEQ ID NO: 16239 - RNA, 1134 nt, Homo sapiens
ugagggucucucucuuccucuugugcucuuacuggggcuggugguccaggggucuuacuccuuggaggccaugugggccaugagguccaccauccuguugcuguagccaaauucauugucauaccaggaaaugagcuugaaaaagugguuguugagggcaaugacagccccagcauugaagguggaagaguggguguugcuguugaagucggaggagaccaccuggugcucaguguagcccaggaugcccuugagggggcccuccgaugccugcuucaccaccuucuuggugucaucauauuuggcagguuuuuccagacggcaggucagguccaccacugacacggcaguggggacacagaaggccaugccagugagcuucccguucagcucagggaugaccuugcccauagccuucgcagugccaguagaggcagggaugauguucuggagagccccguggccaucacgccacaguuucccggaggggccauccacagucuucuggguggcagugauggcguggacuauggucaugaguccuuccacgauaccaaaguugucauggaugaccuuggccaggggugcuaagcaguugguggugcagaaggcacugccgacaaucuugagguuguugucauacuucucaugguucacacccaugacaaacauuggggcaucagcagagggggcagagaugaugacccuuuuggcuccccccugcaaaugaggcccagccuucuacaugguggugaagacgccaguggacuccaugacguacucagcgccagcaucgccccacuugauuuuggagggaucucgcuccuggaagauggugaugggauuuccauugaugacaagcuucccauucucagccuugacggugccauggaauuugcuauggguggagucauauuggaacauguaaaccauguaguucaggucaaugaaggggucauugauggcaacaauauccacuuuaccagaguuaaaagcagcccuggugaccaggcgcccaguacgaccaaaucuguugacuccgaccuucaccuuccccauggugucucagggaugugguuuggcugacgaugcaaaagaagaugcggcugacuguagaacaggaggagcagagag

SEQ ID NO: 16240 - RNA, 1802 nt, Homo sapiens
aggcgcucagccgauuggaaguuccacaacgaccgucacuacccagggccggagcggcaacuccgcagcggagcucugccugcccgcugcguucccccaagagacuagaccccacaaacuccuccuccaccgcggucccaacucgaguccccccgccgucuccgagcacucggagggcgccccucugggacgggaccgacgccucggaccgggcugcgccgcgggaguucgagguacgcgacggggccgcgcgggggaggcgggcggaacgggcgccccucggagucgguguccggacgcaaccccgcgacccccuccgccucgccccucgggcacggcccgacugggauccgacccacccaucccgccaggucgcgggcagggcgaggacccgagcgagccuacuccucccgccccugcucuuacccaucuuuccgccucgccuuguagacgugaccguaggugccgcgucccacuuugcacccuucguacucaaacaaauccuccacccgcucccgcuccgccgccagcuucgccuugaaaucauaauccauugucugcuucccccauagaggcacgggacgcgggggccgccgccgcucagucccuccuccuccuccccccgcgaccgccgcuccacuucuccaacagccgccucucgcgcgcgcgcgcgcgccgcccgccgcccgccgcuccgcgguccgccuucagcaagggacuccucggcggccacagcagccaccuccuccaccucuuccuccuccuccuccgcgacggcggcggcggcucccgcaggcacccccagucccgccucccuccuucauuuccuuguuuuggaaccuggugggccgcgccguggcuuccucgagcucauuagcgaacucacuggcccgccccauggucgcggaggcuccugggaaaugaagucgcgaaggccucagcggccugggcgguuuugccggcguaagaaauacagcucccagguuaccucgggccaccacagccucgcccccacaaagcaugcgcgccugcguaccagggccgccccucccccucagguagcgcacggcucccgguuccugugaagguagaaagcucgaaguuccagugugcuuucugcgguucucggggagacacuggaaagaagugccuuacucuagugggaaggggauacuucacuguaacuagccccacgcagagaguauggaaagcauuaaaucagcaccuugcugaaggguuggcugcagugacucgggaggcgagggcuggugaggacaguuguaccgcagcuuguuucuuuucuagggcaguggguccgccuauugccccgccccccgucccgcugcucauuggcgggggcuggagaaugacguccucguuggugcguggguauccccaggcuuuggcuucuuucccgcucuugauuggugauuggaugugcucgguucuuccugauagguugaucuuuuuucuuuacgaugcaaaaaccguauuucaaaaacugaaccuucagcaguuuccuagagccugccuuggccagaggagaacaugcaacuucugagccccagcagccaaucaucauuuucuuggcgcuguagucagcuuucucuuagcauaugcgguucccauaaccaggcuuuggccaucugucuaaggacaauuaaaagugccuggaggaagccgcguuuacgauccuuuggguugaauuguaaaggauuuuuuauggucuaugcaugaugugagguucuagaauguuuaagaaagccccuuuaguuagggugaacguugauugauuucauugu

SEQ ID NO: 16241 - RNA, 2496 nt, Homo sapiens
uucaucucaaaagucuuuguucugauaaaaucuacauaaaaguuuuaaaggaucccacugugguauuccacacaguguuacagaauacuauauuuccccucaaaaugugugcuuccuuaggucuguugcaauucaaaaccagauuguuuuaccuucaucagccaacagaaaaauauaaaaucauugauggccaacuucuagaaagccacuaaaagacauuuuuaauuuuaggugaaguaucaaauaguacccuuuuugccuccuguuugcuuuuugugacaaagucauuccaacaaguuauuucgaagacauuucuaaaagccugugaccagaaacaggcagaacugaaucuucuuacugaacaagaacguucauaugcaccuugagguauguuauccggggucaccuugagguggaaaucagaugcuggcaugaccaguaauaaaagaugucagauccugaauacaguuacuucauugggugauuguuacauuuucuuuggaaaacaguuuugcauaaucuacgaauuuuggacauacccaugucuuaugccccaaccauuuucauucccauggaauuagaauuucccaagguacauucuaggcauuauaguucuaucaaaugcuucagauaugcagacaugugcaaaaauguucacagcagcacuauuuguaaaggugaaaacauagaaacugccaucaugucucucaacaguagaauaaauugagaucuagucacacaauauaauucuauacagcaaugacagugaaaaacuacugcuacacaccccaucguggacgaaugucacacacacacaguguugaagaaggaagccauacacaaaggcauacguauuguuugggucccuuuauauaacaaaggucaaagucaugaccagugacagauacacuaguguucacuuugccaucgauaauugggcuauauauuuguguuuggccuguuuuuucacaugugaguuauauuucacaauaaaaaaugacuuuuuaaagagaaaaugaauagggaggaacuaaaguccauucauauguccauauucucaauuugggaaaaaauguggcuuugucuucauccucuuuuccugaguguauaaggccagaagccaaaggcaagagcaggacauuccaggagccuuuaugauugcucuaagucacaucugcucucgagcucccauuccacugugaaaaauaccuagucuugaacuuuggaguuccaaauuccacaugaucgacuuccucaaggcuuuucacuugacgaacaaauugcaugccaagaaaucgucaaaauucuaucaagcuuaauuaugcaauuucugucuauaaaugacauaccuccuguacccuaugacacccaccuaugcacuaauaagaugugacagcugcaucaccaacaaagccucccccgccugccauucucuucggaggugagcaccuccugcucgggaggaacugacagccccuuucagaaaugugaaggcagugaagucccaaaccagaaacagugugaccaccuaggcucacccaaggaccguccugugcuucugggcaaccaauggauguaggggguuaggaggcaguggggauucgucacguuuucaccuuucacaccaaaacgcauuccuguuggaaguuguagcguucuuuccaugaagucauguguguuuuguuuuuuuuuucagauggaguuucacucuuguugcccaggcuagaguccaauggcgcagucucagcucacugcagccuccaccuuccggguucaagcgauucuccugccccagccucccgaguagcugggauuacaggcaugugccaccauacccugcuaauuuuguauuuuuaguagaaaugggguuucuccauguuggucaggcuggucuugaacuccugaccucaggugauccgccugccuuggccucccacaguggucuuuuuuuaauaaggugaaaaaaaaauuuuugccaaggucaugugccaugcuuuucuauccacugcccaggaaaucaaaagguacucccuccaugagcuucccgcagugaggacucaucuguaaccucauaauguuaccaccucuaaggcaaagcggaaaaugucuguucuccagguucuccuugucuuuuuacccuuuuagaaucaguaaacaaaugauugaaagcuaaguuuccgaaucuuaacagaaauaaaaguucuuccaauacuggcuauaaacauguucuuuuccaauauauuggggcuagugaaagaaaauacccaguggacuagaaauaaaaaaaaaaaaaaauccccuucccaacuccccugaaccacacaccggaucccuugcuccacucucaccugcuuugaguucagagggaagaugccaggaaaaaggagcuuagagauuaaccagcauauacagccucagauaaaguaacaggacugggauguuuuuuauuuauuuuuuauuacuauuauccaaacucuucuguauacaaagguacaa

SEQ ID NO: 16242 - RNA, 13880 nt, Homo sapiens
cgugaagcaaagcuggaauccaaccagaccuucuggauuccagaacaauguauucccugcugcuuuaugcccccauguuaaguauuuaauuagcauaaguugaaacuucaagucagcaguuuuuagcacugaugaacucauuauuguucucugaucuucuuuaaagacaaauuuuaugaugugucauucauagagccacaugacccugcuuggcaaaaggcauugagucaagccagaccccacuaagccuuugcaaaguggagcggcuaguuguagccgcuguaguuguaguaaguggagcggcuaguuguguaccaucugcuagugaaagggaaaugagauuauucuagaagccagggacugucucgggaucucuuauggucucuggaucucuuauggucucuggaucucaaggacagcaacccuccucuuuauuccucgguuuuauuaguguuuccagcgugacaguucacuuccucuaaacaagacauagcuucguauaaugccagccuuucacgcaucauuuugaaucaacccuggggugguggagcccaggguaacccagcuguaguggacuuuagaacguuuuuacaccauguauuuaaauaugggugugucugauauucggcaaauucauuucaagccaaaugacgugucacacucaaaagcuaggaugggcccaacugagaggcugcccuaguuuucugagcgugaccuggcugaauucccucgccucuccuggcagagaacaggcauuuccccuugcuuucgucccacugccugcuucucagcucgagcugggaacagugaguguucaggucuuacugggucucagauauuuuccagaugaaaugcaaaaugagaauaaagggagaggcccuauucccucccagcucuuuauggucucuggaucucaaggacagcaacccucuuauuuauaccuggguuuuauuagugcuuccaguguaacaguaucacuucgucuaaacaagaaacagcaucuuauaaugccagccuuucaugcgucauuuugggucaacccuggggugguggagccgacagaccugggcccccaaacagcucugccacuugcugugugcagaucacagaacaucugugacucaguuuccuuuuugguaaaaugggacuguugcaagcacugauguugagguaauacucauaggaugacggucaauaaaugagacgauguuuuuuaauauuaacuagcuaaaagacuggacgcgucccuucacuuuaggcgcuguuccuuaucgggaauacgacgaagcugaucccaaaggccucuccagcccuuuucagcagacagucccguggguccucacucuaaggcauucuuugaagacuuggucucucuuccacacaccccucccauuccccaucucuuagugguggucuaacccgccccgccauccccuucccucucacuucucauauccauuuggaagcugcagauugcugaguuuccaggacuuuaauccgcgcccuuugcccucggcccgggcuuaggggucgaccucugucacaggaggcgcacucugcgcuuggauccauccuggggcgcccgggccguggaucuccaggugggagaccggaggagagcgcagacguuccggcgccacccucggacccgccggcuuuuccaaaccucuugaggagccugagcgcccucucggcccggcgcugggaggcugccagcggaccugggaccgcggcgggggcgggugguccucgccuugcggcggggaaagagcuagccuugcacgcgcaagcaccggcaaggagcccaggccgagggugcgcgguccagcacugggcgcccugacccucgagcuccucagcccccaacaggccagacccacccagaggccccagagcggaacgggguguccgcagcgccacgcccucgggcgccacccugcaggcaugggcgggcccaagacuguccccgcuggaggcgguagagggauccagaaguaaugagaugcuaaugagucgcgaauaaagcccgggcggcgccccgcgccccucgcggaagcccacacuccgcgcgacuccaggcgcacgccccgggccgccccgcaucccagcauccccgcccgaucucggcguuuccgcccccgcccccgcccccgcccucccacccgcucagaccugguugccagcccaacaggaagcggccccucccggcuucggagccgccgguaagucguccagcggagccggcugcgagccccgcggccggguggggugagguggggugcgcuuccggggaaacgcagcugcggucgcucgggaaccacgccuggcaggucaggcaggucuucccucagcccagcccugcucacgccgcguccggacuuugccguccagugucggggacccccaccgcugccgcccgcgguccagcucccucuccauccuuucagaccgcuccaccccucucacagccuuuguccuggcguuuccaggcugggucgcuccuuucuccccuuucgccgaggucuuccuccuuccacccuccacccccaagaaagaucuuugcccuuccgucaugagauuccgucugcccucguccgggccacccgcagcgggaggcuuucaucuccugucucggcgcggcgggcugggaacggaggggcagcuggaugguggaggggccugagccucagggaccugcccccacugcugccauucacccucccuaacgcugccguggacacccgccuccuccauacccucugauaccuucugggccccgcgugagaaacccccucgggcacccuucagguggcgugggagggggcgacaaagcgaggcuuugucuccggagauuccugggagagcgcgcccgggcgcacagggggcggggcgggguaggggucgaucagggaggggggaaccugggaggggcgcacccggcugcggucgacccccagcccuacccacggcccccuggaguagggcacauucacagaggaaguguuuugaccacagugcgucagaaauagacccaggccuccguuccccagucagucgcaacauccucccgccguuuguugaggcaguuugguggagggaaguggaaccuacgcggacagaggcuguuucucugucaggaggcaagcacgagugcugaggaaaacuuugcccuugccaugagacacuucucagacacagcguggcacugaggccaucaaggggcgccggcacagggacgcuuggagggagauggggcaggauguaugcucagcagcugggguuguggguaucagaucugucccuguguugcaugcaaaggcagcucuguccucuccacaucuaagaaauccccgcacacccugauuccaaggccuaaggaaggcaggcuaagaauuccuaccccagggcuuggagaucccuggacagggaggcugaacuggaggcuccccuggugucccaugugcccucugugcccaagacuaauguuuuucacuuccaaauuuggcaaauuucacuuggaguggacuggauagcagcugucucuggagcagaugcuggcaggggaaugggcugggaggagcagagccaaucacuggugaaucccgagcucccuggggacaccagccugcucucuucgccuccccuuccuuuuuauuucuucuguucuccagccucuuccccuucuuuuuccaccucuccagccacucaucucugcccagcugcugcccuccccaggaggccuccauggcuucaccuaccuccaccaacccagcgcaugcccacuuugagagcuuccugcaggcccagcugugccaggacgugcugagcagcuuccaggagcuguguggggcccuggggcuggaacccgguggggggcugccccaguaccacaagaucaaggaccagcucaacuacuggagcgccaagucacuguggaccaagcuggacaagcgagcaggccagccugucuaccagcagggccgggccugcaccagcaccaagguggauacacggugccugggaugggguguggagcaugcggggagucagaggacggacaggaugccaugcccucacugcccuguguguucacagugccugguggugggugcuggaccuugcgggcugcgggucgcuguggagcuggcgcugcugggggcccgaguggugcugguggaaaagcgcaccaaguucucucgccacaacgugcuccaccucuggcccuucaccauccacgaccugcgggcacucggugcuaagaaguucuacgggcgcuucugcaccggcacccuggaccacaucagugagcaccacgugguggccuggaggggcgggugagcuugggccuagaggcaggccaguggggaaaugcugggacagccaaaugucgaaguggacaagauccguaucagccaggugaccuugaagauucaggucccccaucuauaagugggcuuuugggcugagugauugcuaaggccuuuuccagucugacccugaccaggcacacacugguacauggggagcuugugcugcccuagggucccuguuccuaauguccucucccuuccaggcaucaggcagcuccagcugcuucugcugaagguagcauugcugcuggggguggaaauucacuggggugucacuuucacuggccuccagcccccuccuaggaaggguaaguauuucuaugcucccuggaaucucccccucccccaucaagaacuuggccagugucugaaaaaggaugggccaggaguguccuuuucuguuuuuguuuugagacagagucucguucugucacccaggcuggagugcaguggcaugaucucggcucacugcaaccucugccacccaguuucaagugauucuccugccucagccuccugaggagcugggauuacaggcaugugccaccaugcccagcuaauuuuuguauuuuuuuaaguagagacgggguuucacuguguuggccaggcuggucucgaacuacugaccucaagugauccacccaccucggucucccaaagugcugggauuacaggcgugacccaccaugccagccaggagucuccuuuucuaauaguguggccuugggcaagccacucugagccucagauugagcauuugcaaaacaagaauaacacuuccuuccucaccugccuuccauagcugcugugaagguguaaucugauagauaauauaucauugcuuucuaaaccagagaguccuuuacacguuuugaugauuucacugguuuguccugagaguauaggggcucuuacgacuucuacaccuuugugccucucauacccccugcccuagggaguggcuggcgugcccagcuccaacccaaccccccugcccagcuggccaacuaugaauuugacguccuuaucucggcugcaggagguaaauucgucccugaaggugagugaucacuucccucaaagaagccagcaucucuggcacauccugggccuuucuagauuguuauaacccccuccuccugccauuguucaccuaccgccaccucuaggcuucaaaguucgagaaaugcgaggcaaacuggccauuggcaucacagccaacuuugugaauggacgcaccguggaggagacacaggugccggagaucagugguguagccaggaucuacaaccagagcuucuuccagagccuucucaaagccacaggucagggacccucuugcugaauuuccccucccccugccugacuguggccuggcuccugccucucccuuccaaacuuguccucacugcaaggaacuccacacuuuucuguuuuuuuggucucagcagcaaaggagaaggaaccuguccccucagggauuaagcaagcacagcccuaguugaucacccagcaugaaaaguccuggaaucucucagagaugaaccuguguaugggaguuuugcuuaagugguacuucaagaaggugccucuguuuacuuugguuuugcacugccaugcgaccagguggugcaggucucccaaaugccaccccccuccaagcuucccucuuugcucuaaguccucaggccuccugggccugggacagaugguuguuugugucaucaggacucgugggguucuaugcguggagcacucaccgcagccuaagcugggaucccagcucagaggucaggccauguugggauguuuagggaaggugaugcauuaucaggagacauaucuacuguccccugcccuguacccccaggcauugaucuggagaacauuguguacuacaaggacgacacccacuacuuugugaugacagccaagaagcagugccugcugcggcugggggugcugcgccaggugaggcccaguccuggccaggagaggcuggguggugagccccgggaggcagaggcuaggcuuggacauagucgacaccuggguguggggaccccguccucuccugccuuuguccuggcauuaacuucaccucuaaaaguucucuuggccaggcaugguggcucaugccuguaaucccagcacuuugggaagccgagguggguggaucaccugaggucaggaguucaagaccagccuggccaacauggugaaaccccgucucuacuaaaaguacaaaaauuagcugggcuuguuggcgggcgccuguaaucccagcuacuagggaggcugaggcaggagaaucauuugaaccugggaggcggaaguugcagugagccaagauugugccacugcacuccagccucggcaacaaagugaaacucugucucaaaaaaaaaaaaaaaaaaaguucuccccugggauuuacaaggcagcaggaaucauauucugggcuaaacaccuuauaccagccacaguagaugugugucagcuccaugagggcaggcauuucugucucuuugucuguugcuugcugcuaauugccaguaccuggaacagugccaaauacauaguaagcgcucgguauguauuugcugaaugaaugaacuaguugagugccuaccaugugcuagauacuguguugagaguuaaauuugcaucucccaucuaauucucaugaguacccugauaaauuaggcauguugucucuaagugauggacaaacuaaagcucuugaguuuguggcaaguauaugacaguaaugauaugggcagaacagagccugggacacccagcagcagggugaauguugaagaaagggcuuugagaauuccaggcugcuggaauucuagucccagcucagccuucaacugcuguguagucuagggcagccccuuccuucucugggccccaggaugugcaccuucugcgcccaaggggguggcacuggcccacugacccugcucucagaggucucugagguucugcucuguugaccauacaggacuggccagacaccaaucggcugcugggcagugccaauguggugcccgaggcucugcagcgcuuuacccgggcagcugcugacuuugccacccauggcaagcucgggaaacuagaguuugcccaggaugcccaugggcagccugaugucucugccuuugacuucacgagcaugaugcgggcagagaguucugcucgugugcaagagaagcauggcgcccgccugcugcugggacuggugggggacugccugguggaggugagggguucaggaggcacagggguuucaugguuaggggagggagcugccuaguauggaggaggggauaaaaaggucugccugcagaggggaggagcuaagggcugccugguguggggauggccccuucugcugugaccuggguggauaucugggcuugggaugcaccuguuggauucucccugagcugcuuccuauuccucugacacugcagcccuucuggccccugggcacuggaguggcacggggcuuccuggcagccuuugaugcagccuggauggugaagcggugggcagagggcgcugagucccuagagguguuggcugagcgguaagaccugaguugaggaggaugugggcagggcaggacaugugacaagguucaggaagaggggcaggggugcugagugaauagacggaggaauaggcagaagaaaaggccuggcaguuccugagaggugggugcugacaggugcccucccauucaugccccugccccuuacccucacccccucagugagagccuguaccagcuucugucacagacauccccagaaaacaugcaucgcaauguggcccaguaugggcuggacccagccacccgcuaccccaaccugaaccuccgggcagugacccccaaucaggucagacccccgacacacccaccagccuucccaagccaacccccuucccccaggucaggcccucccugcccagucgcugcccuuuggggucaauccuacccccggcaggcccuuaccccuggacucaggggcuguguggccagccugccuugagaccugagcggggcugccuuagguacgagaccuguaugaugugcuagccaaggagccugugcagaggaacaacgacaagacagauacagggaugccagccaccggugagcaggccuuccucccaaggggugaccaaaauauguacuacccagcgaggcccagguggucccugcaaagcagcugcagccucaggacaggagcagcgugccggagcacucauuguuggcugguggguugguugggggccugcuggaggaacggaggggcagcaccgcacaggcagcaguuggcugccagucugaauguaagcgcguuaguguuugaaccaccguuacagccauaguggugcuggcaaccuccccugcccccaguuuagucugcugcccucuauguggccaguugcgauuucacuuuauucacuccucuacuuuauuccaaagagauuuuuuuuaaaagagaauugggauggagagcugcugauagucagcuuuaggcuggugcccuaguagaggugggucccugacuccuccuccccuacagaacccccacaugcagcagcugggcucccuauaugccugggaugggcagagggggccuugggcacagcacagccuucuuucccagggucggcaggcacccaggaggagcugcuacgcuggugccaggagcagacagcuggguacccgggaguccacgucuccgauuugucuuccuccugggcugaugggcuagcucugugugcccugguguaccggcugcagccuggccugcugugagucccuggcagacccaccucucucucaugaucucaguguaggaguuagcauauccaguugaauccuagagacagugugcuucccugcaucugccgacagucuugugagacucuaaugcauucagauaguggagagcuuugugaauggcacaggcccccaaagccaggaguagugucacuggguugggcacuggguagcagagacuacacaccuaccuucaagccuucuuguaccccagcugcugcuugcugucccuccccuccugcugcccuuccuccccucaguggggcuagguucuugucucuaguuggcuuuucucccugacaucccacagggaacccucagagcugcaggggcugggagcucuggaagcaacugcuugggcacuaaagguggcagagaaugagcugggcaucacaccgguggugucugcacaggccgugguagcagggagugacccacugggccucauugccuaccucagccacuuccacagugccuucaagagcauggcccacagcccaggugaccugaaggaaaggcgggcaggauaacugggauggggaggugugugugugugugugugugugugugacagagggagaaggcggugugugugugugugugugucagaaagaggaagaaggcgcccucugagggccagccugggagagguguccuucuggguuggagagugacugucuguucugagaguacaguauuggcaccccccauccacacugaugcccuggcucuccccgcaggcccugucagccaggccuccccagggaccuccagugcuguauuauuccuuaguaaacuucagaggacccugcagcgaucccgggccaagguggagaguuuaggcagggcuggagcugagcagggaggagugggcagggggguacccaguggagauccuggggugauggugaggacauucagaaaguggggaggacugggaccucaaaacaucacacuuagagcuguuaggacuuauugcaggaaaaugcagaggaugcugguggcaagaagcugcgcuuggaggugaaugcaggcaggggcgggucggucuccuaccccacauuuuauccccuuuccugguacugucuucccuauuucucaucccaugucuuguuccccaccccagguccuguaacccccccauccagccucccugccuagucucacuccccuucccuucagccccuuguguucaucuguacgcauccccucccagcuggcccugccccucuacccucccugccugagcacuuaccuccuuagauggaggccgagaccccaaguacugaggugccaccugacccagagccugguguaccccugacacccccaucccaacaccaggaggugagagccaggcuuugugugcaggcagaggcccggggagggcagggcaggggcguuucaugggagggaaagaacuuuggagcuggccuuggcuccaccugacccuguguccuggggguccacgcaggccggugcuggggaccugugugcacuuuguggggaacaccucuauguccuggaacgccucugugucaacggccauuucuuccaccggagcugcuuccgcugccauaccugugaggccacacuguggccagguggcuacgagcagcacccaggagauggugagugggccugggagaccuccagagagacucugggccuggcccugcuugggggacacagagcuugagguagagaggcacaggauggaaacaggcucaagauggcacuucguucuccugagcucagggucuucucuguccccugcaaagcuccagaugugugguucugaggaacaggaggcuggcagaaauucaccugcaaaucugucuuguuuuccccaccuuccuucauaaacuguugcgugucugggcacugggcugcccacaccaaaugccuccuccccucucuacccuuuccaggacauuucuacugccuccagcaccugccccagacagaccacaaagcggaaggcagcgauagaggcccugagaguccgguaaagacugaaggcguguauguauauuggggcaugggaagaggaagagggucucgucaaaccagcgcuuugcuggggguaacugaaugucgucuucuacuagcauguaagcucugugaaggcagggaugccugucugcuuacacuucuuguucucucaaguaucuaaaacacagccagacacuguuuguaaaugguuuuaagugaaugaaugccaaggcucaccuuugcuccgaagggguggccucaccccccgaccucacuccacaugguggcuuuuccaggagcuccccacaccaagugagaauagcaugccaccaggccucucaacucccacagccucgcaggagggggccgguccuguuccagaucccagccagcccacccgucggcagauccgccucuccagcccggagcgccagcgguuguccucccuuaaccuuaccccugacccggaaauggagccuccacccaagccuccccgcagcugcuccgccuuggcccgccacgcccuggagagcagcuuugugggcuggggccugccaguccagagcccucaagguaacccauccucacagaugugcugacccagggugggacagggugggagcacuggcuuccugcagaggaauucuggggaauacagagggaaguuguggggaucccaggccguggcagccucuccucugcuccauucuucucaguuccucccaugccccaacacauacauucagucuuuaccagacuugcagggccuccgucaccaccaugcucuuuguugccugacuggggcaggcgcuggaggcaguagaacgucucaguucuucuucucagcucuuguggccauggagaaggaggaaaaagagagucccuucuccagugaagaggaagaagaagaugugccuuuggacucagauguggaacaggugagugggccagcgugcagccacaaaacgcucuccagcccacuacaggagaaaccugcacugguccacugcacccuucucuuggaaugucuucucacuuggccugucauaucucuggccucuaccuuuucuaccagagcuuaccccacuucagcacggguuauuuucugccuuuccaaacaacacuccuauccaccagggggcccaggcccuaucccugacuggccugacccuccuauaggcccugcagaccuuugccaagaccucaggcaccaugaauaacuacccaacauggcgucggacucugcugcgccgugcgaaggaggaggagaugaagagguucugcaaggcccaggugaagcccggggguucccaaaauucugauggggucaaaguucugagacugagaucagaguuccuccagugcucuguucuugagcaaccuagagacuccuggauauucugucuuguaccccucagaccauccaacggcgacuaaaugagauugaggcugccuugagggagcuagaggccgagggcgugaagcuggagcuggccuugaggcgccagagcagugagugacaagcuaggacaccccucugccuucuagcacuguguucagcuccacgcuccagcccguaggagucccaguggcuaugccacacagcuaacacauaccugugacacccggcucuccugucuccccuaagccuguaacuccuguggugcuggcuggaagccuccugaucacccuacccaucuuccuucuucucagguuccccagaacagcaaaagaaacuauggguaggacagcugcuacagcucguugacaagaaaaacagccugguggcugaggaggccgagcucaugaucacguaaggggaaggggauggugacaguggcccaugggccaggcuccagccccuugggcaccuuagacagcucugcuucuacaaucccugaccuccacagggugcaggaauugaaucuggaggagaaacaguggcagcuggaccaggagcuacgaggcuacaugaaccgggaagguaggugaaauguggggagaagcagacacaucccagggaugugucaugcaagccucaugaucucagauacugaccaagcaacaugaugcucuagucuguguaccucugagacaauucaggaggaagccagaggagggggcuccaaagccccuucucacuucaguucaaucagagcugcacaguuggcuuuuguauaagaucuccuucaaaaaaaaucgugcugcucaguagugcuagaaaaccacugguguuggcaacccuccuaauuuggcagcuuaggaaacaaagcccggguuauagaaaucacauaggcugggauuagguuguggcccuccugcuucccugcccaguucccuguucucuaagcuuugucuccuccuuuuagaaaaccuaaagacagcugcugaucggcaggcugaggaccagguccugaggaagcugguggauuuggucaaccagagagaugcccucauccgcuuccaggaggagcgcaggcucagcgagcuggccuuggggacaggggcccagggcuagacgagggugggccgucugcuuucguucccacaaagaaagcaccucaccccagcacagugccaccccuguucaucugggcugccuggcagagagccuugcuguuuacaauuaaaauguuucugccacaaac

SEQ ID NO: 16243 - RNA, 15991 nt, Homo sapiens
cuauuaauucaauaaacauguagauuuauuuuaagucaguuugguacaugauacagauugguuuugcaguuuuuaaugaacugaaauagaaaugucuaaauacagcaguaucugccugugcaacaaauaucuguaagguaaaauaagguauuugauagaagaacaucugcaagaacaaaucagaugaaaaaucugaaaagguuucuauauaccuucuggauuuuaaaaaaacccaaaaauuaauggcucaagauacuacauugcuaaaguuaggggaaaaaaguaaaaaggcugugaguucuguugcaagagcucauuuguagacuugcaaaaucuaacuaauuuuauauuaugcuuguuguuagagcagugcucaaaauuacagaagcuucaaauuguuauguuuucacaaaauuugcuacauauguugacaugaaugugugucagggaauucauacccagguaaaugacaauuacaucaguauagcuaauuuuugccaccuugggaggaauggaauucugccuauuuucgaauuaauccuacagcacucacuaaaaacuaacagccauggcaccauaauacauuuugugagguaccuagaauauuacuaauggaaacaaaaaaugugagguaaaccgaccuuuccccaagaaacuuugaagccagagauuuuaaacaauuaaggcacuugaaaacauuaaguauauguacaaaugugcaaguaaaacaaacagcuguaccaacgaguaacaaagaaacaguaaaucuucaucuuaacaaccuuuaauaguuaucuaaaugcagaguuuguuuaugaaaugaaacaaagcaguuugucauuucuuacuauaaaauauugaaaaucaagugcgaaacucagccacuauuggcuaaagaaacuaaauaaaaaacguuaaugaccuagaaaagcaaaagcccauuuuaaacuacuuaaagccucugcacuaguccaaugagucaaaggcaagggagaaguaaaccucuaaaacugaagacgacccucuaaaggagaaaacuauagaaguuaaaguaugcaugcuuauuauacuaugggaaaccaagaaggaagggagagaaaaagaaaaagcacagucuauucauccaggacaaucaguaaaaaucuacaguaaccugaucaaccaaaaaauccuuagguguugugaaauuacauuggucacuucuguuaucuuaaaacuuaaaaugauugucucauuuaaaauaaaugauucuaaaauaauaugauugucucauuuaaauaguaaaugauucuaaaauaauguauauccuucuugccucaccaaagaagucacuacucaagacagucugguggaaauccuuucaagguacaauagugcuagcauacuuuuuuuuaaaguacaaaggaaaguguaauuaaaucaauuuagcucuauacuuuucaacagccauaagaaaaauguugggagguucaagauacgaaggcuuucaauucuguauaacagacuuuagcuuaaguuucuccgcucugaaauaaauuuucaauaaaauauuaacaguaugauaucuaaaacagguuuacuacugcucacaucaaguuacauccucugaccaauccuuaccuuccuuaaugucaaagaacaaaucauagacauuaagcuagagcuuaccuuucacugucuucuaaggcacuguucuuuauauucucaaugacauaagaugcuuuacaaguaugaacaauaaucuguuauacacacuaaugguauccuuucauuucuuuaaaucuggaauguaguuccuuguguggcaucuuauuucuaauguagaaaaaacagcuguuaucaagcacaaaauuuuaaucuaaggauaccauuuaguacuacuaaauuaauaaauuuauuccacuuuugaaaugacagccaaaaauccaccuaauugauucucauuuggcacguucuucucaauucuguucacuaaauuaaaauuacuaaauuuaaacugccaagagccaugauguugucugcacaagacaacauuuuccaucacuuucagaaaguuauauuuggcauguuaaggaaaaaaaauauaaucccacagcagcagcuauuuaaaauaagacagccacaggauucaugcagaauauuuuaaauauuccuguugaacacaaugauuuaauugauuuuuucuucacggaugaugcucccaaacauccuauaugcauccauggaaauuuaaagauccuggaauagcgucuuccaugugggacaucuuaaaagauaguauuuuggcuucagugaguuacacaaaugaaucaccaguccuuauuaauucaaugggucuguuuacagagugugguaauuucguucuuuagauuugcagaauuuauaaagaaagaaaauuacagccugcacacccaagaccaggacaauuccuccaaugaaacuggcugcaucaaagguagacuuucgcacagguugugagguuggagucacaguguuauuuguuguaccuguuagauaagacaaaagaaacaacaauccuaaguuucaugguccucuauuguaauuuaaagaugcaccugagccucuauuuugccauguguuaaauucuauaaaguauuuccucaagucuuuacagcuagaauuuaucccuaauugaggaagacaaccauaucccauuuuucauuccacccaaggauacaaaguggucaaugcuacuguacuaguacaaauauaaaaacaaugggaaaaauucuccuaguacauaaauugugcccugggaauguaucaaacacuucuaaaauaugcaacaauuucuucagacuauguacuuuuaguuaauugugaguguaaacgucaauagugcugagaauucacaugacuuuugaauuuacuaguauaagguaaaauauuugguugcaauuuuucauguuacaaaaauaaucuuaauaauaugcaauuuauaauuucaacaaguaaaauaacuguuuuuaaaggcauauccugccaacaaauuucacaugagaaaguauuaucaaguaauaaggaaaaaacaaauaucugaauucuuuucaggcaguaaaauguuucaagaggaaacagaaaaagcgauuuccauuuaaaauaaucuaagaaaaaaguaacaguuaucaaagaacacugguucugguggcuguacaaguugguaacuuuaaugacaacuguuuuguauuccuucucgugaagacagaauggcuucacugaaacugagaaaaagguggcauaagcaugaagaaaaagaaaucacaaaaagcagguagaagauucauuagcaucaguuuuuuaaaaauauggagggaggaaaggauuccuaaccuguguaccuacaguauccuguggcguaaccuaacuaugaauuaaauuagauuaugucaaaucaucauuuaauaacaagcuaauuuucacauuacugagcaauguuaagaaaugguuaagaaagugaggugcacaucugguagugauucuggcuuuuuagaccuuucucagugaaaaggacggauauauuaucuucccucaaaucgccaugcucucucauacagcacacaaccaaucccuaacgguaaucagaaguuacaaauuagauuuuacauacaaguuguacugaaauguuuggaaaaacauuauuacuuaauucuaaagugucacgucaaaugugauuacacauuuaaaaaugagaagaggaaucucagcaaagcuaucauuauuguguuaacaaagcacuaccuugauccccccuaagaguaagagaagaauuucaguuccauaaccauuaacgaagaaagcuggaaaaugauggcagaaauuguaaagggcaacaucgugcacacauccugcaucauugcuaaucuaaaaagccucaauuaccugauguaguaacugucuuggaaguuguagaaggggagggcugaacuguggguuuagcuggaaugaaaacaaaaugucuuuuuaaaaaaccuuaaauuucuagcuucccaguuaucuaacagcuuuaaaaaauaauccugccaacuucaacaugcuuucaauuuuuuagagaccaaaagccaaauuucaguuaaugguucacuaacauagcuaugcacccaagaauacuaggauuuaaguguauuuuaaaacaauaagcaaucauaaaauuguuaauaucuauguaucuaucuuguauaaaaucuauguauacaucuggauaaaauuugcgaaaacucuuaucuugcucacugccaagggcaagaacauuuaggugaggaaacuauagguucuucauaaucuuucuccuaagacaaaaacuauuaaagucguaaguucucucuuacaaggguauugagauuugccuaucuucuucacuucaggaguuggcaaacuuuucuuaaauggguugaaagcaaauauuuuacucuuugggcacugugugaugcaaaagcagccaaagucaacaugcagacgaaugggcaugguauguuccaauaaagcuuuauaagaacaggggcccugggcccacaguuccccaacguaagauucuaagagcccaagguuaaguaagcucuaguccaccacacugcaugaggccaaaauacuauuugaguugccauuacuaaaggcaagaacugcaauuacuuuugcaccaaccuaauagcugaugauacugcuaaagaaauguacacucugagaaggauuaguuugaauguaaaaucauuuuagggacuaaagcacucuuuuuuuuuuuuugagauggagucucgcucugucacccagacuggagugcaauggugcauucucagcucacugcaaccuccgccucccagguucaaacgauucuccucccucagccuccuguguagcugggauuacaggcaugugccaccacacccagcuaauuuuuuauuuuuaggagagacaggguuucaccauguugaccaggcucaucuugaacuccugaccucaagugaucugccgccuuggccucccaaagugcugggauuauaagcaugacucaccucguccagccaguauaucaccuauuaaguuucuauugguaguaugaauacuaauagaagucugaccaaggcuuucagaaaggaaggaugugaauauaguuucuacaaauuaacauuuuuucuaacauccaaauggcuaccaaauaaauucaaaguuugcuggagcauuugagaaagguuucauuaagagguuguccuaaggguaggguucaaauuuuuggaaagugcacuauaggagucacuagcuaagagagcuuauuuugucucaggaaaucauuagguaagucaggcuucagagugcaagggcuucaauaugaggauaugcuuaugcuggugggccgcuagggaugaucuggggaaagaugaggaagauuaaucauaugagauuuauauuuuuauaaaaauguaaggugcuaugcaaacauucauuuuuguacuauuucagaaaaaaggguuugaaggcuaaagagaauuuggaaaacaaauguuacuucuguuuaaaguacauaacugaacagacuucaaagugauaugcuuaacccacgaaagacagggaaagggugccaaauaacuguugaugaagcacagaaaugaguaaucuuuucacugcauuagacuuucaaacaaucgaacaaaaaccucaauaggaaucagcauccucccaaauucuacuaauauaaaagaggaaguucugugcuuuaacaguaaauauacacuaaaagagcagggcuugacaguuuucagauauugcuaaauaccugaauuguugcuaaaaguagaucuuuaaagaccaggacucucguaacaggcugacuacccauaaucccaagguugacugaauccuaggaaacuaagguauucuaauuuucacaugaccaugagucacagagagcuuaagacuucuuuuauuaauauugauacuacuuagaagcuaauaggugauauacaaauaauacugauggauauguucagacccauuugcuuucuuuuuucccucuuacuucaagcauuguuguacauacuuccauccauccugcucuugauuaaacaguucucucaacucuccaugcugagaaaaucuuacaggaaaauauuugaccuuaucucugguaagacugguccuuacacagaauucuuagauuagaggcugugguuauguuaaagcucauuauuucugucaagguuuuuacugcuucuguguaaccacaaaaaaauacacuuuacaaauuaaacacaucaaauucuguucaaucucaaaacacuauuaccaauuguuugacaauguuaggaaaaaaauucugcaaauuugcaauuugguucucauuacccagccucagaacaagguaaaaacuauuucuuuuuaauaaguaggcaaaauauuuuauuuucgauuuugaaaaaaguauugcauugacaauauuuucaaaauaaaagcaccacuuagggaauauaccucuguugaccuacuguuucuuuuacugaaaaaaaaagauucauuaggaaagguuaaaaaaaaauaauaauaaucauaaguuauaaaaguugcuauuagugguaagaaaaucuagaaaaugccaaaaaaaauacugaauuagucccaucagaguaacagguuacuucuugccauuuuucuaggcauguauauaacaagagcuaaaauuguauuacaauugcuuaauacaguucaucuuccacuucauaugaacauuuuccacuguaucugacauauuuuggcuauucuauuauuuguacugaaggagggccauuauaauuaaccucauuauacacccuucuauauaaauuagauucucuuugcauuguuuaacuaccccuucacuucucacuugcucucuucggcagacgguacacaugcccggaaaagaaaccgccuaaagguuuguucuucaacuagugucagucaacugaugcauuuucugcagauaagcccuugcugcuuucccccuuuacagcaccaaagagagcuauagcacaaaagacucauggcaauucacaggaggacccaggguggagaaagcugcagagaacuacaucaagagugaacccaguucucaagaaaugaacaacaguucugaauaaauuguucccccacucccugcaccccauuuucuuuucauaaccaaccuucugaaaauuacuuuucuccaaacaccucugguuucagcaaccuucaacauccuacuuagucaaugucuucuaaugaguguuaaauauuuacgaccacaucaccauauaaucaucagcucaaaauaaguuuuguaucauuugcagacuuccauggcaugacuauuuccaugguaaccaguuucaaguuaccaacaugguaucacugaacaugggcugggaagagcuacuacacaauaacuggcuagcaaaagcugguccaagccagcuccacacaccacugcguaaguguuucaagaugaguuguccuuguuacagcauuugacuacuucuuccuuugaaaaacuacgcccacaaccacauacuguuaguuucuugcacauacuucucugggcuuuuuuacuacccuacccccaucccuauuuccucccgucuucuuccuagcccuuagacauuacuguuuccuagagucuggucuucaagccccaucccuucuuucuauaugcuccuccagugccucuacuacugccuaugccuauuuauauuuuuagccaagagcucuugccugacuugcaguuuccugaauacugaacagaucccacuuaaauggauucuagguaucuuaaacuaaaaucccaaaugacaggcccaaccaucaauagacugcucuuccucuuucuugcuuacuuuggugaaaauuccuccccuucucccuaucacucuaccucuccuccucucagucaugaaguccuaccccuucuacuuccuaaacuuauuugcaaacaucugcagcccaccucuaucuguucucuagaauuauuguaacaggcuaucuaaucuccugaguuccuucuggcaucguuccaaucuacucuccacaaugccagaauaaguuguuuuauuaaaaugcaagucugaucauaugaccuauaaacuuuaaaaucuuucaggauaacaucuaagucuaccagcaaggcauacaaagguguuucccaauucugcucaccuggugagcaacuggugauggaccagcuuaacuccuucucaccuuguacaggaugggacacucuuugaacucaccguacuacuucacaucuccuccgcaugugcugacccgcugcuccacuucagaggcucucuccaaguuuuccagugcaguuucacuaccaagcuaucaccacaucugcaucccacccaauacacauuccuucuuacaaauuucccaauacgcugugcucacugagaucuuucauuguuccuacaguagacaaaaugcuggcuuaacccuaccauuuacccuaguacuugucuuggaauagacgcauuuaauauugguaaaauguuaaguauuuaauauuuacucuuccucucaaguuaguaaauuuuaaggaguucuuauccaugcuguugagggcacgguaaaaacuuuccagguugaugggaaugaaaauaauaaaucuuucuggagagccuuaaaauaaucauacccucugaccuagaaauucuguuugacucaaaccuaucagagauaaauacaaaugcaauuccauguaagauguucacugcauggagaaugagagacggccuaauucucuaaucaagagcaggauggguaaaguguauaccauaaugcuuacauuaagagagaaaauacaggcugggcucgguggcucacaccuguaaucccggcucuuugggagucugagguaggcggaucacuuuaagucaggauuucaagaccagccuggccaauguggugaaaccgugacucuacuaaaaaaacaaaaauuaguugggcaugauggcaggugccuguaaucccagcgacucaggaggcugaggcaggagaaucgcuugaacuugggaggggaagguugcagugaaccgagaucguaccacugcacuccagccugagcggcagagcaagacuucgcuuccaaaaaaaaaaaaagaaaagaaaaaaagaaauacaaaggugcaugaacguuaucguacaauuucauaaaaaguguauuuauuuagauacacauaaaaaagacuagaagaaauuaaucacugaaaacauuuugguugcucuggaugaugagaauuauaauuugcuuuaggcuucuauauuucccaagauuuccacuaaaucuauaaaaaguacuuuauagacucaauguacacagccucagcaaaucugcucacauucaccgacuauaaaacacuggagcuaugugucacugucacaaaagguagagauuaacguuaauugcugugguccaagacuuuuaaguuuuuacucaucuuuaaaauuauacuaacaacuuuuacauaauuauuuaaaacuaauccaucaagaaagcuuaaaaauacugaaggaaaaggaagaaaacagucaucuugaauuaccuguagaauuggcuguuggcacuggaguggccguggaaacuauuaaaaaaagaaaaaagaaaaaccauauacaucaaagcuauuuaaaauaucacaaucuauaacgcuaguuccugaccugcaaucauuugaguacuuuucacaauuuuuacaacacuuaaauacuaccuguggaagagacugacaguugcccccaaauaccagucucuucuuuagaaauagaaucaccaauuuuuaucaacaccucccuuccuccugaaaagacauuuccuagucuccagugcuuccaggccaucacgcauaaccucuaggaagcauccuuaaaguaagauacaagccucuuucauucccuucuucauccugcuggcaggaaaauaaucaaugugauggcuggaacauaaggacccaccuuggacaguagggucaaagccauuuuugagaggugaaagaguaaaaaccuaaagaagccucagucccuaaugguugcagagcugaacucuaguccagacuuccuuuacaugagagaaaaguaaaucaguccacugcuuaagccauuguaauuuggggguuuauguccuucauagcugaaacuaauucuaacugguacaucaucaaauaugcagcaguacaaauacaguuuuccuuuaaaucaguuuucaaaaacguucuaauacuaaugaaaucuucauuaaucuugucucuaagcaauauuacaaaaccacaggucugacaguuauuaguuuaucuaacacauauuaaaguaauuacuuaaaauguuucagccagguccaguagcucaagcauguaauuccagcacucugggaagccaaagugggaagacugcuuaagcccaggaguucaagaccagccugggcaacauagugagacaccaucucuacaaaaaaauuuuuaaauuagccagcuaugguggcaugcaccuguaaucccagcuucuggggaggcugaggcagaaggauugcuuaagcccaggaauaugagguggcaaugaguuaugauugugccacugcacuccagccugggcaacaaagagacugucucaaaaaaaguuuguucguguaccaccuaacuauauuaugcacccugugugaaguaaaacugaucuaauacuaaugaaauguucaguuacaaaauucacauugggauggggcaaccccuaccaaaauuaaagagucaaagguagucuuucaagguuagacacacugcacaaaaaucuuuuuccuauucaauuauuaucuaugcaucaaauuaggaauaugccuuucccacugauuuacaaucucauuggaaaaaucagcagcuucaaguagaauuuuaacguuuugcuggacgaauaguaaagguuaaaaauuaaucaaguuacucagauuaaaauacagaaaauggauggguauagaaaagcucauuuaaccacagcaccaacuaugcugcagaauaaauuuaucaaucaacaauccccaguaucgcaacaccaaaagugccagaaugagguuucccagaccugcaagaugcaaacauagcggcuaaacugugaugaauuccuagaaaaguuuaaaaaaaaaaaaaaaagugugggggcagacaacgcauccacacuuacagcauccacacuauagcuaaaucacuaaaccaagcuucaaauaucauccuuuaaucaaucaauaugaauauacuauucauauuccaauucuaacaagaugagaauuauggcaaugcuucaaacaaagcacugaaacaaggcuuucugaggcaaugaucuuccucaccucucugcggucagcuuccaagcagccaauaugaauacuuaccggaacagaagucugucguguuccccacuugacaaucacuaacuguugaguuaugugaacaauagcucucaucuguuggggggcaggggaaaagagacaaacagcaucaaccacccauuuguauuaucuuugacucugcuacuaagcucuaugaaaucaaacccaaacacuuuagaagugggcagggggaaccacuuuagguguuuugaccuaaaguuaaacccacagaccaaacccugucauucuccuuuucccacugacuuagagauuacgcaggauccuucuaacuuuuauccauuaaaaauccacauuaauauacugaaaaaauaaaucugcaacacuuagaucucagaauugugggaagacuacuguacaaucaagaaaggcagccaucaucuaaaaagugggcagguggcucacgccuauaaucucagcacuuugggaggccagggugggaagaucaccugaggucaggaguucgagaucagccugaccaauauggugagacccugccucuaccaaaaauacagaacucugucucagggaaaaaaaaaaaggcggagacaguaaguugaaguggucagggucuguauuaagagguuaguaaacagaugaggcaccccauaacacuguagaaacucuauuccaaaucucacugcuuuagucuucuauacuuucuaaaacaacuuuccuggauagguagacuuggaacaagaguaaggggagaaccuuucccaacaaaucuuaaaguagagcauuccaucuccaaaauucaccaacucuuacauacucccauauaaaggggaaagaguacgcccuuaaaucccauuuuaugaccuaaaaaaaagagacacuucuauaacaaaaaaguuaauuuggcccaauuuaguuaauaccuuaaagagcuuuuugaaauuuauguagugauauaauuucuagaacuauuaaaauuuuuaccaaauaaaaaaacuuaugguuuguuuuuacuuaaaaaaaaaaccgccaaaacaacuagauuguuuuacugauaagugcaaccacuuuacauuaaaaaacaauuaaaauaauguaugcaguaauaugguucuaauaagaaucuuauugaauuucaauguacgucccuuuagcgcucuaccucuuguauuaacaaaagcacaggaagucaacucucccuaccucuuucuucucuacaccuaagcauccaacaguuucauaaggucucuuuauauuucauguugcaggacacaguuuucaacacaaccuucacucacagcuaauuccaguguauuaaaguacucucaauccuuagaacaggcuuuaaaaaaagccaggugaggaagcacgcaucuguagucuuggcuacuagggaggccaagguuggaggauugcuugagccuaggauuucaagaccaaccuggguaacacaggagacuccaucucauaaaaaacaaacgacugagcuuuaauuaucaagucuuaaggaaucuaaagggaggaugggagacaaaaagagauuuucagggggagugcgaggcaacuggcacuuuaaaggaguacuggauuugcaaaauaaauagugcacaauauccuaaauguccuacauaacuuucaaguguucaagaauuacuguauuuuaaaaugcuauaacaaaacaguuuugcauccccaaaguuucuuaccuuuacauucuauccaaaagcagguaguauuaacaacgcuaacauuaaaacaggaaacgcagcuguuucgaccuucacagguuucuggggaguuggggggagagaugcaugaaaucaaugauuuuauuaguaucuuauuugaaucuguauuacuuaucuuuuugaacaauaagcauuacauacagcaucaaaauuacuaauucagauaaaugauaaaacuuuauacugguuuacuaagaaauuccaaucauuacaaagcuguaaguaaacgcauuagaaaaacaagcuaguggucacucucaguacagugccugaugguaucugucuaaccaauccuuuuucacaggacaacuauuggaagacacccacagccacuaaggauuuaggcauuucaaagcauccuuaauacauaaaaauaucgagaaaaaggcuuugauauaauaccaacacuacacauaggaaaaccacuacccccaaacaucagauaaaacccugagauuuuuaguaguaacaguaguaguuuaacagguugaacccaagcacugaugaugcccauucugcugcaaacaaagauaauuucccagggauucucgauucauaaaugauccacucucgacaggauccuccacaacuggagacaacaucuaaaagcccauauucaagugcauacaauucagguuaacaagguauuugucaauaguucauccuaggccaaacaauccagaaacaaguacucaucaccauaauucaauuucuggagaagaacggacuauaaaauugggcucuauuuuccagugagaaaaagcagcaaaauaaaagaaaaaaaagaauugggcuccauucauuuuccuagaaacuagaugccuccaaacauucucguuugcuuugcuccugccuaaaaaauaguucugcagaggcacugcuuucaauacuucaucauuaguacuuauuaaagacugggacauguacggugggguggggaaggguucauaaaguaaaaauaaauuuucugaaguuuguauagauaaaacaugcuguuuaaaaaccuuugugcuugacggguguagcaaagugaaaugucugaaauguucuuuacaaugaacuaaacuugcuaccuuucagaccacacuacauccacuuaugauuuccagaaaauacauaccuccuuugcacgcacuucaauuacacaaagacaaauuaauuugauacuuccaaccuucucuuacacacacacuacaauucugaaaggaaacugucaaauuaagacugagacaaacauauucugcucuaucaucuuaaaauagugcgguuagaauucccaguauuauacugcaauuuacuucccucguuuugaaauguuaccauuacaucuuccuuaaacuaaaaacaaaacauuaaguuuacuauauacuuuauuaaacuuuuauaaaauacuaaaacuagaggagaauuuguagaauaugaaugccgugauaaaaaucauuacacuucggcauucuucggucaagaagccaauguuaacuacguaaacauuacuccuuaacuaauguuaacuagaauaaccaaucauacgagacugcagguuuuaaaccucuaguguuucucccgcuuauuaccucaaacuuaucuuccuucucucuuuuguguugucacgguauauggcaauuucugcuuuaaaauguauguaugccuuaaccagcccuaugcgacugcacauaacaaaagacacgcuccugaucggguuuuagaaaacccacagaccugggcacaaacccccguuccacgaccuacuaaacauacgcuaucugagcacaggacauaguuaagaaaauuuuaaaaacaauugaaaaaagaauaaacauacaaugucaggagaguuuacucaucuccgucucugcaucuaccuccuagguuucacuaccuaccuuccaguuuagccuuaggauacguacgcaaaacacccgguacauacauggguacuuuucuuccuuuucgcauacuuugaagugugaaguuuucacuaacuacgugcucaaacgucagcuacauucuauuccuaucugcaaaaccaauguaauuaaaucucaagcgaccuucucagacucaagucugagacacgaacgagcauuaccgucuuuaaguuucucuuucccggacuuccggagaaggcuaccuccggagagaggcgccgggagggugaacaaccaguggcagggagaggcagcucggccccaccgccaaccucagaggcgcgacgcccggccccauccucaaccccaccgcugcccccgcggaaggaagccacguccccauuuccgaccccaagugaggcuaggaauuacgaugcacuuuuaaaaggcaccucgacuugcaacacuucgaggggggccccagccccgcagccacugggaaccgcgcguccgcuuccccccagcgcgcuccccacccggcccggccacgaguggacuccaggcuggccgccauguugccggagucgccgccgcaccccgagcgcggcccgcccgcccgaccguggcccgaacccgggccccgcccgcacggcgaggaggcagugcggcucggcugggcaggggagggcgggaagcccacagggcccgcgcccaccuggugccggaguggugaccagcgggagggacgucaccggcgccgagguuacguuggagaugggcgcuaaagucgucacguucgggugcugggucguguucuuguccgcggacagcacgcagagcacgcccaggcagguggcggcccaaagcagugagcgggagagccgcgacaucguguccucagcgcuggcguucgggagaaagcuaaggcucgcaacgcucagucaaccccucaauccccugcggcgccgccuccgagacuacgcucccccgcgggagcgcgcaggggucacgug

SEQ ID NO: 16244 - RNA, 2948 nt, Homo sapiens
uuuuuuuuugaauuuuaaaaucuuucaauauuauuuaaugaaaaagucucacacugucauguacaggauauaucaacauuuacuacucaucugucauguuaggaaaaacaucauuauuacacgcuuggaaaauccucaaacccaucucuaguggaugucugucauaauuuaaacgguauuuuccccauucaaauaaaacaaucucuuguaaagcuacaacaguuauauaccaaagcaauaccuaguuacaugcuuuacacggucccgugaaaaaauaauuuaauugcuccuaaucccugaugcaaggcacuucaaagcacccgcacaaaacguccauguaaacagcaguacagugcaucauuuaaauaacauaaaugacuuuuacacagcuugaccuaggaaaaaauaaaauccaucauagccacagcuaaaaagcauguuaagauucacaacaagaauuuguuucucuuauuauaaagagaagagcaaucauaaaaccuccugggggugggggagaccucauaaauauuuuauauugauugacaaaacagcaugcucccuggguauguaugaaaucagaauauucaggaguaacugagaggaugcaaaugacauuucuuaguacccagcuuuaauaucuaccaggccugguagucuggauuauuuguagcaccauggaaaacucauuagaaaaucacaaagguauauaccucaaccuuuccaugagguucauuuaauuauaguaaaaaacagcagugaugcagauaaagaaucuuuaaaauuauuggcuuacuggauuuaccuagcaagaaaaacucuauauuacuuauuuuaguacaucucauguacauaaagcaccaguuuaaaugagauuaucaaauaucuccagcaucuuuuugcuuagccuaaaaguucauuucuuaucacuuuccauggcacauucuuaaagccaaggaagauaaaacuagaaugguuauaaauaugaauggagaaauucaguuccuucccuaucauauuuacgugucucaaguaaaacauagaugaguggcaaaaggucuacugcauucucuggaaccugccaccccagaguaguuacuagcuacuagaggauuaacacacagggcugagcaggucaaagccagggcucugucagguaagggccaguuuuuacuacugagcaacccacaaacaccacugguaaagcaaagaggucugagugugcauauagcucaggaaacccugaguuuacccuuaguuaccacuaaaaacuaacaaaugagacucugcugaggcuuaacuucauauacaaaaaucaacaccuuugccucuuugacagugguaauuauuagcaugcccuucuuagguauaaaagggauaaugguauaucuagguuuaugcacaguuaagaaucaacuacaaauauucagacuuguauuuuaaaauuacagaucaaaagugacucccaaaagaaaaucaauuucuucauaaaugaaacauaguauauaaaaagcuggaaugaugauuaauucaaauacaaaagcuaguauacaacaacccuacuuuuucuuccaaacuacuuagguucauacgguucacacuaccacacaacuguucuacauuacaauuacaccacuagaguaaaauacuaauaaaacacuucaguuagcaagcugagguucuacuuguugacaacugcauuaaaacugcagcauuuaagcagagcugagaagcaccguucuuaagcauggcuuucuucuuccuguucuuguguuccacagugauuauuaaaggaaggaauuuggucuguaaaugacugggucauccacugcucauuaggaaugccacugaaaguugauucuccucuuaacuccaggcucucaauuagcccauuugaagagaagcugcaagguucacugucgcauggauuuucuccguaagcaccaccauaugcugccucauaacccagaucauauuuuucuuccuuaacagccaucuucuuugcaucuucuugggcaagcuguaggucaaauguauauugcaccucuugaacguccguauuucguucaaugccucucaacugaucucuuaagucuuucaguuuuauguaguaaugaacuuugucuugggcccgaggaaacugagcacuucuugcacuggaugacggcauaacauagcagagaguuucugugccuggaaucuuauggggcugaagcccaaauuccaaguucuuaaccuuuacaccaaaaacuucuuuacuaaaaauuucauaaauacauuuuccauuaaacacugcuauucguggcugauauuucuauaauuucuguacuagaauacguccuccuucacgaaauucuuuacuggagagaucuuugcugccaggcgugguccuuuccaccauguugguaaauccaauaccauacuucccugguagagugugaucauccauaugguucaccuggaccucacugagcccugacauaaacaaacacuuccaaaaaugguuuccagguccaggguaaugaugcccuuuguaagcagccauuagacccggguuuaugccaauaaugacaauguccagauugaaggucaaaauaucggggagagucuuggucagaaguucagcuucugaaacaccauuaaaacggucuacuuuucuuuugacuuuaaaugugucuguaauuuuucuugcuuuucuuuugauuuugcagacuugcuagauuuuuuugacucaacagguuuuuuggguuccacugguuguuuugguucuguuguucuggguuuucuuuuucuuccuuuuggagccucuugcacugguuccugagcaggagcuggggcuggaacuucuucuggcauuugcuguucauucacaacugccauauuaggagcuucagccaucaguuguugaaauggaaacguauaaaaagcuugagcuugcugaagggaguagc

SEQ ID NO: 16245 - RNA, 2176 nt, Homo sapiens
cacuggauacgcggaugcugcgcggcuccgggggcugcucgcagccgccuguucauccgcggcgggcacgggcggcucgcggcgccccccgcggccgccaccuccccgccacacgccaggggcgccggcgcccgcucggaacccagcccugcuucucagcuccgcgaggugggcuggguugcguguggaguugguuuuugagcccguccuaggagccgcugaggaaaaaugaaugggggugaaaggagaagguugggcggcgggaggucgcgagaccugaggucgccuggcuagagggccgccgucccccggggaggguugacugagccugccgccucgggggugcaacgcuggggucucggggaaaggaaaccacagcccggacgagcuuccccccacugagcugccagaauaguuucccccuccgggggccaccgcagagugcgcggaggcuggagaccccuuggagagguccccgcgccccgcccggccgguccuccacgcggcgcugccucggacugcaauggcaaugaagcuuuugccucucaaagaacuacuuagaaguaggacaucucggccuucagccccuucauuucuuuuuccccuugguccuucucucuuuaucucucucucacuuaugcccugcuucaaaguaacagcuuuacgcgugaccccgccugcacccuuaucuggguguccuggguuucgcccaaaagguugggcugagugggagcuucugggagcgcacggucccgcguagggucccgcucacccggaccccgaacgcccucgccacgccccggugggauccuccccuccccgccugguugcacuuucuccucccgacuucccagcuagcgccugcccuccauggagcggugcucgcucccucugcgcucacaaguccccucuuuggcccucuccugccacgccuggggccgaggucugauugagucugucccugucccuggguugaggcauugggggugacgacuggaugauguuucugugauacgcgcggcucugagcgcucccacacguugcagaggacacauugacguucccggcuucuccuucccgcgccucgacacuucauaauuaccugacacaaugcgauauggggguguccauuguuccacugcauguuacuguggaguguucguuaugacagugguggaacuuaaaauuacacaauuuuuuuaaguuccuaaaagaaugaauuccguguggggauaugaguaagcuuuccauuaaaucucaguuuggccugucaaacgaggcucauucuggguauuacaucgccuaauuugcauuuuagcauuguuuuguuucuuaaaugucacauuagagauacaugggcguguacgcaggagagcugaguaccuccacguugccuauuuugcauuuuagcaucauuuuguuuuuaauaaacgccaacuuaaaaacaucugggagugcacccaggagggcugaguaccuccucccuccugauuucuucucuuccccgucccggggaggcgaggggaagcugcacccugcuccccguggcugccuagauccugggcaagccaggaggccagagcgagccaggcuuugcgccugcaagggguccgcgcgagaaacacuuacgccgaggaaaaguuaaaauuccugggacgcccaagagucaagagaggaagacugaugagguuuuaggggagcuuugcaguacaggcguccuguauuugcgauuuucccaguagccucugagaaccuaucuagguacacucaggucgugagccgcgaguccuguggccgggucucagagcccgcagcagcccacagcgcaccuacgacgacccaauaacgcggagaggagccuaaagcugucgcagcaaccuccccccacuccuggaaugauagugcaacauucgccagugggugaguggguguauuuugcgguggggaguaucucccuaaugcuguugcugggagagggagaggaagagagagacuuuugguuuuuuaaauugaauuucauccaaaacaucugauaaauaauauguggguuggagaguuguuuucucuguuugauccuguuagucuuuaaugagggaaauagugagaaaacuuuuuggggggcuuuuuaauauucuaaaacuguggaaacauauguuguaaacuguacgcaaaaagc

SEQ ID NO: 16246 - RNA, 2176 nt, Homo sapiens
gcuuuuugcguacaguuuacaacauauguuuccacaguuuuagaauauuaaaaagccccccaaaaaguuuucucacuauuucccucauuaaagacuaacaggaucaaacagagaaaacaacucuccaacccacauauuauuuaucagauguuuuggaugaaauucaauuuaaaaaaccaaaagucucucucuuccucucccucucccagcaacagcauuagggagauacuccccaccgcaaaauacacccacucacccacuggcgaauguugcacuaucauuccaggaguggggggagguugcugcgacagcuuuaggcuccucuccgcguuauugggucgucguaggugcgcugugggcugcugcgggcucugagacccggccacaggacucgcggcucacgaccugaguguaccuagauagguucucagaggcuacugggaaaaucgcaaauacaggacgccuguacugcaaagcuccccuaaaaccucaucagucuuccucucuugacucuugggcgucccaggaauuuuaacuuuuccucggcguaaguguuucucgcgcggaccccuugcaggcgcaaagccuggcucgcucuggccuccuggcuugcccaggaucuaggcagccacggggagcagggugcagcuuccccucgccuccccgggacggggaagagaagaaaucaggagggaggagguacucagcccuccugggugcacucccagauguuuuuaaguuggcguuuauuaaaaacaaaaugaugcuaaaaugcaaaauaggcaacguggagguacucagcucuccugcguacacgcccauguaucucuaaugugacauuuaagaaacaaaacaaugcuaaaaugcaaauuaggcgauguaauacccagaaugagccucguuugacaggccaaacugagauuuaauggaaagcuuacucauauccccacacggaauucauucuuuuaggaacuuaaaaaaauuguguaauuuuaaguuccaccacugucauaacgaacacuccacaguaacaugcaguggaacaauggacacccccauaucgcauugugucagguaauuaugaagugucgaggcgcgggaaggagaagccgggaacgucaauguguccucugcaacgugugggagcgcucagagccgcgcguaucacagaaacaucauccagucgucacccccaaugccucaacccagggacagggacagacucaaucagaccucggccccaggcguggcaggagagggccaaagaggggacuugugagcgcagagggagcgagcaccgcuccauggagggcaggcgcuagcugggaagucgggaggagaaagugcaaccaggcggggaggggaggaucccaccggggcguggcgagggcguucgggguccgggugagcgggacccuacgcgggaccgugcgcucccagaagcucccacucagcccaaccuuuugggcgaaacccaggacacccagauaagggugcaggcggggucacgcguaaagcuguuacuuugaagcagggcauaagugagagagagauaaagagagaaggaccaaggggaaaaagaaaugaaggggcugaaggccgagauguccuacuucuaaguaguucuuugagaggcaaaagcuucauugccauugcaguccgaggcagcgccgcguggaggaccggccgggcggggcgcggggaccucuccaaggggucuccagccuccgcgcacucugcgguggcccccggagggggaaacuauucuggcagcucaguggggggaagcucguccgggcugugguuuccuuuccccgagaccccagcguugcacccccgaggcggcaggcucagucaacccuccccgggggacggcggcccucuagccaggcgaccucaggucucgcgaccucccgccgcccaaccuucuccuuucacccccauucauuuuuccucagcggcuccuaggacgggcucaaaaaccaacuccacacgcaacccagcccaccucgcggagcugagaagcagggcuggguuccgagcgggcgccggcgccccuggcguguggcggggagguggcggccgcggggggcgccgcgagccgcccgugcccgccgcggaugaacaggcggcugcgagcagcccccggagccgcgcagcauccgcguauccagug

SEQ ID NO: 16247 - RNA, 116438 nt, Homo sapiens
ugcuuucuagguucaucuaggccagcagggaaggugccacuuggaagauugcuggguuuccugcuucgaagucuucaggagcgggcugagcugcgcuggugugccgcuuaggacugcaaugaggagggugacguuagaaggucuuuaaaacguuacguuuacuauuuuaggaaacagauuuucaaagaaucaaggguaggggacaaaauacauuugggcuaggauuuuagugaagagggaucacgcccagaaugagggauaguaaaagaguggugguauggggcucugauaucgcuuaaucuguaaucuccggcaguguugauagcucuccucuggcauuaauucuucagucuuuuaaaacggaguagaaagggacguuggauugaucauuacgguuuguuuggagaauagaauuucgugucaccaacuuggaaggguaaaugaauugcagagucggauacagcuaauuugggggaauguaagcuggaugucuuuuccuaauuuaugaaacgugaacggggguaagguauuuauuuguacgcuaguugaaguggggcaggagcacugauuccuggacagucacucaaaagcugcgcccaaaguuuuaaaaagcgcggggacgguggagagggaggcgaagagcccgcgcugcugggcugggcucgggugccgcgcuggggacgccgcaucuacugagcggucgccgaagacgccgggaggcgaggggcgagguaagacgccgccuaaagaggcccgggcucucccccggggucguuguuggaaaagcaaauuccacggugaacucuaccaagcucagcgcguacacagcuagcggcucuggauuggacugcauucgccuaaauugcguaauuaaaaaaaaaaaauacaccacugccacccuacagcgacgcuuccgcuggaagacgagcggggacgcgugacagcgcggggauagcuuuucuauuacguuucuuguucuccgagcucgagcccccuuuuaaaaagucgcucaccaaaaacggggugggggauggagguggggacgagaaguuuccgaaugcugaguucauuuggacgaggugaggagaacuaggguccuaacagcagguccagaggacucucgagauagguuuagagcccguccuuuugucuggagugucgcgggacuccagaaguggguugugcaagacaaacuuccagauaaaucuuugcccggauccuccugcggucaaagcaucaguccugcccguaacuuccuaacgacaucuucuuggagcagauuccgcggcggggauggcugggugugcaaaccgaaaacaguuugucagcccuccagucccgccgcgucgggaaugcgagcccggccacgcgguccgaccggguccggggacggcgcgcuugucgcgggagccucccggcuugcggagggcuugaguuuuuuggcggagacagaggaaagccucuggucgagaggauuagagcgcgcguuuucuccgccgagcacgcugcccgacgccgucgcagccgcgcacuucccgguuuugaaagccagagagaugagucaagcgcaaaagcuccggagugacaaugcgagcuuuuggccagccucauccuccuccccauucccuugccuucuuuuaggucuucgguucgugacaagugcauagguuaggcuugcacggaagagggucggggcaggugccagcucagggcaccuacccggcguugucacguucccuuugggaucaaugaucuuucauaacuaggcugggcauguucgugcagcccucugggcacucugggggacguucucauaaggcuuuuuuucuuuucuuuucuaccuuuuaacagaaccuucuaggaaaaguguuuuuuaaaguuuuaaauauacugaugucuacagaaacggauaacaaaauuucaaagcggaagggaggaaacaaaaggaaaagguguuuuacuuggcagucauugcugaagcuaccauaguguaggauagaggaagagcguuucagaagagaauugguuaaguaaaaccuucagcuguaacguaauagaaaagacacaguaaaugggaaaaauaauaaaauguacacuagauacauuacacagacgauugagaacuuaugcucccacugaaagccucuuucucccagggagaauauuuauggaggaaaauuauuuaguuauuuucacaguauuacauuguccuuugaaugaaaguuuuuuuuuuuuaaucagucagcuagacuugguucuuuaauuaggaggcacaaugaaguuucuaacagauguugucagccacaaacucugauccaaaauaauaaguguaacuaauuuucggggacaaucuuuaguuuguaaggccugaaauuaaaauacgaugcuuuuaaacacugugguucaaaaauguaggaaaacauuuguuccagaucuuauaguggcaccauuuccuugcucuguguuggaaaagccuuaaguaggauaugacccuucucucucacuccaaaaccucuuuuuucaaacuugauuucuuucugaucuuagaaauucuacuuuaaaaauauuuccugauuuuuaaaagucagccagaugaggugaaauccuuaaaauauaacauauuccugaucagaucacauaacuuuucucauaaacuaagucuuauaaagaauaugcuuaagcaacucuucaucuaaauauagcuuucaaauauguauaauuuaaucugaaucgguguugucaaacuuccaguacccugaaauauaagcacaaagaucaaauuaucuauaauugucagauaaaugugguagccacugguucugcuugguguaguaaaaauuaauuaacaauuaaucauuuuuaaauugaauauacaauguuaagacaaaauauugagugggaugcucuaauauauccaguucuuaauucuuggcauggcaucaugacuucuaaacucuauaugguguguugaagauuugaagauuugucauuguaaguuaccuguuuccuacacauuggaaagagggggaaguuaauacguuuucuauagcauucaacuccucugcugccaaaacaucuuauaguuuggacugcauuuuaauauaugccauauuuugaaaucuauuugguuuugaacaagcugcagccucugugcaaauaaccugucauccuuuaguggaucuuuauggcuauuuuaaauaaaaguuuuuuuaaagugccaagagagaacauuacaaagugaggucugucuucuugggauucuauaucuauuugagggugaaggguagauagggcugauguuacaucuuuugacagagggcuaguagaauccuauguuucugacacaaauuaaaugugauuuccgccaaauugacugucuccuggcguggaggcacaucaccacgauuuugguuugccacauugaaauaaauaagaaaacaaaggcuggacuugcaaaagcuacuacuuauuuuucagcuucuuuaaugacuaggauucuuucacuuaucugcccuggacuacacacugacaggcugcuggaauucugagcaguaaaaaaauucuagauggccaauauaauuuaaaugacaaauguguauugagcacauacuguaaggacagggguaaaaaguggaagaccaguaacucagccguccaaaugaaugggccuuaccaauaagccuaagacacugggauggggcugcaacuucuuuucauagcaguuucauaaggcuuucuuuucuuuucuaccuuuuaauagaaucucuguugaaugauuuuuuuuuauauugugcuaaguaguuuuuccuagcugucucaauuguucuagagcuucuucgugugucauggaaggccugaaagucugggccaggauuauaauuguuaaaaaaaucauuuuucucaguucguucucucuuuuuaaauacuaggauauuugcuucguuaauaguagaauuuuaguccuuucuuuaaaaaaauuguuuguuuguucuucauuaacauuaaugacauuucucaacugcauuugcuucagucucauuugggaaucugccuagucuugucuccuuaacggguuagcggugaugacaccuuaguaccagagguucccugaguuuugcugucaacucacuuauaugccuuuuuuaagggaaguagguuggagggguuacccucauaaagcucguauucuccauauuuguaaaagggauuuugaaacauuucuuuacccauuggaaauuauaaaaucaucggaggcauuacaaaguagcagaaaaugcuggaaaacaaaagaagagaucuauggacuuuguaaugggcauuuggaugagagcuucuagauuauggucugaaaaaaggaacuauacuuucuauuucaguaguauuuuauuguucaauagugaaguuuuaaauaugaugguuucuugcccuucaaaaauguaccuuaauacuguaugcucaagcagaauuaaaaaguaaacugguugaguuuagaaauauucuauuagaaaacuguguauguuuaguugguuucuauuuuauguuaaacaaagugcagggaguuugaauaaaugaauuuuaaguauuuuuauuacaaauuuaauuuacuucugguugugguuuuuuuaaguuugcucuuauagauaaacauugcugccuuucacagcauuucacauuugaaauaucuguauauuguguucuggguccaucgagcugaaagcuuguggcaaaauauuaacguuuuuucaauuucuuaauugaaaggauacuuuaagcugugagaaguggcacgugucuguagucccagcuacuugggaggcugaagcaggaggauuguuugagccuaggaguucaaagccagccuggacaacauagcgagaccccaucuccuaaaaaaaagggaauacuuuaaauauaagacauacuugaaaaaacuuuuuagaacauuuuacauuugacauuucugucucuaacauaaauuaauauauaaggugcaacguuuugcuugauaggaaguuuauacuguaaauaaacccauaagucaaaugaauauacuugguuucuuucuauacacaugacaguuaauuuuacuuuauuuagauuuuugcuucuccuaggauuaccaguuucaaaaaguuuuuucuucagucagacuucgggaagcuaguccaccuaauuuaaaauaaaaugacaugaauucccaguauuucauuuguucauuucacaucuuuucuuugucugcccaaggacuguuagucaacuuucaucaaaagaaaacuauuuuuaccauuuauaguucugccucugccaggcugguaauauccaucuucccuuacuggguuacuauaaucaaccuggcuauuguuuugcauugggauuuuuaaaaguuaauacauauauauauauauauauauauauauauauauauauauauauauuuuuuuuuuuuuuuuucuuuugagacaagaucucacucugucacucagguuggaguucaauggcauaaucucgguuuauugcagccucaaccuccuaggcucaagcaauccucccaccucagccucccaaguagcugggaccacaggcaugugccaccauacccagcuaauuuuguuuaauuuuuauagagaugggagcucacuauguugcccagguuggucucaaacuccugggcucaagugauccuuuugucuuggcuucccaaagugcugguaauacaggcaugagccaccacgcccagcccaaauauguuuuuucauaaaauuuagaaaacaggggguugggcagcaguggcucacacuuguaauuccagcacuuugggaggcaaggugggaggaucacuugaggccaggaguuugagaccagccugggcaauauagcaagacccccaugucuacaaaaaaaaaaaauuagaaaacacauugugaccaauuagaacaaaauuuguauacaaaagugacauguuuuuugcuuuuuuuguuguuguuguucagccaggggcacuccuccuguggacuuugauuauguguguugccacugcuguguuacuugccuuacacuaaguccucucagacucaagugucaucgugaugggcucagguguaccuaagcuaccuuccaauuccaugcccuccuugcacuggcucaggaccaugacugcaguagaaauaaacuuagaccuaguguuuaccaacaagcucauguaaccuuuggcgugcagggccucaauuucuuuauggguuaaauauaaguuauugagauuaaaugauauuugcaaaaauauccaacuuaaauccaagaauuucagaguauuuuaaguuauuuuuaaagggcaaaguaugugaccuuccuuuaucuauguguuucuuuuuuuuugagacggagucuugcucugucgcccaggcuggagugcaguggcgccaucucggcucacugcaagcuccgccuccuggguucacgccauucuccucagccucccaaguagcugggacuacaggcgccugccaccacgccuggcuaauuuuuuauauuuuuaauagagaugagguuucaccguguuagccaggauggucucgaucuccugagcucgugaucugcccgccuuggccucccaaagugcugggauuacaggcgugagccaccgcgccuggcauuaucuauguauuucaacuauaccaaaaaacuauagagaauauuauaaaccaacaccuaucuccaauauacuuauuucuguguaccuaucuccaagacauuucaaagcuaucuuuaacucaucuuuaaaaaauauauacaagccaggggcaguggugcacaccuguagucccagcuacucucaaggcugaggcagaggcugagguaggaggaucgcuugaagccagagguucaaggcugcugugagcuaugauagugccuuuggauagccacuucacuccagccugggcaacacagugagacuccaucuuuaaaaaauaaaauaaaaaauuaaaauacguacauuuuuaaauguuaaagccuccuauauacucuuuccaucucuuuucccucccucccucccucaccaagguuauuuccauguauguuuuccauguauguaauuuccauguauguacagacuuuuauauuuguauguauaguaauguuugucuuauuaaagaaagcugacauaaauaguaucaucauacacguguucuuuuuaacuaagcauuauguuuuucugagauauauucauacugauauauguugcuuuguuucauuccauuaucaguacuguagaaguuaauggacaugccauuauuaauuuaucuauuuuauaauguucacuauuucaaaugaggcuguugugaacuucucauacauaucucccuguacacagguauaauugucuuucuaggauaccacauagaaauggaauuguggggucacaggauaugaauauuaucaacuuugauaaauaucacuaaauugauuuucagagugguugcauuaauuuacaccgauacuauuauagcuucaugugaguguuccuuuugcaaguauauugucaccaacacuuugauaaggucugacauucaaauacuuuuccacuucagcuggaucuaagauggugacucauuuuuaaauuauguuuuccugaccuagugaaauugagcaucuuuucacuguuggacaccugguuuuccucugcugugaauugcuuguucuuauccuuugcucauuuuuuauuuggggagauuuguuuucauuaauaauuuauuauucugugucuaguguggauucuaauuccuuacugguauguuugcuguaaaaauauuuuccuaaaucuuugguuuagccuugcguuguuuauggugucuuaaaaaugcagaauguuuuuaauacaaugaaauguauucaucuuguagaguuuaucguuuugucuuuuaagaaauucucaucuaaaaguuauagauauaguuacccauauauucuucuaaaagcuucauaaaauuuuguugagucuuuaacuuaccuaaaauguauuguuguuguuaugagauagaaagcuguuuuacucuaccaaguggauaacuaaguauccaggcaccuuuuguuaaguagcccauccuuuccuugcacuuuuaaaaugccaucucuaucauguaucaguuuuauguauacuuguguaugucucuuuucuugucauuggucuauuuguauuuguuccacuaucccuguuccauuacacuggagaacauugcuguaugucuugauaucugauagagugaguucccaauuguguuuuucaaaauugucuugguuauucuugguguuuugcucuccuguauggauuguagggucaguagauauacuuuuuaaaaagugggaaaacauuauaaaaaguauuuuugagcuaauauccacaauaacuuuuuguagaucugaaacuggaaauauuuaaugguuucucuauuuaauuguuggaucuucacugaaaugcaguaugugguugauaccaaacuaauuugaaaccugcuguugaauuuggcuguccugaauuucagugcaugaacaaaguuggagaaguuuagauuaaaaaaaaaaauuggagcuugacuaagcugaaguguuggguugcaaaaaaaaaaugagauuuuuuguuuucuuaaguagcauuugaauugagauguagagguaaggccagguaaucgcuuucuuuucuccuuuugucauuaagcagagguagaacaauggguguuacuugagagcugcccuucuaacccuugcugcucuuaaaaugccuucaggucaucacaagguucuuagugguguuuuaauuuuuuaauuuaauguuuaacuucugagagaauugcuuauaaacauuuacuuuguugauguugcugggacaugguuagauaaugguggcuaugggugaugauaagggauuucauaguauguuuauuuuggggagcgauuaaaaggauugucauaguuuuauuuaauuggaaauuuauuuuggauucuuucguccuuaaggcaucuaauauuagaaaugaauuuuaauguuaaaauguacaaagauaucuaacucuuaagguuuuuaaaauguauucugcuuuauacaaacuuagaaaauauuuuuuauuauccucaucaaaugugacuugacaucauaguuguuuuauaaauauuuugagauuuauuuucuuacuuauugucuuugcccacuagaagaaaaaaugauauuugaggcauucuauucauuccguguuauaacuuaucaaggauuggcccuagauacucuguguuuaccuauagagagugugguugcucguucaagguccugauuuuucucaauuuuucauccuuuucuguucugagcuucacuugaccagcuuccucaacuguguguggccaagagaggaggaauagaguuggccauucucuuuuggagcauucagcaggauuacauguuauggaauuuaggaauuuuuacuuuauuauaaugcaauguuauuaguuugugauuauuuuuguucuuuuucuuuuuuguaaguugauuuauuccaaguuaagaaagaccaagauauaccuagucagagaauaccuuuacagacauacauaggaacagagauuuggaauuuaagauaauugcucauugauucauucacucaucauacauaagcaugcauauuaugaauaaagugucaguauaauguauuguccaaagcaggacacuuuugagacugaaagggggcauuagggacaauuauaccaggacuauaaacacaaaucaggaucuucccuggcaggucaucagauacugacuacugugugucaugcuucauacauucaggacauuuuaaauaauuuaguuaacccucagggugggaaaggaagggaaagaguugauuagaaaggagaggcuucacucacagacugcagguuuauugggugcuaagugugcccugcuguagucuguuaguuucauuucauuggcauacuguaccuugcuuccuuacuaucuauccuuagacauuuuaaaaaauuaucuuuagcuucugcauuacuuuuauuuggggcugguaacauacuucuggcccuugucuuuguuacuauuuuucuuacuuuauaguuggauuaguuggauuuucagaccauucucuaggcaaaauugguuagcuguuucuuuugaccacuuaggaagaaggccuccuaguaaugcaugugcuuuuuauuccugucugauugcuccaaucaaacguuuuguaggugguuuaucuggaauauaaagaaucugaaaggagcacagacuuucaccccagguccagaucuuacuuauuuuuggacaugaguguacucgguucucaaggcagaacagcuuugugugccuguauuccaguauuguugcuuuaauugcaguuugcuuccuucuccaaagggagagugaguggugaaucaguggaggagugacagauggaggaaggggucaccuuuccuuguguagguauauggacuguuuggcaaagagucauuuuguuuuuguggguaaugcucucccccacuuuucugaaaucuauaucugagaguacaaaauaugggaguguguguuugcugauaaucagaucaaagguucccagggggcuaaccuaccugaaaagggaaaggggcuauuguggcucucugcagccugaccucuccacucucuuauuguaacaaaguuuuugauaggcaucuagauagaaagcugcuggggggaacuucccaggugcuucugagauggaaugugugcaucuauccauggauacgauaaaugugagcuauugaggguagaaaaaaaacaguaacauauaugcuaacaugaauauugaaacagauuguuaaucuuucaucagagcuucuugguuuagaaaccuuuuauuuggcaauaaugaauguaacuauugacuaauauuguuuaagagacugcuauuuguggcaccaaagauaagcauaaccugagugacuucuugacccuuugcaaauauuuacaggcugaaauaauauaguuugacaaaagagccaagugauuuuggaguggcuuauuuucugguuuuccuacaguucagaagauaauuuaucugauaaaaaugguaaguuuugcuuguggagguguaauggauuuugaaacacaaaauauggauuaauuuuuuuugaggcgggauaguaauggugauaacgguauguaugacacaugcuguuaugaauauauuaaaaagcauuuuaacauguuagagucaucaaaaguuaugcccacuuccauuuuauacauuuuggcauuucuugauuaaaaauauauugucaacauaaaacuaccauuucuuggaauagaugcuuguuaaaaauguauccuuaucaguuuaucaaaaacaauuguuaaaaaugauauauuuguggaaaggggaaaaacuuuccaaaauaaauauuuuuauggaaacaaugaacucuuugcuagauuuccucuucuaguacaugauucuucuaauaauguaauacauuuacaacaggucugauaccuuuaauucuccaguucuuucacacaguuaagugcuugcugcaaucuucuuaaggcugaaagaaugacacauucaagaagucuuugacaguguuuaaacaccucuuaucaaaacuuaauuuccaugaaugauugauuuuggcacuugauggaaggcugaagaauguucaauuaccccauuuucaugugcuaaugaagccgaaagugacuuaagaggauuucuuuacacuguggcagccuguuuggauaugcacaugacuucuuagguuucucucccaggguuugucucuacuaaauaguugucuuauugaguaacuguagcuaaucugucugcuuggccacaggccuuggccuuccucuguagaguggacuguaauuagugaagcugucaaccagguguuuaauuucaagagaacuuauuuuguucaaaucuuccaauaacuugccaaaucaaucagguuuagauuuucuguuuguucacgagcacuccuugaauuuugaguaaaaugaauauggaaaaccuuuuaaacuaggaaaaaaugcaacuuucaauucgaaacuuuggguuuauaaagcuugacuaugaguuucaauuuuucacacauugcgcuagaauuaucauuaaaacacuuaaccuaagcuuggcuggaaauauacguaucaaauugaagaauuuccugcccuguuuuuugacaagggauggcugaaugaggaagaagaaaaauuauacuguaggaaaauacauaagacucuccccacuaaaauacaugcaguucauggguuuaaauuuugaugauucugcuucauguucuugcauaauuuuaguguuagaaaugagaaaacuuuacgguuagauauccuucagccuugugaucccuuucaguuuauaauccuguggauccagaaagguuauuucuccagcaucagaagacaucugaggcuugcaguaaagucacagacugguuuugugacucuagaugaggcacuucuagccuuuucaguucaaaacaacgauaguccucauccaaacugcuccuuacuuucucacagccuccacuuccuucucacgaagguguccgauuccucugagcauggaaagugcuguauucuggggacagcaggaacuuguuuagauugaggcaaacaugcugcguguaaacacuuaaugcguguguucuagcagacucagccaagacugauggaugacuucuuuuuucuuuuuccucccuuauauggaugguaggacugacuucuccagauaacaacugaguuguugauuagugacuuuugguauaaacuuuacuuucguaguaaggaggaaaauaugucaaggaaagaagcagcucuguuuccuccacagaccccuaucuaaugagcuugcaauuaugagaauuuaauacauuagucucguggggugaaccuaaacucuacauugaagcuugagauucucaacaucauuuaacaucagauagcauuuuaucgucucccuuuguauguagaagauacuuucucuuuuccucuacccucccaggaguuaucuccaccucaucuccucaccaaaaauagauaaaaauaaaaagagggaagaaaauaagaccuuugccagauaccaucaaaguauccucaggguuugggugguacacauaacgaagaaauuacuuccuucuuuccaguuuuuugaggugaaggcaguguccuggcugguccaugcuccacucaggcauggugcuguagugggaaaagaauauugaacuggaaggcagccauguuccucauggcuucucuacuuugacaacagagcaaaguuaucucaucacccuggggcuggggguaucacaguaagcuuaaaaaugucuaaggucucuucaaacucucugcucagugaucguuuauggcacuuguguguaauuuggaagguguacuaagacauggcaacacacugcacucaaagucaugcuuauuaucugcagcauccccauuguauuucauuggggcuuggucacuaucacaucugacuugauuucucuuccuucugagugauuucucucucauuuuucuuaguuugcuuccuuaccauucuacauguucuuuaggaguuggugaacccaaaauuauuugagacaggccaggcacaguggcucacaccuguaaucccagcacuuugggaggccgaggagggcggaucacgaggucaggaguucgagacuugccuggccaacacggugaaacuccaucucuacuaaaaauacaaaaauuagccggguaugauggugggugccuguaaucccagcuacucaggaggcugaggcaggagaauugcuugaaccugggagguggagguugcagugagccgagauggcgccacugcacuccagccugggugacagagcgagauccaucucaaaaagaaaaaaaacauuauuugagacaaaggcaacugucauuuuuguuacaauacuauuugagcagaccauucaugugaaauuaucuacuacugcaucuuccaaauuacaugcaacuaaagauggggguauugacaacucgaaaguuacauucauaacuaauauucuugguacuuuuaauuuuuuuaauuucuuaagacuuuuaaacaaagcaggugauauauaaacuucccacauuauuuggacuuugcucuccuuuaccuaagaguucuccugcugucauucgucccuugagguuagcuaacaaggucaccugccugccuaccuauucuuuuugcauugcacugguagccuucuuucuguuuuccuaaaugcaucuccuaacgacuuucuccagcuccaagcucuuccaucuccagucuuuccuccuaaacuucuuaaccaguaguugguacgcccuaugaggacaugagccaggccucuccucuuccccacugcacccugugcauucgcucaauguuuguuccacgaaaaauguaccguuuugaugaaaucucuuuuuaucuccagaaccucuaauggcuuuacaucaugugcagacuaaauuucaggcaucuuaaucccacauuuuuucaaagcauuuuaagaaauggucccaguggggcugggcgcgguggcucacgccuguaaucccaacacuuugggaggcugagguggguggaucacgaggucaagagaucgagaccauccuggccaauguggugaaacuccaucucuacuaaaaauacaaaaauauuagcugggcgugguggcgcgcgccuguagucccagcuacucuggaggcugaggcaguagaaucacuugaacucaggaggcagagguugcagugagccaagaucgugccacuguacuccagccuggcgacagagugaggcuccgucucaaaaaaaaagaaaugguuccaguguuucucacaugacucacacuuguggaaaucuucuccaugugccgagcuggggugccccuccuuaaagccuuucaguaccugggcaccagauccccacccuuucacacucuuuugccacaagugucuccuuuauaacauuugcgaacacacugaauauuuacuaagugccugguacagaggauauagacaagauaagucaagcggcucucuaggauucuccuucucucccaggacaggcaggcaggaaaggagggcccagucagaccccuucugagugugagagggaggguggggcucugauggugccccuuacuggaaguaaaggcagagacuagacacuggcucuuuauccccguuucuccagggcuuuccccugaugcuuugucuaaaauagaugcuugguuacuggccauugccuguacugccuuugccuuucuucucuuguuggcuuuguauucuccugucuccaguaacucccaccuggaaugucuacuccuucgacucuaccucuaggaauacuccccuuuccacaagguucaaaucacagacuauagucuucccgcagcgguggccagguccauggccaggcauugucucugacuccuaagaccccagcaacugaacacaggccccucacggcagugguuauauucugccacguucuaugucuacccuuucgcucacgcccccuucugucuuagcgcucuugccucccuagaacacuugcguaggggguugucaggcucuugguauugguucucagcauaaauuuacuuugacaaaagauguuugaagcaaggaaauuggacaaauuccaaaugaaugaaauauauuugaaguauguaugugacaaucagguuaauguuacucgugugcuucaaaguggauucauuccaguuccaauuuauaguguggcaaauauuuacguggauuuuuuaggaugacuuucgcuuccuuuugguccggaaagcuggaucacccuaggcugaaggaaaaaauguagaaagguuuuaaauuuacuuggguuaguaguuagcauuccuuaggcaaacaauuccccccaggauuauauuuucauuuucucacaacucugcucauuucaaaaaguugcacauauucaaagcuauaguaaaggggggaaagggugugcaagaaaucuaccuacauauauacacauggggggaaaacuguaucaagguggaaaccauaaaugaacaaauuaggggugcauguaugagagagagcccugaaaccaaagaaggagcuaacucaggacgaaaguuuugagcauccaaccugagugugaugugauuaucuucucccuccugaauuuuuuuuuugagauggagucuugcuccauugcccaggcuggagugcaguggcaugaucucagcucacugcaaccucugcuuccugaguucaagcaauucuccugccucagccucuugaguagcugggauuauaggcaugcgccaccacgcccggcuaguuuuuguguuuuuaguagagacaggguuucaccauguuggccaggcuggucucgaacucuuaaccucaagugauccaccugccugggccucccaaagugcugggauuacagacgugagccaccaugccuggcccuuccugaauauuugaguuaccccuauggcaggucaaagucacugaaguccagcaggcacucugagagcuauggggucccaagaugugcccaguuccccucucugcagaguaugguaagcuuggcguagggccucuacaaacuaauuuagcuuguguaauuaauucucacagcuugagauacccaagagucugacaggcacucuucgacaggcguuucuaauccuuuacuuacuuguuuauccuugcagaaccccuuuuucaaagaaaagcuuacaaugaaucuuaauaaauagaauaugaauaaaugauaguuuaauacuacaaaugcauaaucauacauauuuuauauauuuauguuuaaagcauuuauuuauuaggaggugaaucagcucaacuuuuuugacucccaaacaagaaaucuaugguuauggaugacaguuauagccuuguaucagcccgugcaucuaauuaaauucuacaucuuuagaauuuaauuaagcauauacaccaugcaccuuaucaaaucaauccauuucaugaacauauuggccaguuugauucaauucaacuuaaagcuaauugaccuuaucaccucuaucagcaaguuuucuuuuuaaacuuacuuuuuuaaaaaguucuaguuuuaaggucacagaagcacccaaaacuaugaaguacuaaaacuagaauucucugaagcaugacaccguggagccguauuaucaccacgugcccugucgugucaggggugcauuuguuaacugcacaacucacuuuuggccaagaaccugcauggggcgaugaccucgagccuuucccaggaugucacugagcucaaccuguggguacuggagauccacuuagauagcuugaaguguguggacuugcucaggacuacagguuuaaaagaccagggcaaagcaaguguccucucaguaaugcacaucuggggauuucagcugcagccacugaguagcagcaggaccagccugcagagucccauuugaaagcucuugcugugguaggcccugcaccguuaauccccauaggguguaccuuuucaucuucauugucuucucugauuguaucuuuuuaucuugggguaguuuucuucuauuuguuuguuuuguuuagcuuuucuauuuuaaagaauuaaauuacauugcuauagauauuaccgaagauguaccgaagacuuaaauuuaucaccuuuauaacaaucccagagcuaagaagacucucugaggaaccucuguugcugauuugggccuagucuguggaaagggcaguugacccuauacugggauuucuugauguugacugcagcuauuguaaacuuauuauaaaaaggcacuuagguccuuuuguuuaguaagacuugaacucuucagucugucuccagccugggagaauaccaggacuugccugggucuguccagguugcuggaggcagccugccuuccugggguggaagcaggaagaguaugugcgaggggagcaagccuugggagugugaggagcggaguacacuauacccuccucccugagggcagugcccagacaagugggugagaacccuucauucccuccugccuucucaccccccgcccccugcaaagcugcuuacuguggugcaaggaaaaggaguuggaguccgaagucccagguuagugguauugccaaagcggguggcuugggagugguucaagcucaccucaacauucaauuuaaaugaagacugugcugguggccaaguucuuacucucagucagccuccugccucagucacucacauacacacccccacacauucacacacaugccacacgcaaacacaguacacaaguaccacagcagacacacaccacaccccuucacauucacacacuauacacacauaccacacacaccacaccucuccacauucucacacaccacacuacacacacacacaaacauaccacacacaccacacuccuccacauucacacacaccacucauacaaacauaccacacacaccacaccccuccacauucacacaccacacuacacacacacacaaacauaccacacacaccacaccccuccacauucauacacacacacacaaacauaacacacacaccacaccccuccacauucacacacaccacacuacacacacacacaaacauaccacacacaccacacuccuccacauucacacacaccauucacacaaacauaccacacacaccacaacccuccacauucacacacaccacucacacaaacauaccacacacaccacaucccuccacauucacacaccacacacacacaaacauaccacacacaccacaacccucuacauuacacauaccacacacaaaacauaccacauacacacauacacaaaaaacauacuacauacacacaaacauaucacaugcauaucacaccccuccacauucacacacacacacaccccuccacauuuacacacauaccauacuacacacaugcacacacuggcauaccagccccacacacccaacacuccccacacacaucccacaucacacacaccacacauauugcauguguugcaaacauacaccauacauuaccccccuacacacucagcccacuauuauacuugcuuugcagcuggcaacucccccucucccagcaccugccccagauguguucagguaaaugguuuucuagaacaacuucagaaaacucgggaacucugaagagcggaaccugagugauacacucuagggaaaagauuacuuguuucucugucugaaaaugcagaaaaagguuugaaauuuguuuucugcuuuuucaguuuuuaauuugucagauggcugaacagauaugccauuagauguauaagauuuggcauauccuuuugugugugugugagacggucucauucugucgcccaggcuggagugcaguggcacccucucagcugaagcaauucucgugccucagucucuccaguagcuaggauuacaagcgcgcgcaaucacaccuggcuaauuuuuguauuuucaauagagacgggguuucaccauguuggccaggcuggucucgaacuguccucaaucaagccaaccuccucagccucccaaagugcugagauuacaggugugagccaucaugccuggccauacucuucaacaacagaucaucaauaauugcagugcuuaucaucaaccuucccaaucccucuaaaacagaaauuuuguacaggcaucugccuaaacugagcuuauccucauucaccccugccuguaaacugcuuuuugaacuuuucuuuuuuuuuuuuuuugagacagagucucucuuuguugcucgggcuggagugcaacugcgugaucucagcucacugcaaccuccaccucccggguucaagcgauucucaugccucagccucccgaguagcucggauuacaggugugugccacaacacucggcuaauuuuuguauucuuaguagagacaggauuucaccauguuggccaggcuugucucaaacuccugaccucagguaauccacccaccuuggccucccaaagugcugggauuacaggugcgagccaccaugcccagccgaccuuuucuuaaaguuccuuucuucuuuugagagucauuuucaccaagagccaauauuguauagugcugccaagaguuccugaggucccauaaguaccaguagagauuccgcugcugaaguggcugcuuguccgcuuggcuagccacacuguccucugcccuuuccucccagccucuguucacuugcugguucuucugcauagaauucuuuucccccuaaucuuguuccccucccuuuauggguuuggucaccucuucacagaggcuuuuccugcugcuccuaacaaaaggagcuuccuccuucccaauuccuuuauccugcuuuauuuuauuccuccauagcucuugucacugucuaaauguauuuauuuguuuacuucuuuacugucugucucuccaaccagaaugcuaacucuaugaggacaaggaauuuuuuuuuuuuuuuuuuuuuuugagacggggucucugucauccaggcuggagugcaguggugcgaucauggcucacugcagccucugcuucccaggcucaagccauucuccugccucagccuccugaauagcugggaccacaggcaugcaccaccaugccuugcuaauuuguuauuucuuuguagagacagggucucccuguguugcccaggcuggucucaaacuucugggcucaaguaauccgcccgccucugccucccaaagcgcugggauuacagguaugagccacugcugccugccucaggacaaggaauucauguguuugccuuguucacuguugucuccagugucugaaacaguuucuagcacauaagaaauguucaaaaaaaaaaacuugaauaaaaaguauugaacaaaggacuuggaugaaugcaaaugcugaaaugcucaggauuuuuuaaaaaauugaaaccagauuauuuuaauauauaugaucuacguuuaaucuauaauguaagucuaaauuuaaucuguaacaaauguauuuauuguacaucaauaaaacgaugauagauaauagauuuaaucuauaauauuaaauuaaauauacuauaaauuuauuuaauauuauaauacaguuaaucuauaaucaucacauuucuaaauuuuggauuuauccugagagauagaacacauuuuuuuuuauagaaccuuaaaaggcagcuguuggccuucuggugacaggugucuuucuuucuuuuuuaaaauaaccaaagcuguaaauuauugugaucaaaaauaguuugggaagauggugagcagggguuuugcuuugucuugcuugucuuucugugagaugggggugaggagagagaacaagacacagggacauaauaaguucauagaguucaagauacagcccccugggaugcccggugaauuuccuuaaauuuaaaagaacacagccuugcccuuguagucugagcaguggucaucuggaggccacccccaaccaaggguucccuuugcugggauggauaacucaaagguggggagguugcguuucuuccuuucuuuuacaaggugguaaucucuuagcugccuauggaaauaaggcugcuuugaaagaggagcuuuacacauuguaaacuuuucccccagggcaagucagccauccuuaaugcuucuugaaguuaaaauuucuuuucucucuuccuccucuuuucuuuccuuuaaaaacuuuuuuguuaaugaaguagaaaaugagcuucucugcacuuguuaaaaagugcuacuugggcaaagaaaaugucugucccuucuacaaauguguaaaauuaucccguuugagcuuggcauuugaagauuucagacuccucaagacuuaaaugaaaggcaaggugcuaaacaaugaauaugccaccuuuuguaugagaaagagaaaaagagauuugcugcuguuugcuaaagaaacacuagaagaauaaagaagaaagcaguaacaauggucucugguggacagguguggauguaaggggugggugggaagggcauggguggagacaggaccgagggugggacuucucccuauuuaucuguuuauaucauucugauuuuugaaucauguaguguauuaccuauccaaaaauguaaaacaaacauucuuaaaucccaucuuauuuugaucuuugauacuugucugauuuguuuuuuccuuuucuuucuuuuuuuuuugcagggaguagggugugauuuuuaaaaaauuguaguaaaauauacaugacaaaaguuaccauuuuaaccaucuucaaguaugcuauucaguagcauuaaguuuauucccaacauuguacacacugucaacauuaucuguuucuagaauuuuuucuucauuccaaauaaaagcucuacugauucaacaauaacuuuuccccuuccucagccccuggcaacuucuauuauacuuuguuuauaugaauuuggcucauauauauauguaaaaucauacaauauuuggccuuuuguauguggcuuauuucacuuagcauagcauaauguuuucaaggaacaugcauauuguagcauguaucagaauuucauuccuuuaugugguugaauaauaucccauuguguguauggauugccacauuuugucuauucauucauuuguugauagacauugggcuguugccaccuuuuagcuauugagaaaaaugcugcuaugaaucuucuagugcuuucuucauauuguuuuauacuuaugauguauaauuauuuacauuuaucuuuuuauuuacuuuuuaaaaauuuauauuauuuacauuuaucuuuccuucuagccugggaacuugacuugagaguaagggacauguaguaugucuuauucuuucucgcacccuggguacccgcagauuaacaagcagguguucaguuggcauuuaauaaaugucugucaaaugacuaaaugguagauggaaaauuaguuuugaguuuauuucauaaaggacaaaagaagauuugaaaaguuuauucuugaacaaggguuugaacuuugaggguccauuuaugcacagauuuuuucuuuucucucuuuuuuuuuuuuuuuuugagacaaagucucgcucugucacccaggcuggagugcaguggcgcaauaucggcucauugcaaccuccagcuccuggguucaagcgauucuccugccucagcccccgagugucugugauaacaggugugcgccaccaugcccaugcccagcuaauuuuuguauuuuuaguagagacgggguuucaacacgcuggccacgauggucucgaacucuugacuuugugaucugcccgccuuggccucccaaagugccgggauuacaggcaugagccaccgugccuggccgcacagauguuuuucaagaaauacguuggaaauuuuuuggagauuugcaauaauuugaagaaacuccuagaugaaccaugcagccuagaaauguugaaaaaauuaagaaaaaugcauuaugaaugcauaaaauauauguagauacuuguccauuuuuguguuuguuaauugacugcuuauguuauugguucuggucaacaggagacuauuaguuaaguauuggggagucaaaaguuauaugcagauuuuugacugcacaggagaauuggugccccaacccccucauugcucaauggacaacuuguauuuguucagcucugucagcuuugaagaagugaucuuguuuauuuggaauuaguuuuaaguuaaaacauauuuagaugauaggaaguugcuguagaaauguauccauuuucuaaacacaacauggcagucagaaggcaauauuaaugaacacaggcuaauagaaaacacucuugcucugugugugucugagucugggugugugacuccauugugaacuggccuuagagggugaccugcgcaccuccacccuacccuugccggagggcaccguguuaugaauaaagcaacuaaguuuagaaacaggcaaagggaagcagaggugggguuuuggguaaguucacacaguugcuuggccagucugacccugggcaaauguccccuuaucucucaaugauggaugaugcagcagcuuugaccaaacugaacaauccccauuucaagaccagcugcccaguuuuuuucuuuuucggaaagggacccugaaggauguugauuuaguggcaucuccucacgguugacucugucagucaucaggauacuguggaagcaggggcagauuaaaggccaggcccacuuuuugaaugagaaauaaagccuggggugggcugagggucagggggagugugggugggaaaguucuuucuuauuucaaacgugugccucuggcuuuuggagaaaugauauugaacaugguguaccuguagggcuguaaagaaccauacugauaaucuaguccagcgucuuggauuuauugcugaggaaauuaacagaugagauugcucaggagcuuuauaugugaccauguaacuaggaggcagaacugggcagauaccaagacauuuucaucugaaccgcucagccuuuaugaaacaucuugauuuuuugagggcuauuuccucaacagaauacuuuaaaaaaaaaauaaagcuagaaucaaagauauuugauaugaaaaaguaaauuugcuaguaauggaacguauaguuauuaaaguaguuuuguuaauauaauaauuuauaguguguuaaguagaccauaauuuuuuagaacagcuuagauuuacagaaaaauugagaagcuaguauaguuuucauauuccccacacucaauuucccauguuauucacaucuuacauuagucaauuaaugaaccaauguugauguguucucauuaacugaaauccauacuucauucagauuuccuuagcuuuuaccuaguguccuuuuucuauuccaggauuacauugaggagaucacauuauguuuaauggucauguuuucuucagacucuucuggucuugacaguuucucugaauuuucugguuuuucaugaccuuaacaguuuugaggagcagugggcagcucuauuuuagaauguccuucaauugaaauaugucuuuuuuuuuaaauaugauuagucugggguuaugggcuuuuuggaggaagaccagacagguaaagugcuauuucaucacaucauaucaaaaguauauaucaacaugacuuaucacugucgacguuaaccuggaucaccuagcugaggugguguuuucagguuucuccagagaaaaaaaugacccauuuuuuccaccuuuucauaugguauucuuuggaaggaaguuacuauauccaccucacacacaaggaggagggaauuauguuccaccuccuuggggacagaguaucuacauacauuauuugauauagugggguuuuauauucuaagaagagugcagggcacaguggcucacaccuguaaucccagcacuuagaccgaggcggguggaucacuugaggucaggaguuugagaccagccuugcaaacauggugaaaccccgucucuacuaaaaauacaaaaauuagcuggggaugguggcacacaccuauagucccagcuacucaggaagcugaggcacaagaaucgcuucaaccugggagguggagguggagguugcagugagccaagaucaugcuggacagagugagacuccaucucaaaaaaaaaaaaaaaaaaaaaaaaaaaaaaggaaagcuuagaaccuucuauaugauuuuauauguuauuuuaauauguuguauauguuauuuacucauauaaauuuacccaaguagcaucugaaaauaacaugaaugauugaaauauagaucgcucauacugaguuuauagcuuuuuucuucucccuauaauuaaaaaaaaaauagaacugaaaauuugauuaauuugcguuuucacuuaucuaugccaaaaagaagcuagcuaaaaaugaaacgggguagcuggagaaguagaugugaauauuuucuauauuggauaucaaccccuaauuaauaagugaugcacacuauguuucuuauugacuugcuuaauuuuuuucuuuucuuuuuuuuuuuuuuuuugagauggagucuuccucgaucugucacccaggcaggagugcaguggcaugaucucagcucacugcaaccucugccuccuggcuucaagcaauucuccugucucagccucccaaguagcuggaauacaggcgcccgccaccaugagcagcuaauauuuguauuuuuaguagagacgggguuucaccauguuggucaagcuggucucaaacuccugaccucaggugaucugucugucauggccucccaaagugcugggauuacaggcgugagcugccucuuucaaaaaaaggaagagccgggugugguggcucacgccuauaaucccagcacuuugggaggccaagguggguggaucacuugaggucaggaagagacaagccuggccaacauggugaaaccccaucuccaccaaaaauacaaaaauuagcuggguguggguggcgugcaccuguaauccaagcuacuugggaggcugaggcagaagaaucacuugaacccaggaggggaaauagaacgagacucugucucaaaaaaaaaaaaaaacccacaaacaaacaaaaacaugaaaguuaaaaagagagggaaccaauauuuacuuagaaccucuuguaugccaggcgguuuacauuuauauguguauuuuuaccuuuuuuuauuuuuuuugagacaggguccaguucccucacccaggcuagagggcaguggcacagugacagcucacugcaaccucaaacuccuggccucaagugauccucccgccucggccucccaaagugcuggaauuacacggaugagccaccaugccuggccuacauuuauguuaucugacaaacacucagagaacugauggggagcaguggaguauacuguccccauuuuacagaugaagaagcugagauuuggagagauuaagcaguuugcccaaaguuuauauagaccaaccuggauccaguccacgucuacaaaaccucuaaguguucuuuguauucuauuaugcaccccccaccauuuuuuuccccuauacuucauggugaauuugauaaaggggaggaggaaggaauaguuuguccuaauucauagaacauucuaaaguaacguguuuggcauuccacaugaaacuacuuuucuaugacuuauguaauuuauaaauugauuguuggcuauuaaguacuugggcaagucccuucacaccuaaaucucaauuucgaaauggauaaaaagagaacuuugagcaggccagccuagagugccucccagcagucaaaccugcacccggcuccaugccaguccuuucccccucuugucuaccugcacauccucugaggacuuucauuuucuugguauggauuugggcucuuauuauaaaagacuagcauuaauaaguacaguaaaaaguaggccauucauaacaauaacuuauuaaagauaguuuuauuugauuuuugauaaucuuaagaaaaacacaagugugugcacuaaaucaaguuggcaagacuguguaaucugaugccaaguauaaacugagcagacuucaggcuuacugacaucagauucuucgguuaugcuuucuuuuuacuuuuuaaaaaguacuucuaguuuccuauguuugggugguuucccuucccaagcuccuucccuacucuuauuccaauuucaguaaaaaaugcagaaaauggaggaaaagccaagaaaggcugugugcucuugcacacagugaagugaguggcagugcagaaaucagcagucucccuuucauugaaauuugcccaaguagccaagucuugaguagaguaagcccagacaggguugguuuucucugaauuaaccugagaggcuccucuccuuuacuuagggcaaagaagaagcuuucuugaguacuguugcaggaaaacauaaugauggcaaugcaguuaauugagaagcaaaauggaacauucaccuccucuucucaaagugaaauguuuauuuauuuauuuauuuauugagacagaguuucacucuuguugcccaggcuggcaugcaauggugcaaucuuagcucaccgcaaccucugccucccggguucaaucgauucuucugccucagccucccaaguagcugggauuacaggcacgcgccaccacgcccggcuaauuuuguauuuuuaguagaaacaggguuucuccauguuggucagacuggucucaaacucccagccucaggugauccacccaccucggccucccaaagugcugggauuacaggcgugagccaccgugcccagcgugaaauguuuauuucuucaaguguguaucaacuaucaggagauugucacaaaguagacugaugacagagaaagucauuuuaugcuucauguuuucuaaucucugaaaugagaguuacaguaucuauccuccuacccaaaagacuaguauaaggauaaaauaaagcaagaaagagcuuaagagguacagguguuacaccaacauaaugguacuuccauugaaagagcaagcuguucuagcagaauucgaaaugugagauuccaugcaaaucuucuagauaauugggcauuuacccuuaagcacuaaguggaauacuuaaaaaguuauuuauuuaguucauugauuuagguuagagacagggucuugcuuugccaccuaggcuggaguaugguggcaaaagugaucauagcucacuacagccuccaauuccugggcuuaggugauuccccugccuuagccucuugaguagcuaggacaacaggcaugcaccaccaccacgcccagcuaauuuuuuuuuuuuuuuuuuugagguggaguuucacucuuuuugcccaggcuguagugcaauggcuugaucucggcucacugcaaccuccgccucuuggguucaauucuccugccucagccucucaaguagcugggguuacaggcacaugccaccaagccuggcuaauuuuuguauuuuuaguagagaggggguuucaccauguuggccaggcuggucuggaccuccugaguucaagugaucugcccaccucggccucccaaagugcugggauuacaggcgugagccacccgcccagccuuuuuaauuuuuuaaagagaccaggucucacuauguugucuaggcuggucucaaacuccuggccccaaguaauccucccaccccagccucccaaauuguugggauuacuggcaugagccccugugcccggccauaaaugaaauauugaacaucauuucacuauuucuuauagauucaaugucgucaccaugaauacuaauuaaggagcuguucagggucuuugcccuucagucuaaauggcuucaggcugcugcgauucuuuuguguucuuccuccuguguucugagcucccauuccuuucuuacuuacagacugucagcuucccccucgugugcuguuaaagcgauuuccuucaucuuuuccaguguucugcucuggugcuuugaaaucugguaauucauuagcacugucuugauguaaaaguaaauuuggucaguaguggggaauugucaugauuugaggacaugaucuuuguagccucucaaugguuauuuaaucuaucauauacuauggacauuauuuuuauuuucuuucuauuuuuccucuacuaugggguauuuucuuuaguguuuguaagauucuggcacuuuaauaagacucccuguaguguuuaacagugguuuaaauuuuaaugauuugccuguagucccagaggcaggagaauggcgugaacccagaaggcagagguugcagugagcugagaucucgccacugcacuccagccugggcgacagagcgagacucugucucaaaaaaaaaaaaaaauaaauaaugauuugaaguaaguucugaccagcccuccccuccucuaggaagcuuuacuaaauuaggcaauggaggucauuacauuuucuucaucuaacaggaauuuugcugaguucuuaucauuucuguuguguagacucuuaguucuuccuuaggguaggaaccacacaacuuuccuagaaaauccuguccuuuggaacggggcuggauacuguucgcaugcaauugucccagagcuggacaggccacacugcuugugcugcuggaaucugcuagcugauauuugacuugaaguuguuuuucuaccuccauuucaaaagugaccagaaucuuuacuuuuucucugauaaaagauucagaaaaauuagauuggccuagcacgguggcucaugccuauaaucucagcacuuugggaggccaagaugggaggauuacuugagaacaggaguuugagaccagccuaggcaacauagugagaccacaucucuacaaaaaauuuacaaauuagccaggcaugguagcacgcgccuguaguccuagguccuugggaggcugagguaggaggauugcuugagcccaggagguugaggcugcaaugagcccuacuuuugccagugcacuccagccugggugacaaagcaagaccgugucucaaaaaaaaaauugaaucagugccuacguguuaauuuaaguguuccugaagcugguuugauuccuuuugugccuggcaggcuauggagcaugguccuacggcugucugcacauggccaugaacccccaaaauuaaaugcaagcauuugugugccuacaguuuucuucaacauuucgagaaauggccuuuaaacaauugucauacguuaauauauuauuguuucuucacuacauuuccucuccacaucuaauuaguacuaugucucauucagaggauuaaaaauacucucgacaccuuauuuuauuugcauggugugguaacgaugacagauugcaguugaaauuuuaaacuugucucagacaucucuucuaugaaaggaaaugacuuucuuauaagacagacaugugauguuugcaauggucauuauacuauaaauucaaaugauuauuuucuucauucuuaaucaucuguacaguggaagaagucacauaagacaguguggagcuuuuuaaaucucaccaaaucugaaucuuuuucaggccaggagaggacaaacaaaggcacugguuuuucugguggcuuuuaacacugauuuuauacaccacugagacacuguguuuagcucaucuuuucaggagguuauuugccguguucuagaaggagagauacugaaaucccucuuuuuccuuagccaucagauuugaaauuaaaauaugugucagguaacauguccaugcucauaaccaacaacaacaaaauggaaauggaaacaguuguauguagaggaggguggguguugggcauuuggcacuugugaaugccaaauauucacaagucgugugucugcugaauauuuucuuccuucccuuggcaagguagaacuucuuugaucucguuaagaaaaaaaaauguaaaauuaaugguuuaaaaauaaauagugcuguauagaggugaggcuuuuuaagcaagcacaccaugucugagcaaucuaaaguuaaaguauguuaucaaucaacuucuuucccauuuauuuuagaggaggagcaguggagauggagaccuuaugucaaguuugaaaaagcacuaaaggccuacauguuaaaaugcaaaauuguucuuguguaauuuagguucucccacagcuguauuccuuuguguuguuggauuaguuaacguuuaugccauaugcuugacauaauccauaguacaaaauaauccagaagcacaagaggucuaauuugucauaaaagauccauaacuuucagcccacugauuuuccucagguugaauaucuggcaauauuuuaaaaaauauuuaauuaguauuuauuauccauaguaaagcaaguuuaggauuguguuuauuuuucugaauuguuuucuaguugaaacccagauuuggaauagucaaaucuugaaucugcuuuuuagaauaaauauuucaguaugagaguaagagguugccuagcauguucaggauuaagugagaggagggauauaugcaagaguaauuuucauuucucaccugaggaaagaaaaaagaauaaaaucucaaagguauaauaacauagcauuauuaugcaucauauuaucaaauugauacucuuuggggaguuaauaaguuguuuaugcagcauuuccugauaaaauugguugaccucauaacauacuaaacuaaugucuuucugguguuuagucauggagaguaauaagaauaauaaacaugacuaaaaguuggcaaucucauauacaggggacucauaaguuuugaaacagaccucaugcauuucugaaauuaaaugaaacauuaugaaggcaguuuauuucauuucucuuuuccuuucuuugaaucaucuucccucauauucucuaacacauaagaacuguauuaacagagguacuuaggaugguuuacuuuuucucugugagugauauuaaggaaauauguaaucagacaacucuuuugagaaaagguuuaagguuuucuuuuucauuguaauauagucuucgaugcaagaagaauccuauuuguauauuugauuuaaagagcagaaaauggccgggugcagugacucacaccuguaauccuagcacuuugagaggccaaggcaggaggaucaccugaggucgggaguucgagaccagccugaucaacauggagaaaccccgucucuacuaaaaaauacaaaauuagccugguaugguggcgcgugccuguaaucccagcuacuugggaggcugaggcaggagaaucgcuugaacccgggaggcagagguugcagcgagccaagaucgugccauugcacuccagccuaagcaacaagagugaaacuccaucucaaaaauaauaauaaauaauaauaauaauaaaauaaaauaaagagccgaaaacugaacaauguuuucgucugguguagugggagggagggaggacuguaaauuuccuaccuguaagugacagugggugaagggugaacuaagcagccucuggcuguccaguguggauggaugacacccaauaauuagcuucuuacuucuuaacuuaguucagcccuuagauaugcaggucuuuauuuuuccugucuuauauagaaaguuacuugugcauacaaagauguguguuuguagaaaggagaccauagaauaagaaugaaugcagaucaacauggucauggaugagaagaagcaagcaaaaaucucuccagcugugggagaacauggaccaggaaaaccacagacaggaagcagcgcuaaaucuaaacgagucacagcaguaaguuucagcaaaugggaaagagaauguaagaugugcuguuuuuaccaaagacgugucagaguuugagcauugccuaccgcaacuugcaucaguucccucucucagcccccaguacucccacguuguugaaauucggauccccaccacccaccuuauucuuccacaauauguccuaugugaucuauucgaaucucauuaaacugauuuacugggcccgcuggcucugcucucccucaguuuauuccuacuuuguuuaaaauucgggaagugccgggggaggggcaagacauuaaucgcugcacuugugcaaacggagugccagcugauuuauggcaaagguuauaaaggaaaaguauuaagugugcuucauuccauuuggcaaagccauccugcacaauguccacagaaaccccaagaguccuguuuuguagaaagaaggggggaaaaacuucaccaaagaugugcucuucuucuuuugagcauuaauuaagacuguaaaucacaggccacaugaaacaacuguauacgacagaaugcggaugguccgggacuucugcugggcuugugugaucagucugaauaccuacaccaaagcccuaaugggagggcggacuucaaaggggaguuuuggcaugagggagaggucugcucuagcagggagagaaagaguuguaaaguacagacugcauggaaaaauagguggugggggaccaggaggaacgggggagagaaugagaguggaucaauguaggguuuuaucuuaaaaguaccagauaaguauugaauaauguauauucuucuauucuaagcaguuuugauuucaucacuugagaguguccuacaaaugaggggcaaaaacccucuguuuggcaggagagaaaaaaauuguuuuuaaacccaugugaaauguucuuuggcugcuuugcugacuguucaccagcuccuaaugcugggucucaggcuauuccuacagcuggcacuuagcucauuacacaugauccccuggaguggguuugcaaauagugaauuuaccuacuuaagucacuuuccucagugcaagaucagcuuucagcaccaauagaguugagacuguguuaugugccuuggagagcucuucugcauuccucuucuacccuaaaaaacacauugaauaccuucaauaaauauuuuuuucuuucaugauucucuuaaggcugauuaagcauauucuuugcuuuuggagauaauguggcugaucugccauuucagcauauguuucuuuuuccuccagcggggcuggauuucuggugauuuuuccucacacugaggugguccagugucuuucgguccaaucgcauguauuuucagcacagcaauccaagacuaagguuauguccaaguucauggcuaugaaacagaauuuuaauguuggaccuuugcuucauaaguguaguauuuuaacuaacugagguaaugcaacuaagaauuauacauggccucucugaaaaaauacucuuaucugugguuuguaauagugaacaguugaaagcaacuugaauauccaauaacaagaguuugguuaaauaaaucagaguauauucauguaauggaauacuaaaacaugguauagaaauauaggcauuaauaugaaaauguguucacaccauauuaucaaguuaaaaaguaauagguauguaugauuccauuuuuggcuuuauuuuucuaccuuauuaagguauaauugaaguacaaugaacugcacauauuuaaaguguauaguuugauacauuuugacauccacagacacaugugaugucaucacaguugagaugaugaacauuccauuagcaacccccacccccgaaguuuuccugugucucuuuguaauccauuaauccaucuuuccuuccauccucaucuccaggccaacacugaucugucuccugucacuagaaauuagacuguauuuucuagaauuuuucuagguuguaaauauauuucccuauguuuucuuucuuuccuucuuuuuuuuuuuuuuuuuuuuugagaccgagucuugcucugcugccaggcuggagugcaguggcacuaucucggcucauugcaaccuccaccuccuggguucaagcgauucuccugccucagccucccgaguagcugggacuacaggcgcacgccaccaugcccagcuaauuuuuguauauuuaguagagacgggguuucaucauguugaccaggauggucucaaucucuugaccuugugauccgccugccuuggccucccaaagugcugggauuacaggcaugagccacugcacccggccuucccuauguuuucuuauagcaguuucauaguuuuggguuuuacauuuaggucuaagauucauuaagaguuaauuuauauguauggugauguaugguacauaaggucaauuuuaauuauuuugccaugugaauauccaguugguccagcaccauauguuaaaaagacuuuguauauucccccacugaauugccugagcaucuuaagucaguagaucaaauaugcauugucuggaauaagcaguaugcacuuguuuguuuuguuuucuuucacucaguauaaugauuuugagauucauccauguuguugcguggaucaagaguucauuccuuuauguuguugaguaguccauuguauggauauaacagucucuucaacuuuuugguuuuuuucuuuuauuuuuuuuugugacagggccucacucugucacccaggcugagugcagaggcaccaucauggcucacugcagccucaaccucuccaggcucaggugauccuccuaccucagccucccuaguagcugacacuacaagcgugcaccaccaugccuggcuaauugguuuuuuuuuguuuguaucuuuuguagagcugggauuuugucauguugcccaggcuggucucgaaccccugggcucaagcaauuuguccgucuuggccucccaaagcguuaggauuacaggcaugagccacugcauccggccucauuguauuugaauuugcguuucccucaugacuaaugauguugaacaucauuucaugggcuuauuggccauuguauaucuucuuugaugaaguuucuauucuacuauuuugcacauuuagaaaauugguuuauguuuucuuauuaaguuuugagaguucuuuauguauuuuauauauuuugggcauaaguccuauguuugauauaucuuuugugaauauuuucuccuagucuguggcuugccauuuuguuuuguuuuguuuguuuuugagacacagucuuguuuugucacccagucuggaguacaguagcacuaucauagcucacuauaacuucaaacuccagagcucaagcagucuucccaccuugaccuccagaguaguuaugacuacaagugcacagcccagcuaauuacgaaagauuuucuuuuguagugauggggucucacacucauuauauugcccaggcuggucucaaacuccuggccucaagcaauccucccaccauggccucccaaagcacugggauuauagcagugagccaccauacccagcccauuuugcuuucuuaaugucuuuucaaaaccaaaaguuuuagauuuugagggagucuaauguauuauucuuuaaugguuuaugccuuuuuugacggggguggggggcagguaacuuaucuaaaaaacuggcugaguccaagguuguaaauauauuuucuuacauuuucuuauggcaguuucauaguuuuggguuucacauuuaggucuaagauucguuuagagauaaucuauauguauggugauaagggucaauuuuuauuuuuuuugccaugugaauauccaguugguccagcaccguaugcuaaaaagacuuuccauucccccauugaauugcucaagcaucuucauauaaaaucaguagaucaaauaugugcgggucuauuucuguauuguuauauugaucuguauaucugaagugauccuauuuuaauaucagcauaugauuaaaagcuucuggaagaauaugccuaaagaaguuaacaauaguugguagguuggagucuccugucauuuguauucucucuuuuuuuuuuuuuuucugauuuuuuuuucuucauagugaauaugcauugcuuuuauaguaauaaaaaaguuuguuuuggaaagaaccugcaggcacagcccaaguggugccaagaguuuggcauucugguaaguuuauugggaaacuuacuuauucuucaauuuuuagaauauauauugaacaacuucuguguuauauagaggaaacaaauauacauaagccagaaauaacuuuugcccacauggaacuuacagcagcuugagauguacagaaaaguaaauggacaccuuuuaaauaugugguuccaugauaagugcaaugaagguagaagucccaggaucuucagggaugacccagcagagggaucugcccaggcuuagggggcaaaagaaugcuuccuggagaagugcucuccaguccacggccuccuuuuaauacuccuuucacugaagcuaaagaaaaaaaugaggauguuggggaauuuaacuuugggugguagaaaguugaggguaauuuagugguuuauauuuucucugugaaacagagugaucuucaguuuccugagauuggagggcagaagauugaggaugaaaguuugaaauugagguuguggaaaccagugagaccaccaaggugggaaacauggaaugaaugccaggcaauggggacaguccaguugacggggaaaccaugauuuuaucugaggcuugggcuaucuccaagcuugguuuucugcagugugugggaagaggugccagggcaacaaccacacuacacaacuuugaaauuaagaccugaaaggggccuuaaagagaaguagaucagcuaucuaauuuuaaagacaagaaacaaaaagcccgaguuggagugagagucugaucuucugauucccaucccaguuuuguuuuuuuaacuuuuuuugugcccagaccauagcugucuccuuuaauaggcuugaguccaucagaugcaggaaacuuauuuauuuuuccugaggcauuuucucugcaauuaguauauguugugacucaguugaagaugaugccuuacccacagguagagucucacaaaaccagacaaaucgacuuuguuaaaaagagaagaaaugaacauuuucacaugaaauuaucaagaaaguaaaguaauaaaauagcuaggcauauuaaagaauacuuuauuuauuuagagacagggccuugcucugucacccaggcuggagugcagugguacaaucacaguucacugcagccucucugggcuuaagcaauccuccugccuaagccuccccaguaguugggacuagaggugugcaccaccacacccagcuaauuuuuuuuuuuuuucuuuuugguagagacaggguuucaucacguugcccagguuggucuagaacucugggcucaagugauccacccuucucagucucccaaaguacaauaccguauuuucuuuuuuuguuggagacaagagucuucucuuucaccaggcuagagugcaguggcgcagucucugcucacugcaaccuccgccuccuggguucaagcaauucuccugccucagccuccugaguagcuaggacuacaggcuugugccaccacacccagcuaauuuuuguauuuuuaguagagaugggguucaccauguuggccauggccaggaugaucuugaucucuugaccuugugauccaccugccucagcuucccaaagugcugggauuacaggugugagccaccacacccagccaauaccauauuuucaugacaacccugaauuaaaauaaaauuugaagaaauaaucacccucauacaauuuggcaccuuucuuacuauuugcuaauaguuaucaauucuugauuauuuuaauucuaguucccuuccacucauuaaguuacuuuuaaguaagaauaauagcuaacauuauugaaaguuuacuguugugucuggcacugcacuaaaggacuuaacaaauauuuucucauuuaauccucacaaaagcccuaugagguggguuguauuaucauuuccauuuuagagacauagaaauaaugggcuuagagauaacaaaacauggguaguuuuuuuuuuucaauuuuuaaauugugauaaaauauacauaacauaaaauuuaccaucuaaccuuuuuuuaaaaucuguuuuuuaagagacugaguuuugcucugucaucaaggcugaagugcaguggcacaaucauagcucacuguaaucuguaacuccugggcccaagugauaccccaccaccaccucagcuucccaaguagcuaggacuacaggugugcaccauuaugcccagcuaauauuaguuuuuuuuuuuuuuuuguagagacagaaucucucuauauugcccaggcuugucucgaacuccugacuucaagcgauccuccugccuugacaucccaaaugcguugggauuauaggcaugagccacuacgccuggagauuauguauaauauuucuuuaauuuuuaguauguuuuuuucuuuaagagaugagaucuuggucuguugaccaggcuggucuugaacuccuggccucaagcaauccucccaccuaggccucccaaagugcugagauuacaagcaugaaccacugugccuggccuaaucuuuguaauaugcuguugaauucauuugcuaguauauagaugagguuuuuugugucaauauuuauaagggauauuggucugcaguuuucuuguagugucuuugacuagcuuugguaucaggauaaugcuggccucauacaaugaguaaagaaauguucuuuucucuuuauuuuuuuuuuuaaagcuugagaagaauugguguuaguucuuuaaauauuugguagaauucaccagugaagccaucagguucagggcuuuucuuugucaagagauuuuuuauuauuauuuuuauuacucauucauucuccauacuaguuauaggucucuucaaauuuucuauuucuucgugauucagucuugguagguuuugcguuucuaggaauuugucuaucuuaucuaguuuauccaaucuguuagcauacaaauauucaugguacucucuuugaaucauuuuuguuucuguagaaucaguaguaauguucccacuuucauuucugauuuugguaauuugaguuuucucucuuuuuuucuuaguucaucuagcuaaagauuugccccuuuuuugguuaucuuuuaagaacuaguguuuuuggucucauuuauuuccuuuauuguuuucuauucucuauuuuguuuaucuuugcucuaaucguuauuauuuccuucaucuucuggcuuuggguuuaguuuguucuuuuccuaguuacuuaaguuauauaguuagguuguugauuuaagaucuuucuuauuuuuguuuguguuuauagcuaaaaauuuucccccuuagcaaugcuuuugcugcaucccauaaguuuuugcaugucguauuuuauuuucaugcaucucuaauuauuuuucuaauuucccuuuugauuucuucuuuuauuauuuaauaguguuuuaaauuucuacaaauuuguucauuuucugguuucccuucuguuauugaugucuaacuucauuccauuguacucagagauaacacuacagucuuacagucuuucauguucucucucuuuuuuuuuuuuuuuuuuugagauggagucucccucuaucacccaggcuggagugcagugaucuuagcucacugcaaccuccaccucccggguucaagugauucuccugucucagccucccaaguagcugagauuacaggugugcaccaccacgcauggcuaguuuuuguauuuuuaguagagacgggguuucacuauguugcccaggcuggucuugaacuccugaccucaggugaucuaccugccuuagccucccaaagugcugggaggauuacaggugugagccaccacacugggcaugacacuaaagucuuuuuaagucuguuucauaggucuauucuggagaaugugcugugcacacuugagaagaauauauucuauuguuauugcauagaauguccuguauauaucuguuaaauauaauuaguucguuauguuguucaggugcucuauuuccuuauuucucucuguuuguucuauucuuuauugagagugaaguauugcaaucuccaacuauuauuguagaacugacuacuucucccuucagucuaaguucuaucaauuuuugcuuucaauauuaugauggucuguuacuagguguuuaaauguuuguaauuguuacaucuuauugcuguauugagccuuuuauuaauaaaauacauccuucuucgucucuucuaaacucuugggauuuaaucuauuuuggccagguguggugacucaugccuguaaucucagcacuuuggaagacugaggcaggagaaucgcuugaggccaggaguucaagaccaaucuggacaacauagugagaccccccuccccgucucuauagaaacuuaaaaaauuaacugggugugguggcacaugccuguagccacagcuacucaagaggcugaggugggaggauagcuugagccugggacgucgaggcugcagugagcuaugauaaugccacauuacuccagccugggugacagagagagagagacccugucucaaaaaaauuuaaaaaaaaagacuauuuugucuaaaauuaguauaccuacccugcuuucuuuuaauuacuauuuauaugggauauauauuucuauccuuucacuuucaacuuauuugucuuuggaucuaaagugaaucucuuauagauaacauaaaauugggucaugggucauguuuucuaauucagucugccaaucuuugucuuuugauuggagaguuuaauccauuuacauuuaaaguaauuacugaugaagugagacuucugucauuuugcuuuuuguuuucuuuuuuauguuuuuuaaauaaaauuuuuuuaaauagagacaggguuucaccauguuucucaggcuggucuugaacuccugaguucaagugacccaccugccucggccucccaaagugcugugauuacaggcgugagucacugugccuggccagcuauuuguuuucuauauuccuuauggagaagcaauuuuuugacccucauuuccugcauuacugucucuuuagaauuuaguuguuuuuuguuuuuugugagacagagccuaagucuguuacccaggcuggggugcaguggugcaaucucagcuuacuggaaccucuccguccuaaguucaagugauucucaugccucagccucccaaguagcugggauuacagaugugcaccaccaugcacggcuaaccaugcacucuaacuuaaguagagacaggguuucaucauguugcccaggcuagauuaguugauuuuuuguagugaaacauuuuaauuugcauuuauuuguauauuccguaacuauuuaauuucuuuguauuugccaugagaucacauuacaacacucuauuuugaauuuacacuaaauuaguucaauaacaugcuaacuucuguucauuuauagcuccauccucaccucuguguuauugaugccacaaaacuacaucuuuguacauuguaugcucagaaacacacuaauaauuguguuucuuaguguaacagucucuuaaaucauguagaaaacaaaaaaguagaguuaaaaacaacuuuacagccgggcgugguggcucaugucuguaaucccagcacuuugggaggcugaggcgggcagaucacuugaggucaggaguuugagaccagccuggccaaccuggugaaaccccuucucuacuaaaaauacaaaaauuagccaaauacaaaaauuuagagauggggucuugcccaguugccaaggcuggaaugcaguagcacaaucauagcucacugcagccucaaacuccuggacucaagugauuuuccugccucagcacucccaaguagcugggacuauagguauguaccaccauuccuggcucuuuauuucuucacauggcuucagguuacugucuaguguucuuuuauuucaaccugcaagaccucuuuuggcauuucuugcaggacaguucuaguaguaaccaauuuccucaacuuuuguucaucugggaaugucuuaauuuccccucacuuuugaaggauaguuuugcuuggauauaggauucuuggcugaggguuuuuguuuguuugcuuucuuugcuccuaguacauugaauauacuagcucacugccuucuugccccuaaaauuccugaugagaaaucaguugaugaucucauugaggauuucuuguaaaugaugauucacuuuucuugaucauuugucuugguguggauuucugaauucauuauacuugaaguucacugaauuucuuagauguuuauauucauaucucucaucaaauuuggucaguuuucagccacuguuuccucagauaaucuuucuaccccuuuucccucuucuccuuauaagauucccaugaugaugaguauguugguuuaccgauggcaucccacaggucccuuaggcucuucucacuuuccuuccaucuuuuuucuuucuguuucucagacucaaucauugucuuuguccuauuuucaaguuugcugauuuuuuucuucugccugcacaaaucuggccaaauaccucuagugaauuuuucauuuuuguccuuguacuuuucagcuguagaguuucuugguuucuuuuuagguuuucuaucuuuuuauugcuguuuccauucuguucauacauuguuuucuugacuuuccccacaucuuccuuuagcucuuugagcauauuuaagacuguuuuuuauagucuuugucuaguaggucugcuaucucaucuuucuuaaggacaauuuuuguugguuuauuucuuucuuuugaauaggccacaguuuccuguuucuuuaugugucuugugauuguugcuggaaguuggacauucgaaacaaauaaugugauaacuggaaaucagacucucucccuuuccuaugguuugcuauuuuugucuuuuuuuuuuuuuuuuuuuugagacagagucucacucugucacccaggcuagagugcagugacaugaucuuggcucacuacaaccucugccucccggguagcugggauuacaggcaugcaccaccaugcccagguaauuuuucuauuuuuaguagacacaggauuucacaauguuggccaggcugguuucgaacuacugaccucaggugaucugccugccugggccucccaaagugcugggauuauaggcgugagccaccauacccagccugcuauuuuugucuucauccuauuuuguuuuuuauucuuguaggcugucucugugccaaggaucagccugagguauaaacuuaagguguucucaggucuuuucugagccuguacauuucacugggcauguguggugacuuguaaauuuacuccuucuaugcauugcuuuugcauauucuauuuuuuaaugucuggcucccaaaaggggaaaaggagaaaaaugaagaagaaaagggaugcugguccuuuaaaaccucuggcaauugcuuuagcuggaggaggaggaccuuguaauaaagggaugguaugugcaacaaagacagccugccucuaugucuacacuccaugauccaaagcagcaaucagugaucaagacauagauccuaaucguuggaggauagagucccuuuugcacacccuggcaagcugcuccaggaguacauacacagcugccugccauggggcugagagguggggaauggguagcugcugcugaguuaagagcugaaauugaccaaaauuaaccauaauuugacauccaagccuuccccuagagguugcaugaguuccaaaauaguuacaugagacaaauuuugccaguguguuuguugucuagcugagaagacaggucccuacuccuucuuuccagaauccucucucccaacugccauuucacacacauuuuuauucuucuagguauauuuuuaggaaucuuauuuugauuugaauagaacuuguaaauucaaaugucccauugcuagagaauaucaaaugagacaauauaugaguauguauuuuuaaaacauuuuuuaaauaaguaaguaaucuucuuucuuguucacacucuuuauaauuagaccauaaacuuagaaaguucagaaacagcuauguuauaagaagucccuuugauugcuuauggucaucuucacuaucucaggcugcauuggaggaguggggagaggcucagagcuuuccucaaaggauaaggacaugccuuuaaaaauagacagagagccuuuuuguguauauggauuuuauuaaauccaagaguauaaaacuauauuuggucccuguauucauaaaaggcugccuuaaguuuauuuucaucuaagagaaaagugacucaaucccuguuauguuugucuaaguuucuguauaauucaacacauugaugauagaaagauggauuauccucuauagcuacuauuuugguuacucauaaauguuuuugaaacauugugccaauuuaucaaaaaagucuauauuccuaaacccacucauuucaggaaacaaccacagcuauuuuuuuauuguuuuuauuuuguacugauugaaauauaggccaccuggaauuagcuuccuucugucucccuuauuauuaaauucaaguguauaauuuuaccccugauguguucagugaagcaugaucaaaauguuacuuuaaaaguuaaaauaagcuaguuugugaaacaguaguacuaaauggguuagucacaaaucuauugucauauaauauuagaaauaaguauuucuugcugacaucccugccuuaaucaguuagcuaguccauagcggcuuagcgagauuguguuuagccuauuucccgaauggcaauuaagaaaugguuuuauuuccuaguaaagguuugccagugauauuuuucuggccuguccaccucuauaaauucuccgucuccaucccucccuuuacaauacccacaccucucuugaaacccucuuacuuucccugaucacuaagaccaaggcauucaaaauauuuccuguguguuugggcacugcccagcgaggaagaaaugauuaagcagccaaauguuugaaacccagcuacaugcacugguuauuaucugcuuaacucuuucuuaucuugaacugcgaggagcuuaauggcugggacccauuguucuucucuugacauuaaugaagaaaucagagcaugcagcugauuuccuaagauggcugagagugacaugcugaauugauugauuuguccucuucucuccaggaccauucuagcuagacuagagcaauggagggugugggguugcuggaauaaacacaugugcacauauuagcacacaugaauacgagcacaccaccuccgucuaucugcaggccaggguguauuuaccuucuaguaaaaggauugaagaggcucucagauagucugcuuaagagauauacuguccuccuaguuucuguucuacuuucucagugauuaagaauccuggcagcagcagccgucugcagcuuuucucuguaaagcagacuucacaguucaaaccuguauccugugggcucagguguuguccagauacauaccuacuugacuaaauugaucagaagguugucuauuucuuguuuguuaaaauuacaagaauuauuauuaauuugcaguuaugaauuaagaguaaaagcucccuuuucaauguuaacaacaugauguguauccuuuauuaccuuccuaaaugugcauauaauuauagaggaacaauuaagauagaaauauauaguguuuucugucauuguuuuggaaaaacagaucauauuacuaucuugcauuugucaauaaaaggaugaugaaaauccuucuacagucacuguuacaggucuuaauuuggccuggcauucaaugcuauguuugacuauaguauauucaaccauuccugcuaaugggccuuaguuuacuuuccuauuuuuuccccacuauaaacaacaugacauucuaggagagguaauaguaacacaguuucugaagguggaccgcuuggauuggaauccuauggcaccacauagcaaugcuuggagcuccagcaggaauguuucuuguguucaauucuguuuguucucucuccuaggucuuuugagcuggcauuacuauuaauauuacuguaugucucucuguuacuuuucauugucauuguucuuugagagaaucuucuugauaacauaaaauaucucccaggcccuaccugcaaacauuguauuuuucacauuguucaaagguuaguauuuuuguucaggagcagaaugagucacuuaaggaagauucuaaauugaaaaauaucugggacaucugucucaaauaaugauuaagaaaaaagccauugcuuuagguuauugcuguuauguucuuuuacuuucauuaccuuaaaauacguuuuuuguuuuuccugaaaauucaaguaauaccuacuaauuauagagaguuuggaagcuacagaaaaggcuaaaaauuaaauaaaaccaucaggcaugacuaugaagaaauagcaugagauaguuucuuggcaugauggaaccauuguguauccugauagugguggugguuauaugaaucuacauguguuaaaauucagagaacugaacauccccccagaaaaguuugaccguauaauaauuuuuuaaaaguuacguaaaaaauagaaccauccauaauuccuccacuuagcaucaaucauuaucaaccugguaacaugguggcaucguucuuccuaguauuucuuucuuuuuuuuuuuuuuuuuugagaccgagucucacugucacucaggcuggaguauaauggcacuauauuggcugacugcauccuccaccuccugggcucaagcaauccucccaccucagccucccagguagcucagaccacaggugcaugccaccguguguggcuaauuuuugauauuuuuguagagaugggguuucacuauauuucccaggcugaucacaaacuccagaacucaagugaucugcccaccucagcugcccaaagugcugggauuacaggcaugagccaccaugcccagccccuucauuauauauuuuguaaaacauuuuuaaauguuuugauaauauuuaaucaccagauauuucuaauucacauaacuguucucuuauuagaguaccuuucuucaguguuaccuuaaaaacuaaguguggggccgggcaugguggcucaugccuguaaucccagcacuuugggaggucgaggcgggcagaucaccugagaucgggaguuugagaccagccugaccaacauggagaaaccccgucucuaccaaaaauacaaaagaaaaaauuagccgggcgugguggugcaugccuguaaucccagcuacucgggaggcugaggcaggagaaucgcuugaaccugggagguggagguugcagugagcugagaucaugccauugcacuccagccugggcaacaggagugaaacucugucucaaaaaaaaaaaacaaacaaacaacaacaacaacaaaacaaaaccaagugugaacaaaaauuguuaauguaagaaugaacguuuaacuucugguuuuucuagaguuguccucagaauaaaaccuggucuucuggagacaaauucuucucuuaucaugggcuaugaaguuuuguaccucaacuuaugcacucacccugcugcagcuaugucccuguagauccuagaacucacggaguucuucccgauuuuggagugcuagaaagcuucucuucauccaacguuacuucacuaucauacugccccucucuccccauucuacaaggcuaacacauuuuggggggaggauggaguuucacucuugucaccuaggcuggaaugcaauggcgcauucucggcucaccgcaaucuccaccucccguauucaagagauucuccugccucagccucccgaguagcugggauuauaggcaugugccaccacgcccggcuaauuuuuguauuuuuaguagagacaggguuucaccauguuggccaggcuggucuugaacuccugaccuuagcugaucugcucaccuuggccucccaaagugcugggauuacaggcaugagccaccacaacuggcccaaggcugacacuuuuaagccuuagcuuaaaagucaccucacagaguggucuucucugaacacccaguuucccuucacuguuauuuucucucacacaacacaaacaauugccauaauugguauuuauuuuuacauuaacuuguuuauuguuguuuucucucgcuuaauuauaagcuccauggagggcaaagacuaugucaguuuugcugaauaucauauacccacugcuuagcacagugccuggcauguagagggagcucaguaaauaaucguuggcuaacugaaugaaugaaugaauaagagcuaucauguucucauaagacauagaucuaauuauuacaaaaauauguuuggagagcuuauauucauauuuuauuuuauuuauuauuauuauuuuuuugagauggaguuucacucuuguugcccaggcuggagugcaauggcacgaucuuggcuccccgcaaccuccgccucucccggguucaagcgauucuccugccucagccucccgaguagcugggauuacagcaugcaccaccacacccagcuaauuuuguauuuuuaguagagacggcguuucucccuguuggucaagcuggucucgaacuccugaccuccagugauccgcccgccucagacucccaaaguacugggauuacaggcaugagccaccacaucuggcccagauuuuaauauuuuuaaucgaauuaacugucagugguaucaagauugcucagugaccaucauuguaucuuaaucuuaugaaauggguugugauccucuuauucuacacaggagugaauauuuuaaaagcuagggaaucuuuuuccauuuaguuuuuucuuacuuuaauuuuuuuucuguuuuaguuuuaugcccuaccuccuuaaccccacuauaugugugaauauguacuuguauaucucaaucuauauuguuaaaguuacuacuggcuuuacaauucucaauuucuuuggaaagcaaaagcuuuacacucuuuuuuucugccacuaaucacuuuuuguucuuuccuuuuuuucuuucuuuuuuuuuuuuuuuucuguuccugcucaugacuaaauucuguugcuaacauucuaugagucuggcugacaagacucuuaauuccauuucucuuucuugaacuguuuagaagaauuuaaaguuauaauuaaguaacuaaauggaauacuagguaaauuuuggcacuagguauugugagucaguugguuuauuuuguuguuaauaaaucacuuaguacuuuuugccaagggaagccagaaguaaaucaucauugcagaguguaaaauagauaguauugaacccagggcaaacauuuggguaugagaggagcagcaguacuguucaguaucuggccucaaaucguaucaccucuuuccgcccuucaguuucuccagucuuuuaccagugcuuccuggaaauucuuuauuuucugauccaaaguggaucaaagaccuagcacuacaaguuuaggcuuucauuacuucccaugcaggugaauggaucaucacuauccuugugauuguuaagcucagauguaagcaugguaguuaucaaagacagaauuaagucagguuccuucuaaagacauccuauccaccuagauaagacaagggaaagcaagaaaguuucacucugauuuccagugagacuuaggugauaagaaaaaggcagugaacgucauuuucauugaguuaauacguagacacuuuuggaaaguucacuuucccuuuaaagugacuagagaaaacaaagggcuagaaauauuaaauguaagauaacccuuaaagauaagaugacugccacuugagcccaggaguucaaggcagccugggugacagaacgagacccagucucuuaagaaaaagggagaugcauaugguauuagaauacauguuuaagugauuuuuucaacuuuuaucuuucugguaagcuacuguggcuagaaaaugcaauuucucauccaucuuuccaagguucuagcuaauucaggaacuaucccaauaaaacaccaucauuguuaugacauuguucaggugagugggaauaacaguguuaauccccagagaaguggcuauugcacaagucgcagagggcagauugggugucuguagaaugcaaaacuugaauuaaggguugcaaguccacacuuuuacugcuuuccuugagauaugugguaaaaaaaaaaaauaguuucauauuagacuguuuaaaaaagcaaacagacuuuauuuaguuugguagauuuucuuccuggugucuggaacuacgcccucauuuauuguggcuuauucaaaacagcauauuuuaaagcaguaauuauagcacagaugaucaacaaaggcaaauauaugugccaugcuaaucuuuguacaguauuuugagaaaucaacguuguucucuuuuauuaguggcugaaaguaguuaaauauuuucaguaaaaaccuuguugacacucaagguauuuuuauuuuaagaaacaauggagagacaaaggcuaaaucucuguuugcuuuucugugacuaucacugauucucucuaaaacggggucaacaaaaugauacagagagguaagaauaucuuugugcuucagucugauugggggugcgggggaagaucuggaagagguuggaucuuuaaaacucaauguagaguuuuccuuaggcaaaagcuaaacaaaaccaaugccuauguucuagagaaauguccuaaacaaucucuucuuccccaccaagguucaugagauagaugcagagccuacuccguauccucaugggugauauuauuauaaaauacacugucacacuuggcgccuccaaauaucugauuauuuaccuugagcaagacaaaaaugucaccauuguuugaagaaaugaaaguauuaguccugaugcuagcagagcugcuuuagagaagaagggaaaaaaaaacaaaaccaaaacaaacaaaaaaaaccaccaccaaagaacccuugguaggaugcuaaucaggccuauucagaaaagcccuaauuaauguaauuaaaaucugucagaucaaacugauuagccugauacucaagccgaguggagggaguggggcuccuggggggaggggaggcagcugcugcuaaggugggguuagcuuucagaagaaggaggugguuggucuccaaggugaucaaagcaacuugucuuucauuuccauggagggaggacagugggcuccuggcuggagaccuaguuuccugugucucuaguuguucucccgcaccgaaccauucagguaggagaagcagggccuuucugggcugugguggaaggcagcuggggaggugucuugucuuccucuuugacagcuagaauauagaugaagcauuuuuccuccccuggcaguccccuguugcagucauuggucaugaccaccgacacaccggcaggaaggagacaaaggcugugucaugugaucuuccugauagggcuguugacacaggccucuugugaagauccacauucuggggugggagagcagccaguggccucugcccggcagggcucugcgcuggggagagggagaguucugcucaggggcagcccuuucagaggucccgaggaaguuuccaggcggcuugaguggaaaagugaguauuucaucaccagugcgagagucuuagucuagccaaauggaagaagaaaggacaaguaaauucgggguuaagaaauucucugagcuucuaaucauguccugagauauauucuuuccuggagggguaaaaugacauuucucuuaauaacaguuauucugaaguucagagaaggucauugcaggucuuuaucacuucuuuacugauauagaaguuuaaaaagcaagacucacuuaagagauuggugcuaaccaccugaagugauuuuauaugaucuuuccuugcuucuuaacaaacaggacuaaguauccugggucuucaugauacuguagucauauuguacccauuuugauuuuucugcuaacaccaauaucagaaauaacuaggaaagaaaaaggaagaauggagauauugaaagaauuuggaguuucagcuuuuuuccucaguuguaagugcuacauguaguuguacacagcauuuuuagucacagccuagcaauuaaguuuauacaauuucuugaguuuuugaaaacagucagagaaguaauuaauuuggguuuugcuagcauaguacaccuuaaaaauugucuuuaacagugggguaggucuuugauggaaaugccuguagaaagauggacagacacaugaauugugggccaaacuguaaguugagaauugcauagcuucuuuucauuguguaugguuuagcuaauaacacaagaauaggauguaaaaagcuaaaucuuuguuguaggaaguuaguaggaccuaaccaggggaaaauguguauuaggaucaccacugcaaugcccucuucugucauccuuaucuuccuuaucacauuuugcuaccauuucuuauagugguugcaccaaaggaauaagaauuacaagggcuuucacuaaaacuuuaguaagaaaguaagaaaaccauuucuggugacaaagagaguaggaacuaggaguugagaaccuuugauaguugucaguuuuuacuaugguuagccaagugagagcaaauccuauacuccuacccucagucucuucaaagcuaaugcaggggcugggcuggaaaagugcacagaucuaaacaccugggacauuuaaaugaauaaauucaaaguagaagcauacuccauuuucuagcugugaaacugcauauuuggcaguucuuaaacggcuugugccagauucuaaaauguagugguaauaaguaaaugaguguaugccuuuguuucugcuuuauuugguaugaaugacuagaaaugggaaaaguuccuuuuccuuuucuagaccucuaauagcaugggcccugugucugucaaaaacaauaucuugcacuuugggaggccaaggcaggaggauugcuugaagcuaggagcucaagacuagcccggacaacguagggagaccccaucucuaccaaaaaaaaaaaaaaaaaaaaauuagccagacaugguggugcauacucauaguccuagcuacucagguggcugaggugagaggauugcuggagcccaggagucugaggcugcaguaagcugugaucaugcuacugcacuccagccugggcaacagagacagugucucaaaaaaaaaauaggaaacaucucuagaaaaagcaauaugaguguguaguuaugggcaggacucaggcacucagaacugaccacgcugcauuauugugaugucaacagcuuaguucuguccauaccuguucugaucagaccgcugagccuauguuugacuuagccccccuuuccuacaauuucacaauuuuaugacucuccugguugcacugauauccuugaaaaagacagcugaguucaguuagugaaccugcaguaaagugggguugccuggucagcacagggucuuaucaggagagaaauguguuuuauggaauacugaaggccagaaagguaggggaaggcuuuucucuuuuuccuuguuauuuuguccugcuucagauuuaaccuuuuccacuucuuaguauuuuagagcucuuuucucuaaaugugaaguaaaugccuuccauuuuuuuuuuucuuucugagacagagucuugcucugucccccaggcuggcguacaguggcgugaucucggcucacugcaaucucugccuccuggguuccagcaauucuccugaguagcugggauuacaggcaugugccaccacacucagcuaauuuuuguaucuuuaguagagaugggguuuugucauguuguucaggcuggucucgaacuccuggccucaagugauccauccaccucggccuccccaagugcugggauuacaggcauggaccacugcgccuggccccauuuccaauuuuauauuagcacuuuuggaggcagcagagaaugugggcacgauaguauggugaguaugagagagagaacagagagaacagaugcuguuacuggaaagcaaacuacuugcagcucccaaagccaauuauguuaccucuccuauuucuauaauagaggagcuugacagcaaauguugaaaucuguaacuuccuuucaccaacaagccucaggugacugaccaagucguguacauuuuaugucuauaugaaugugcuuuccaugcaucccuuuaguaaacagacacuuccaaagucacuucuccagccauacuucccacaguucugugaguccuucauuuuggccaguguggaugggaggauggccugagcucuugccuccccucacagcuuugcuuguccagcuguggcugcugggaugccauccaaggcucagcuccgaugacaccuucuccaccaccugcccugguuccccuguccucccucccugucuuccucuccugggcugcuucuguggcaucuaucauuuccuucccugaauugcgugcacaugcacauggccacacacacacacacacaaacacacaggugcauuguacuaugccagacuggaaacuugugccuucuccgugccuggcaccaugucuguaauuaacuacccacugagcaaaugaauauaggaaagaaugauaaauggcugccuuuaccuuuaaauuagauugguuccuuguucucucgauuguccguuucucuuuauuucuugucuuuuuggccuugagaaccugaauuuaggccauugagaauuucauacccacacuuucacccucauucuaaccugcugaccacuuuuuuaguucuccuacaaaugcaaaauauucauauuuggugcagaguagcauaggagaugacacugaguaaggagcuugaaugcuagucugaacuccaaugcuggugugaugugaacuuggaaaagucaccucaucuuacugggccucugcuucuauuuccauaaaaugagaggguuggacugacaguccuucucagauaugugccuuggauccauaggcugcuuccacaaccagauuucugguuuuaucuacucuguuuguuaguguuacucuaagauuucaguaggcuuaauagaaguaaaaaagauaaacaguagugguuccauuacuaagauaaaaucuuggauaaguuauacucuacuauauuaucucuaagguucuucauggaauucuaaacuagugugauuugaagacaucaugagaagagcuuuacuaaaauuaaaaugaaaaccuacaagaauuauuacacuuaggaauuguuuuuuuuguuuaguuuugcaguugcuuaugguacuuuuggauauaaaguauugagauuuuuuuaacauuuacuuuuuauucuuucacaaaaacagaugagcucguuucugaagaauguauauuccuaagcugucagcuuucugcgcgugcuagguucucucccuucauccaucuuaccugccaagagaaaacuucccucaccacagaaggcuguuuggggacuggguaguuuuguaugcuagaugucuuacacaguuacaccuucaaacacguauuuuguaacagucaguacuuagguggauuuuggccauucauauucuuucucuuuucuucucugaguuaaaauaaagcaaaccaauauacccacaucuaaggaauucagagaaacacuauucaaaaguuacaaguaaagcaaaacuucuuaaaaaggcauauccuuaaugaaaaaaaguguuuacuuuuuguauuuaaaauuuagugauaaauugugcuuagaaagaaauauauaaaaauauauuuggaaaagguacauccagaaaaucuuuaugccugauggguugguuuugucacuauaccuguaguguuguauccauuaaaauaaaaaaaauuacuagaaaagucagguuucaccuguuauaauauauccacaauguuauccauccaguuuguguauuuuuuucauucagagcauugagcccgacugaagagaaacuuaagaaggaucacaaagccaguuuccuuaauuguaccuaggaaugaaaaucaugguaacaagaauaucugacauguaauaagguuccuuguuaauuguuaacucuuugaguuggaccuggcuccuuaagcaaacauaaccucagugggcuaggucuucugcccccgcagacccagucuuagggacuaagcuuguagaccaaggaggccucuuccccaaacuaggagaguggacucacagcaggagggcuuucacugucucuucaaacaggaagggaaggaaucauguuacuuaaacugcuauuuucacauaaagaaggcagagaagggggacugguucuguaaaugucuuuaagaucacaggguagcugaccugacuuucucagcuguuauuuugcuuguuuaacugacccguugucugagcagguguguggugccgcaaaggauugcuuaggauagcuggcauaacuuuccuuuccgucuggaaaaaagaggggcaaagaguaggccacaacaaggcuugguuaggaagauucuggagucugagcccuugaagggggaaaugaugccgaagucugaauuuucuuuauagaaggcaaaauuauuuuugaaaaggugaguggauggccuaugaaguauuuggggaaugguguugccuguauauuuuccagguaaccaguuuguuuucuuaauuuuuccauguguaaauuggagaaucagaauuuacacgaaaaaauuaauguuaugcuaauugaaauaaaccacauuuaaaaagacaaauauuauauaaguccacuuauuugugguaucugugucaaguucauagacacagaaaguagaauagagguuaccagggacuagggguagggaggaaugaauagggaguuauuguuuaauagguuuggggaggaugaaaguucuggagauggauacugaugaugguugccccacagugugaaucuacuuaaugccacugagcuguacacuuaaaagugguuaaaaugguaaguuuuaugccauguauauuuuaccacaauaaagaaauauucaaagacauauuugucauaagauauaccaaaggaaaccuguaacaacuugguccagggccuagaaggcuaacaugauuaagacauagcaagauuuuuuguuuguuuuuucuuaaguagacugaauauuuuggcaagauuuuuuuuacucuauggaagauuuucacauucuuuguuuuaaagguauggucgucuugaauuucugguuauugaugccuuuaauguuuuuuuacgcuucauguuuacauuuaacuaacaauguaaaaaauaacuaucaacuugcuguuaauaauguauaucuuaccuuauccgauuguggcauaggaaaauaucuagcguauuaaauuaacaauuguuuuggauccucuguuggaagacagacugucuccuugaugaugcauuggguaggauggcagauuuacacccgaauacgucucaacuagaugaguaaaaauacaucacuuuaaaaauucauggucaugccgggcgugggguggcucacaccuguaaucccagcacuuugggaggccaagguagauggaucacgaagucaggagaucgagaccauccuggccaacaugguaaaaccccaucucuacuaaaaauacaaaaauuagccaggcauggugcacaccuguaguccuaauuacucaggaggcugaggcaggagaaucauugaacugggaagacugagguugcagugagcugagaucacgccacugcacuccagccuguacaacagagugagacucuaucucaaaaaaaaaaaguuauggucacuauuuagaggaaauuaaaaccuaaaaaaacccucaaauauuaaauauuauuuuucacaaauuuacuuccuaauuuuuggaguagaauuuuauuuuaauugcauuuuuauuuuagaaugaauugauuuuuagauuuuauucaguuuagggaaacuggacucaauuucauuucugccuucauccgauaauuuuuauuuacacugguuuaggagcuuugccuauggugacccucuucuucucuacuaucucccuguccccaaagaagaaaaagccuuguugcaaauaauuuaauuugaauuucuaaucaagucguuuuugaaucagacagaagaccucuuagugaaaauuguaacccaguuggaaauuaaaauuaaagcaaccagaaauguugucauaaguaaucuuuuguaaguagccuucuccccuuuauauguuuuuuuccuguuguauuuauaguuuuaaaaagaaaaaacacaguugagaccccaauuuagaaauacauaaguauucuauuguaucuauuauguauucuaauagaauacauaaguauucuauuguauccauuauguauucuaauagaauacauaaguauuguauuguauccuguuuguuuuaauucuugaaauacacuuauuggcacccaaggacucuuaggaaacuuuaaaaugccaacacucuaaggaggcucacuugcucuccuugggaccuaguuauugaguaacaggguugaagccaaaacugaguucccugguuggcgaggcucccugaauacaagugucuuggcuaauguccuuuuucgugguuuauuuuaccaguagcacagugugcccaccaccccccagcccuccaccccccacaauguauacaauacucuggguagaaaguucaugccuuagagcauccuuauccccuaguuuacagaguggugagaucuuuugaaugagugucuagaguacaaagguuaugaaccacuuguaaaaagucacagaauaaaagccccucugggguuuccuugcagagcaggaucauuguguuggucucuuuuuuuuuucauggagacuagauucguagaucauaggucaucuguguaaaggaucagucugccuauugcuugguuaagggguugaccaaagacugauggugucaugagguagcugucauuauuucauugcagcagggaaauagaaaacaagaucaucucaacauuuuuacagaaacacguauguauaaagaaaacugaaggaagauacaaacucagguauuuuacaaaaugaauuuuaaaugcuuuuugacucugaaguaaaugauuugccucuuaauccuucuuuaaagcauuuaaaaaucuuuuguguguauaccugguguauuuguauaaaacugaaaaucagauugcuacuuguuccuuucugucuaucucucucucacuuaaaacuaauucugaauugggcaggggcagauggugucuucaguauuuggcuuuuuuucaagauuuucuuuuaagaauaugucaaguauucuaaagaccauuagaugaauuaaaaagcauggcucuucugcuaaaacaauaacuuccauguguuuucuuuugugcuuuacaaaugaauuuaugaaagacuuggauauuucagccuaagaagaucagugucagauuaauguauaagcuuuaagaagauaaggaccaugugcauuuuacuucuucagguagaacuaagaauagcuacaggcaguuuaaucaauuauuuaauggugauuggaaugaacaauagcuauacuuuuuaaggagaaagaagaugcuuaauguaaugcuuuucaaauuuuucuaugccauaaaagguauauauuucuuugaucuuuaugagaauaguguauauguguucuuucauaagcaaaaacauacuacugauccuuugacagaguggauacauauucugaauucauagcgagaauaggauuuugacauuucauacacaucauuuuacugaagacaucucuagcaugaauacuggcaauuuguuuauaauuuggaacaaaauauauugaaaugacccauacugcuauuggaccugugaucuggguuucaucagcuaacuaggacuucucaguguggccuguccuggauuaucugagccaaggaaggaaauaauucucacgaagcaugacuaguuaaaaaucacugcuaauugaaccuuccuagcauuuuggcuguuaggauacugggcaggguccuuaaauguguaucugauaauacuuugcaguuugaugaagcaaaaaguagaguuggcuuuuacgggaauuuuuuucuuggauuuaguuauauuuaugugaacaaaaucugaucauuacuuugggaagauacauacaugucuugcauuauuauauacaugagagauauuauuaaucggaucagggccuagcaugugauuaguagccugguucacuauuauaacuaguugucuuuacaucucuuaugguuuauuuacuuguuagaacacuuuaaauggaaaaugcuugucauuugaguaucugaauccuuagaggaaaaaagaauggaguauguguccccuugaaaagccugcagauuagauuaucagcacaguuaauacguaagggaccuugugucucccuaacuugccaauaucuauuuguugaguguugcaagaguuugcuaauuaaacaguucacaagaugcuuugagcagaacuuguggacauuucaccaauugaacauuuuauugcugccguugaaaaaagcuaguugguguuuauuaacuaacuuucuugccaugguucuggagagucauggguacagcucugguccccgacucuagauuuuuagagcucagagucacuauugacacuuugcuugcaaacgugccuguuguuacuucaaggcacaaccaucacuuuacugaacuugcaaauaugaauuaaguaacaagaugcuuuugacugagaguccaaaucaaauuaaagcugugugugggaggggauugggagaaaggcucauucuuaagaacaauuuuuuuuaacucaaggaaaaacacauuguuucagauauaaagguaggaacugagauauuuaaaauuaaaaguaaauccuuucagguuaagaauuuccaucucauaauuccuuacagaugaagcuacaaagcaguuuucugucauaauguaagcacaaacuucccuuacccagucuuugugguauagcccagcaggacuugggcuacuggccuucccacucuguuguccugcaagugagcccucagcagcgaaaugggagaagcacggagagucugcacucacccacagaucccuaagaggauaaggacaguuucuggccuucucaucccucaccgccuuugcaagugauuugaauugaaugaauuggccauuccuagaauguaauuaguaggaauauuaaucuagccuuuauaaagguggaaaaacugccccacucuucagacagcauaucugaucugcuccaguauguaucaacuugcuuggacuuuaaugccuucagacccaaaagccuguuuaucagccacacacaaccgacucagaaacagcaagagaagcuccugcgaaggaaguagguuugagucuauuugcccuuuguuguggucaguaaaggaacuacuugugcuuuuuaauuagaagggugggaccagauuuuucuuaauugcaguuugagcuauaacacaaagcauuuaaagaaugacuuuuuaaaauaaauucauuuacauucucuccugcauucaaccccuaaccuuuucuuugaaugacuucucauuuuccacuuuuuccuuaacccuuccuucagaacauauucagccuccucaguucugaauaagguuuugaagcucuagcacugcuuguguuuguuauuuggcuugggaaggugcccaaguuguacaaggcccuggcaggugagaaugcagggacaauggguguggcuuuuguuuucagaauguggauucacaagugcucaaggaauaugacuucagcacuauacauuuugaauagccagaaaggguucaucagaaauugcagacagcugcuuguacuacguaggauuuauccuuagaacuagacaaggaaauuuguauuuccuguuuuaauuagaagggacuuucacaacauaagaauaaaaggcaugguuugccccaaagacaugcaucugcuuuauauaaaauaaaugcauuauaagugugagaaauugcuugaagauggccaugauauugagaauaugcuguguauuuacuuuauagucaucugagguuuucuuuuccaguaagguuaagaaccucaagaauuuuuaugagugguuuagagaaaagcauauucaagaacugguguuaaaguuguauuuauauagaaaugugaaaagaagccuuuugcuucauccaccugccagauauauucacauaucuguagccuucuuuuauggacccugagaagaggcagugguccuuacuuuuucacuauaauuuuugguuuggaaugcauacugaauggaguauaaguagauaggaauauauuuguugggguauuuuuuuuccuucugaauuuguaggauaaucuacugguuuacugcacaauauugauuuuuuucuucucaguaaaucaaccuuacauaugucuaugcagagaaugcuaaauucacuguuucaaaggaaagcaugucaaagagccauuuuuaaaucauuuggagugacagaggauuccuaacagaaccauaaaucaucuuuuaaaaugauauuggauguaaucaucacuuagucuuugcucuauaugaaacucaguuuuuauuccuauaccucucuuacucccagaaaaugugccuuaaaccuuagauaauucauuuuccuuuuuaauuauacaaguauagguaagacagaaaaugagagguauauucugaaaaucauaauucaacuuuugcuguaaaaaguagauagaacuugaugcaagugaauuugugccgguuucuccuaacuuucccauuugggcaggggcaccacuugauuguauagguuuacaauuuugaaaugcuuuguaacucuucaccuccuuggccuauucuuacauuacauaccacccugcaccaauauuuggcaaaaguuauuuucaacucucaaaugacucuugggacagccucuaagucaguuugagcugcuauacaaaguaccacagagugggcagcuuguaaacaaaagaaguuuauuucucagaguucuggaggcugagaaguccaagaucaggguccagccaaguuggguucuggugaaggcccucuuccaaguugcagacaacuucucacuuguuguauccucauguggauacaaucagagugagagaacucucugagauuucuuuuauaaggcacuaaucccauacacaagagcuccacccucauugccacauuaccucccaaagauccugccuccuaauauaucauauugagggcuuaggaguucagcaugugaauuuuggggggacacaaacauucaguccauugcagccucaagacaauugauucuggccuccaugugcuuccacuuuggcauucccacuagccagcauauuucuuucuuucuuucuuuuuuaaagauagagugucacuguuguugcccaggauggagugcaguggcgcaaucucggcucaccgcaaccucugccuccuggguucaagugauucuccuaccucagccuccugaguaucugggauuacaggcaugcgccaccaugccaggcuaauuuuguauuuuuaguagaggcgguuucuccauguuggucaggcuggucuugaacucccgaccucaggugauccgccugccucagcuuuucaaaaugcugggauuauaagcuugagccacugcgccuggccaccagcauauuucuuuaacuucaucuucauaaugucaguguccuguucaagaacucaugguucuuaaagaucacucgaugaaccaaauuuaaauuuauagcauucagaguugccauccaucuagucaguaauucuuuucauccuacaaauauuucuugaguaccuacauguaucaagcauuguccuaagugcugaagauacagcaguaaaaacaacacagacaaaacaccacaagaccccuguuauucuguaaccccaauagggguuacauucuagagggagagacagauaaaucaauaaacaagcacauuaauuaauucaauuucagguaagauaaaaaagagugauuaugauaguagaaauaaaacaguguaagggaauagagaaacaggcuaggacacuauuuuagauagagcucuguagaccaaaaaagacucucugaggagguggcauuugaguagagacuaaugaaaugaaugagugaucugugucacgugugguagaaauucaaaggugggaaugugcuuguuugucaaagaaauagaaaaggaaacaaacaaaacaaaaaccgugucuggagccuagagaacaagugggagaaugaaaggagaugagacccaagagauagguagaacauggaagggccugguuugcauaccuuggcaaguaaggagcuuuaauuucauucugaggaugauggaaagcccuuggcaaguuuuaccauuggagugacaugaugugauuuaugcuuucacagauuucugaauguagaugaagaauacaugguagaggacaagaagggaagaggaagaucacuuaguagacucauucauucaacagucuaggcaaaugaugacagagccuuggcuaagauaggagugguagagauggugagauauguuuggaggauuuggcaaauauuuggaagauaaagcaaguaagacuugcugauggauuggauauaggugguggggacggagauagggagaaucauaaauaacugaugauuccuaaguucgauuuugguggauggaggugccaaucacugagauuggaagauauggagaagaguagcuuuggaaagagagaaucaguucuguuuuggauuaagauugauauguccauaaaauguccaaauaaaguuggcaaguaggaagcuguuuauaggaaucugaugcucaggggaguguuccaggcuggagaugaaaaucaggaguugucagcauguaguuaauguauucaauccagacaguuauuuaaauucaaauauuagaugaaguaguugaacuccaagucaugcuaucuuuucaaaaaggaaaaugaggauccagcaaaggacacuagauguaguggccagugaggaaggaggaaaacaggagaguggaauaguccaaagucaugugaagaauuuucucaagaaggagagcacgauugugucaagugcugcucagagauaaacaagccgaaaacagaaaauugcccauucauuugguaacuuggaagucacuggugagcagugugaaaggugauuuuagugcaaucaugggugagaaagcuugauugcagagcauuggggagagacugagaugagaggaaguggaggcuguagacauagauaacucacucgaguacuagggauuggcauaaguaaugaaagaggaggaacuauauaauagaaaauuauauacaaggaaggauggaucauagacuugaagcugggugauaagggaagugagaacaagugguaaauacuggagaaugaaaaaguagggcaguuguucauuggauuggaagagcugauguaauuugaggaauuucuggagucaaagcaguaaaaacgugcugggaagacuaaauaggaggagguuagagacagaggcuuuggaggacaugugcuucauggcaugauggccauuaagugaacugggaguggguggcugggauggggauaaagggggagaaaacaaucagaugaugacagagguaacaagaacuaaugguagggaggaugacagugagccagaugugaaagucuuccgucaucaagggggauagaccaggagaucuggggaugauggcaacaagcagagguguagcagacaccugaugucaugugcuucaaaagaacugggauugggauugggggaaaugaucuggaagcagucagagaagcaaggagaaccccaaccucaaugccaaguccccugcuucucuuuccgguuuuuagccggugucccuggauuuagccauggcaguuagaugguuccacugauccggacugagugccuuccagcaguucagcaguuagaugguuccacugauccggacugagugccuuccagcaguucagcaguuagaugguuccacugauccggacugagugccuuccagcaguucagcaguuagaugguuccacugauccggacugagugccuuccagcaguucagcaguuagaugguuccacugauccggacugagugccuuccagcaguucagcaguuagaugguuccacugauccggacugagugccuuccagcaguucagcucugccuuguccuuaaacaccuggcuaaagaguuacaugccugccaggaugucccugguuuuccuucuggcugaauucaucugcagugggcaugauaaucacgucccauagcucauuguuaucucaaacauauuuuccaguaugugauuagauucugaguuccucuacuucauuuuggccacccucaacaaauuuggcucuuauaccccagcaacaaguacuguaguguaaggacaugugauuucuuauuugaguugaaugucuuaauacggaaauugaagcuuagagacauugagugaugggcuuaaggcuuucagcuaauuaggggcagaggucuucaugcauuuucaaggcauugggagauuuugaugauauccaacuggcaaauucagcucuggcccauccaugaucauuucuacuuuaguuaauggaguuagaauuuagaccuauccaggaggccuagaagugaagugacagacuuuaaagcaccauuacaagauauauucaggagaggaucuauccuaaaguuaauucuguugauccauuuugauuaucagauuggcaaagaugaaaauagcugaaaaaugccaguauaggcaagggugggggaaaaacagcugucagugagguugugaauacauucaucaguguugcagagcaagugggauguaucuauuuaaaauuguaaaaaaaucuuuuagaccccacugucuacauggcuuguuuugauaauucuuuuaggauauuuauagagguucuugaucauuucaaauuuggaacugccuauagaaucuuaaaaauacauuuuuacuauacgggaacagaucuuugucaugugcaguauuucuuuuuauucuucaagaucuaaguauuaaggguaauuuucuauuuguccuuuggaaaagugaaauuuuaauuuuucuucucauagggaaagaaaauguguaaucccuucaugaggcuaauccauaacaugaaaauucauaucuugaaagugauuuuccacugauuuauacagaauaauuugagauguauuuccagugcuccagaugccucugcacaguuguugaugggaauguggaggaagcuggcucuuacuaaaguaauuuuagugggauguauacaaaaaauauuggcugcaccuggcccuuucuaagagugaaauguccuuuauagcaaauugcucuaacaagaguuauuccuguauagaaaagguuuugaauagcuuucaaagcguuuuccaacauaacucccuaccccuccuccaacacacacaccauuuugaaucauagguuuugacuaaguuuuggcuugcugcugcucagccugcaacaguugguuacuaaacgggaggacuacuaauguguucagagaauagugguucucuucugguugcugauaggaggguuuguugggaaggaaugggaguguaaaugaauaaucagugcugguuucuguuuuuaagagucaaaggaaauggcaguccccucucauuucaccucccaccccccaaaaacgccuaaaugaagauagauggauucccuuaccagcaaagggcgaaggggaugcccucuaucugcaauaggaauggcggggugauucguggguccccgcagauuuaguccuuucguuguguuguuuuccuggggcuuccugacugugaccacugcucagcucuuaaaacuucuaccuucaggucacgcgaaggucaauguaaacuaacucaacaccuccuuuccagauccuucuucaaauggcaagaaagaccaggggaaauaaugagcuuggauuuucaaaggcugcuuucuacaccaaguaugugcacugggagucuuuuguauuuuggcuguagagcagauaaucucagcaccaacuaguauggucuaaugcugguuucacaaguagaguuuucuuggucuuaauuguauccugccuauaaaugucucacaccccuccuccuaccaaauaaugaaaagucacauuuuaaagcaaaaacgugaauugcugacaugucaggcuaaguuuucuccucauuuucagguauucaggaauuaggugugacucccugcccugugugauacauauuuucucuggggcaucucuucauauauaaagagagugagucaauuuaguaauuccuaguuccuuuaaaaauaauuucuaaaaaaaauaggaaagaaauacauuaugaucaauccccaaaauauuuauuagucaauucuggaaauuccauguuaaguuuacgacaugcugaaucaaguucuugaccaaaucauuuguuagcuugagauuaaaaagauggggcaaggagaacagcugacauggaggguagaaggcagaaaugugucaagaagcuuuugcaauguuauuuugguuaauuuccccuuguaugcgagucuuauuuaaagcaaauuauucaucuucauugugucaguguggcuuguagggauuuagccuauauucuguuuacuuacauguuuuaacagagugcagaauagagaauagcuuugaauuuaaaacuagcuuagagaguucaaagcucacucauucugcaaaggguaauaaugcccuaguauuaaauuuuuaccccaaauccggcaucugggauggacccgauugcaagaggaaguacauuuuucauagaugaaagggagaaaucacugucccaucuaaaaauagcauuguauuuuccaccaguuuauaucagcuggagguaggauuaaacaguaguugucuagaagaaagagacaguaauugagugugacuguuuccucugcaaaggccuggcccagguggugaaaguuaaguacugucauucagauaaggcccaaaagcaguuagccucgaugucuauuuggcuuuucuguaaaauauccucucuggguguugagcuguggacagacgaaauccaggccuguucacagggcagucacagugaucacucaggaucagugagaugcuuagccagcggggaaacuguugggcaguuuaaaacacagguggauguuuuugcaaugaguaaaagagccuugaagaggauuugccaaaugacucaaaccugauguuuugaggaccaccagaauaauucuacuccuaugugaaaggggagaugggaagcagugcaagaaugaguacuugucgucugagggcgugcggcccagccucaauuuaucuugaccucuaauagcaggaaaaucuucucucugauuuuccuggcuguauaggcauaaguuggguccuuauguuucagauguuuccagagcugguucuccuuggugagaaggaaagaauguaugcuuggccaaaguccuuacagaugcugaauuaaagcuagcauugaucaggagacuuucuggggauagggugggagcagagaacagcacagagccuuggaaagagccuugagaggcuugcagauucuggagggguuuucagcccagccacugaauugcuuuuugaauuuggggcaguugcuuaacugaaucaccguuuccucuucuguagaagagagaugaugcucucugcuguuagucuaucuggucuucaguaggaccucugccagccacacugguuguccaugugacuaacugugcacagacugcuggaauggcugaggucugccauggauggguuuauucugaucucugggguaguuggaggcuguuuugauggcuagaggaggucuguggcuuuagucuuuuuguugaucuuauguauuuauugaacaaguguuucuuuuugucaaguuuuuuguuuuuuuaaacagaccaggucuugcuauguugcccgggugcuggacucaaaccccugggcucaagcaauccuccugccucagccucccaaguagcugggacuacagacaugugccaccacacaaucuuauauauuauuuauucaacaaauacuucuugaguaccuacuaugauuagaccugccccuacacaaaccaauccauaagagccaggcccuaggugacaguauauuuucagagagcauccuauaauuuagcucuuuuauagcgucucguguuguuaauaagcugaaauguacacugguuaaaagucuggaaggaggaaaguguaaucaacaguucacuuuuucuuauguguaucauuaucauguaucaguaauguucagguuaucguaauuauauauuaaaagggcuacacuuuuggcacacuaguauguuuuuaauuacugcacaaaagguaauacaggacuaggcuggcugcccaauaauauauaaauauagaaaaugauuauguuauuuguaguuucucaguuuauuuuaaauaaaaacugggucagcaggccuucagauaagagguuaggauaaaagaagauugagacuucccugcuuccauggauugaacccaugacuuccaaaaucaggggucugccccauaauccuaauggauugacuuccaaaauuccuuggauuuguccugcuguacuugucucucuagggcuuagcuggaucccugcagauagauauuaugguuuacauacaguaauuccacuuaguccagcuguaaauuuaagucuauuguauuaauacaacauugaaaggcagccuugcccuugcccauggaagcugagccugucuuucagauguguuuagcagaaaaucaaggauuuucaauuaguugguugggaggcccuuggagaaacagccgcccugccuaaccacccauugucuaugguuuccgcuugcuccuuccaaaugggacaaauaaagagauucugugcguggucauuaauaggcaagcuuuggugggggcuuuguucuuaaaugggggcuuuaucuuaucccugcugguuaagccccuccauguacuccucaccugucauaacugucauacauuuaauucaucaugcugguggacaggagcuagcugaucauguuuaaauggaagcggggugagcugugaggagggcucggucacgucagucuuagaacuuuacccucaaagacgauuaucagauuuuaauaaagauuuuuaaaauaagauuuuaaucaaguaggcaguuuugugaaggagaauuuucugcuucaugauucucccacagagcagguuggauuuuagaauccagcauuucaaaagauaguacaacaaaauauguuuaagauucuugcauccaaauuuaaaauacaauagacauucagaaagggcauucuucuguuccuuuccugucuaacuuuuuuccuaauuauaaaaguaauauucauucuuaaagauuugaaaaaauacagaaaagaaaucaauagcauuucuaccaccugguucuaauugauuaauauuuuguguauguguuucuagucuuuuuuuccuguggguauacauauauacacauuuuccaccaaaaaugcuuuacaguaaguaaugucaguuauggauccgaguauuuucuucaucauuacauaucuacugcaacacuguucuuuauuauaaaauuaugauauugcuuaugguaaaguauuugaaccauaccuguggacauagugugccaggcccuuuuccggaugcuucauguguauuaagugauuuagucuucacaaucucccagugaacuuagugcuauuauuaucuccauuuugcugaugaagaaugagagauguagggaagguaauuaacuuggcuaaagucagacagcauguaaauaguagagccaagaucuuaacccaggcaggaugaccucagagccaauucucuucaccaccauuacaaacagccucauagaauuugcuugcauaaauaagacauuuaaccgauuccacauuguuaaucauuuggcuuguuuccaguuuuucaauauuauaaacagugcuuauggucaaaaacuuaguggauaauucucugguugcauuccauuacuucccuagaauaaauuccuguaaauguaauaucuauguuuaaauguaugauguuggguuuccucaaaaagcuaaauauagaauuaccauauuacccagcaauucuacuacuagauauacacccaaaagaauugacaaggacucagauacuuauaugccaguguucauagcagcauuauucacaauaguggaagcaacccaugugucccucaacagaagaauggagaaucaagaugcaauauaagacauaaaaaggacugaagugcugauauaugcuacauguggaugaacccugaagacauugugcuaaguaaaauaagccagacacgaaaguucaaauacuguaugauuccacuucuaugagguaccuagaaagggcagaaucagagacacaagguaaaauagagguuaccaggggccggggaaagggaggaauggggaguuauugcuuaauaggaucagaguuucuguuuugagugaugaaaaaguuuugggaauaguggugaugguugcauaacaguguaaauguaauuaauacuacugagucguaugcucuaaaaugauuaaaaugguaaauuucuguuuuauauauuuuaaaccacaauaaaaaaauguacauuugguaaaaauuuagaauaucuucagcaacaacuuauuauuuuaaaaaauucaaagcaauuuauauauaacuuaucuauauuuauuuugcauagguaaauauacucacauuguucagaauuguaaagguaccaacagguauacaguauacagugaaaagucuacacacacuccagccacccuguucuuuuuuuuuuuugagauggaguuuugcucuuguugcccaggcugaagugcaauggugugaucucggcucacugcaaccucugccuccugaguucaagcgauucuccugccucagucucccugguagcugggauuacaggcggaugccacgacgcccagccaauuuuuguauuuuuaguagagacaggguuucaccauguuggucaggcugguuucgaacuccugaccucaggugauccaccugccuuggccucccaaagugcugggauuacagguauaagccaccgugccuggcccacccuguucuccucagaguagcaacuguucucagcuucuuguguagccuuacauauguuugucugugugcaauauguauauucuccuuccuuccuuuucacauaaguuauaguaucuuguaaaccauucauuuaaauuuguauuuauagaaaccucucccacuguaacuccugcacuuuccaaaagcaugguuaaauucuccuucuaccauccacagucauacaugggaacguuguuaccacaagcuguacugagcugggguucugggucaagagaugggcauccuugccugaacacacagugcacucuucagaagggacauuuucaacucuacaaacagugacagcaucaugucaucugcaaagaaaagaggacauacaggcauuuuucuuuccccacauaaggaaauuauguuacccucccuaauuuguugaagagaggcaacuuuuuuaggaauuugggcugugaacauucucuguuuggaggcuaugguacaucccccaucuguggccacuguuaggucagcaaggggcagagccuucuucagcugcaggugacuuccuaucauucacccaucuuugugccugauggucuaucuaguggugugggguugcagaaagcacaccagguuguggggauagacuucggauuggccaucagcuugacuaccacuagccauugccuuuggauggucacuuugccucuccuguaaaauaaagggcuucuauagggacccuucuggcaucuagaguuuacaaaguguuuaguagcuuagcacaggguccaaucaauuacaaaaacuuaaaacacauacaguugagaacaaauuuuguaacuugauuauauaugacucccaauaaugucuagguuuaaaauaaauaaaauagcaguucuugauaaagccauaaacgaagaugcuaaaacugccugaugacacagagcuuuaaaaaaaaaaaucaaaguuaucaaaauuguuuguagacucaugcaacuccaaaguggcguuaaguguuaauaaaugaaagcaucuuuagcacuuagggaagauauaugggcuuuuuccuuucaacagcaauagauaccuggaauguccuuuuauaguuguaacaaucauggagagaaagcaaacuggaaucugagaaaggugcuggauuugaagauuuagaugacggcaucgccucacucuucuaugguuuggcagcccucuccacugcucagauaccguggagaaagagggacgagcuucucagauacuccaaaugacacgugccaaacacguggaagguaaauccccuaauacagucuguucuuccagcauucccuggcagucagccaagcuaaauauuucugcuggauaaaaaaugcacucucgugugcuccacuguaaacugguugccugacuuuaguggaagagguugcuucggugaggagaaugggaaaugaggaguuggucuccaacacccugugugugcauuuuucaccuuaaaaaaaggucucuacauuauuuguggccugugacuguguuaacugaugcuagaaggaaggagaaaauugggaaauagauuuaaugcaauucuucccucuccgcauccaccacuucucccucaauuuuuuuuuggugguuaucuuuucagauuuccucaguggcugucauuugugucuguugcauguuuuuuagcuaaaucaaucuucaaaggcuguuacauuuggucaaaugagagaccuaacauauggacuaguggguuugugucagauggggauuauaguuaauugaaauuuaugacaaaacugcugacuucauuaagacuaauuagaggaauagaauuuggaaucaacauuucagauacccccuucuaauuguuuuagauguuuuucuuuuccauaaaugguagcacauuuuuagucauugcaagaauacaaaugaaauuaugguacacuuuuguaucugcuuuuuuaauccagggacuuaccucaagcauucuuucauaucacauuuuaaacuuuuuaaaugccugaauaauacuuauauuauauuugccuuaccacaaucuauuuaauaauuucuguaaauuugaauauucagguuguuucuagugugucauaauuguacauaacauuguaacuaauaugcuuauauaacuuugcucaaauuauuucccuguggauauauuucuauaaguauaaucauuuggucaaagguuauaaaucucuaaggcucuugguauauauagguaaauuucuuuucagaaaaguuauaccaacaaaguauaguuuguaaauauuuagacauuuaaauuuaaccuaaaauuucaagacuuuccaucucuuuauauuuuccucuguguaaauauugguaauauuguuaauauuugaauaguaacccuauggcauagugcuucuaucuuuugugcauuugacaaacauauugggcucugacugugugcuaggcaucaugccauaccccaaagauuggcuuugcuacuuucaaauauuuauucugaaggcaaucuuccagauuugaacaaccauguuucuuugaacaaccaugauuuguaaugacauguuugaaccaucuacauuaagaaugcaucuuauuggccugaugcaguagcucaugccuguaauagcagcacuuucggaggccaaggcagauggaucauuugaggucaggaguucaagaccagccuggccaacauggugaaacccugucucuacuaaaaauacaaaaaauuagccaggcgugguggugggcaccuguaaucccagcuacuugugggggcugaggcaggagaauugcuugaaccugagaaggggagguugcagugagccaagaucacaccacuguacuccagccagggggacagagugagacuggcucaaaaaaaagaaugcaucuuauuaugccacccauucauguucuaauucagagaaugaggagaauuauauguauauguuauauauguauguauguauauguaagucacguguguauauauauauauacacacacacacacauacauacauacauacagguaucuccaauaaaaauuaauacaggaagauaacaaugcugauccacuucccaucgauuuugcauugauuuucugguacuggauauugcauugcuguacccauccauacacuugcugguggucuccuuuccaagccacaguauucacucauaacuggaauuaggggcacaauuuguguggccacagacccaagccagccuaagugaccccucugaguacagaacucagguccuuggccucauuaucccaguucuuuguuaaucucagagguggauugucuguuaugugguaucaguccaagccauauauucagaugccauuccugggaauguuccacaaccacaguauauuuucuuugcuuggaagggagggugggugagaguuaaggaaguguuuuaaguguagauaucaucuaaaagguuggcaucugauuaaguaaggcagugguucccaaacuugacagcacauuggaaccacuugaggaacuuugaaaaauacuggugccuggcucccaccccagcauucucaagguucauuaauugauuugagaugcaacuuggacaucaggauauuuuaaaguuucccaggguauucuacugugcagcaaaguuuggggacuacugaaagauuuuauggggcauauuuuaaugaccuacuaucaauguguuccauuuucugaugcccuuggcugggcuuuugcaguuguguuuacaccaacucauagacauuuaucuucuucgccuauggugaggaaaagauguccuucauacuucuuagcuguuucacugggggcaggaaaagagaagagaaguaaggaaaaaauucacauucuaaaagacagcaacaacuaauugaaucuggacauuguuuuuuagggcuauuuugggguguaauauguaggucuuaagcagaauuccagaucgcaaaugagguagcucugggaaucgugaccuucccuguccucucuccacugaagugcagcaugcaauugggugugccucaccugagacuaaaguaucucauauuccccaagcacaacucuucuauuuucuguuauagaagggggaggaauagaagaagggaagaauauauauagagagaacaauucccucuuccuucccacaguuagucccacagucuuuucucuauaacccaguccuaauaaaacucaagacccggauagcuggauuucagcaucacuuuggggggcucugcccggauguguguguggcuucuccugcugucugcggugccccuuguguuggggagcugcagggcaaccuucuaaccaucuacaucaugagccccggguaaaugagaacagaaacaugacgugguggauugagcuguucucuggaaagaggaugguuucaauacuccucaucccacacagcuuccaggggugcuuugaagggaaccuuacgccaguaggccuuugagcuucccuggaagacguagccuauguuguguacagauuugacucuggugggcugaggaaggggaaguaaugauguuacaagggaguaguagaagggaugagaaguggcugccggcucugcucuucaccauguggcaauuaacaggagacaaauguccaaauccuggugacaaauaaauuuguuugccugugugcauauauaucacucuaaacccagaguaucucucaauuuccucuuuucuuuuuuuuuuuuuuuuuguuuguuuuugagacagagucucacucugucgcccaggcuggagugcaauggcgcaaucucggcccacugcaaccuccaccuccuggguucaagcgauucuucugccucggccucccgaguagcugggauuacaggcgcccacucucaugcccagcuaauuuuuguauuucugguagagacaagguuucacuauguuggcuaggcugauuuccaacuccugaccucaggugauccacucaccuuggccucccaaagugcugggauuacagacaugagccacagcacccggccucaauuuccuuuugauuagguauuaagggcaauacuguaucaucauauaucauauuauuucuucaauuuaaaaaauguucugaauaaugauuaagccauuuacugucuauguucucuggucagcuggacagcguuaaggaacucuuauuuuuauuuauugcuuugccuagguaauguguggcuaaguauuuuauuauuuaaauguuauuugugauuuuuaaaauuuaugugaaaagagaaaagaucacaacuuaguaagugauuucaagaaguauauuuguuggaaucaugaucagucacuguacauggaaucccaggcccagugacccaugaggagggaggccuggcuauaguauugacacaaaugcaggucccacauccucaucugcauuccuuagaggccagaugugacuuuggauucagaauuuuucaaauguuagagaggugauauugaagcauauacccucagugagguguucuuauucaaauguuaggguuucugcaguagaaaacaugauccacaugaguggagacaaagacuacagacagccucuggucagcauccgugggagccaugcaaaauuuggggggagggaaggaccaugggaaggcuguaauucagagugauaauucugguggcaguggugcugaugaaaauugcaaaggaguaaaacugaaaauggagaagguaauuacaaggccacuauagcaucuuagugguuaaaauugaucuaugguagugagaauaaaaagugaaacaacauuccauuuccagagcuuuuuggauuuuguuauugcagaugaaauguuguaggccuauacgcauaacugagugaccaaaagaaaauuacuuucccugagagucaauuucuuccuuuaugaaauuaagaaauccagucucuagggauuguaauuucccacguaccaaacacuuguggacuucccacucaaguugccaguuccucacagcauguuguauaauaauuuuaaaauacauuacucauguauguuugaucauugcauuuucugauuugcaugcuccccaaggguuguuuguauuuguucccaaacuagauaaugcuaguuauaauuacguaacuuaauuaaauauuauauaaaucaaugacauauaaguauuaagaguuguuuccauuaaaaccaaguagaacucuuuggagaggcuugguaaauacuggcugaaaaauccuguaauugaaauagaugaaacaacuauagaauauuggguugggggacgaggggggauauaaauaucggagaggccuggugccuuggcucacaucugugaucccagcacuuugggaggccaaggcgggcggaucgcuugaggccaggaguucaagaccagccuggucaacguggcgaaaccccaucucuacuaaaaauacaaaauuagccaggcauaguggcacgcgccuguguucccagcuacucaagaggcugaggcaugagaaucgcuugaaccugggaggcagagauugcagugauccgaggccuugguccugcaucaaagaugggagaguugacauauuguuuccaauacuguauaauguuuaagguuaauagucaucauuuuaaagaagcucuaacuuaacuguuuguauaguuuaaaaacuauuggucccaauugcauuggauaagaaagcaucaaccauguugauuauugaccaaauuaggggggaauuuuuuuuuauuaucauaacacaacuugauuuguguuaucaauauuucuuaauauaucagcauaccuuauauuuugaaauuuucucuaagacuguguuuuuaugaauugagccguauuuaaaguaaggacagucuauuauuuucaguggcuucauuuccaaaacaaacaauuuucaaaaauccucauuuuccuauauuaaauuagauuucugggagcugaaguaauauuuuagccaugguuuuaguucugauucuuaacuaauucuauauauuuugagacaauuguauuuuuauucuggugaucuauggcauucagaauaagaacauuaauaugcagcaacaguagcuucuugagaaaugcaagacauuuucaaaaagcuuuacauagccuuguauuaaccauaaaauguccuugguucugaucaucucuucccuggcccucaggggcuauuguguuuguuuuccuguaggaucacccucauuuuuucacauagugagaaucuaucaccaucagaugcuuauuaggauuucuaguugaaagaaaacuauacuuuuaauagaguguagacuuucccuuuucagguaaaguugcagcaagcuucuuuuucuuucucuucuuuuuuaagagcuggggucuugcuauguuccucaggcuggucuugaauuccugggcucaagugauccuccugccucagucuccagaguagcugguacuacaggcaugcgacacugcgcacagcuaguaagauuauuuuucaucaccauacucuuauuccaaaaucaaggaaguugguauaagaccauaauaaaaaucacuacagggaaaauuaaaaaaaaaaauuuuuuuuuuuuuugagacagagucuggcucuguugcccagccuggagugcaguggcacgaucucugcucacuguaaccuccacuucccaugcucaagccauccuccaaccucagccucccgaguagcugggacuacagguaugcgccacuacacuuggcuaauuuuuauauuuuuguagagaugggguuuugccauguugcccaggcuggucucaaacuccuggacucaagggauccucccaccuuugccucccaaagugcgacaucccaaagugcuggcauuacaggcgugaaccacugcacccagccugguaaaaucaaauuaaaguauguaaaacucuaaauacaugauugaagucuuagguggcacuaauauugaagaaucagcaaaauaauggaauuguacuaaauuuuguauacagaaagaauuuagagugauagugccuguaaaaacuagauuugaaaucguaguauuuuguggagaaggcuuuuggggaauuggaugguguugauuauguuacaucagucuuuuaaaaaacauguaagcuguuacuuuauuaguagaaaaaaaugaagcauuuuucucugaauaauuuaaaacuauguagcacuagaaaaaauaaucccaguuuaaauuuauuagaucugaauuaauauuauaugaggaaggcauacugcuuaguaaaaugcaauuuuagacuauauuacuuaagauguacaacuguuuccuacacacaaacaaauggauuauaugcaaaaugguugcauaacuuauuuaucuuuguuuuaaacuacucugcacauccuaaaacaauuuugcaaucagaauuguaucagcccacuaagcaacaaggaguuuguuuuguuaauugcucuaguuaaaccuaauuacuguggguggaguggcuuuccgugaaagggaggaaggcccuaagacuggcaggagaaaauuuuaggaagaaguccagugccaggagugcagauggcugaguggacaaaagcagaccccacaagaacuguguaagucacuuucacuuggaaaaucuauuacauuuguuuuuaguggaugaacuuauuuucaaaugcuguugucagagguaaguucuucccauucccauaaacaugaacaucuuaaugucuguggcuccugcccuggaacauguuuuuugaagucccauaaacaaaggcugagcagcagucuuauuuucucuagaaaaacagaaaguacauucagagcccacuacagugcucccuucacagaugggagcugagaaccauuuuaauugauucauucggcacacauuaaucaaccaucgaucacaccaccaggcacugugcuaagggcuggguuuucagauaccgaugauuauguauagccugguagguagaagaccacagagacagaucauuguccaggaggaugaaucacaguuagagcaugagcaaaaaagugguauacaugaggaaauggagcccaaggcucccuguuuuccauagacacugccugaacuggaagccaggugucuggggccaugccuagcacugucaccaucacccagcaacucuguagcaauacauguacuucaauaaaccaggacugcauguggacuucuuggcuguaucuuugcuuuuugggacuucugaaauuaaaaauguuuccacgaaugucugaagucauaugaaugaauguuuaauauacauaacaguuugaaggauaauuucacaugcuguguuuucauuccuaauggcauuuuggaaaaccuucugucuucuaaagaaugggggaauaucaucacuggagaaaccuuuucuuugucuggcagaaccuucuucuauuaauguaaacuaguuguuaaugaaacagaggucaauaaggaaauaaaucuuugauuuguuuaaauaucuucugcacagaacaucaagacaaaugggugucccuugucugaggaggagaaggcuuugggagaacauugaguuaagcagugagguaacugugaugagaucuuucuugcucgguaaauguguuuacuuuuuucacugguauuuauacuaguuaauguguugcuccagauaaaucuacuuccugcguccaucuuucagcuuguucuccucucuugggaguugacaaaugguuuguguuugacaccauuuaucagcugagucccugcugggugcugccagaggcuugcucagacuacuguagagaaaaagugaguacgguaaauuuguauuucuagucccucugucuagaggagggugcaucgcgcaggaacagauucagauggcugcaaguuuuaccuccuggaagacauaaauuuucaguccaaaauaagcucuuaaucuucuccuggugggaucucuguaaaauggaauaaaaugagacccaguuuagaauuuccucagaagggcaaaauuaaagggugacugcugucauaucuuugacacccugaaagugccuuacauuuggggaacacugaaaaaacaugucccccaaaaugacugcaaucgcagagacugcugcuuuugauggagcaggauagcagccagaugccuucuuuguguuauaucagugcuuuugaauuuaacauucauuuauauucaugcaaagggaauaaacuuaaguuaaacagcauggcugggcgcaguggcucacgccuguaaucccaacacuguggcaggccgaggcaggcagaucgcuugagcccaagaauuuaagaccagccugggcaacauggcgaaacccugucucuaucaaaaaauacaaaaauuagcugggugugguagugggugccucuaguccuagcuacucaggaggaucaucugaaccugggaggcuacggugagccaugauugugccacugcacuccagcuugugugacagagggaggcccugucucagaaaagaaauaaaauaaaaaauaaaacagcgugagggccuugaguagaucauuuggggucucuggaauuuaaaguuuuauuuuaaaaaaauuauuauuauuaucauuauuauuauuauuauuuucagacagagucuuacucugucgcccaggcuggagugcaguggcgcgaucucagcuuacugcaaccucugccucucggguucaagcgauucucgugucucagccucccgaguagcugggacuacaggugcccgccaccacgugggccuggcuaauuuuuguauuuuuaguagagacgggguuucaccauguuggccaggcuggucucaaacuccugacuucaggugauccacccaccuuggccucccaaagugcugggauuacaggggugagccaccgcgccuggucuauuauuuuuaacauuuaaaaaaacuguuaaaacaaggaucagugagggaaaaaaaaauaacugaagagaaugguauaaugcacccaguacccaguucaacaauuaccaacuuaagaccuggguuguuucaucuaucccaaccccacccaaugauuuugaggcaaaggccaaaaagcauauaauuucauugaugaauauuguaucuuguauuucuguaacacaaagauuuauuuuaaaagaaaaucaacacagcagggugcaguggcucacaccuguaaucccagcacuuugggaagcugaggcaggcagaucacuugaggccagggguucaagaccagcguggccaacaugguaaaacccugucucuacuaaaaauacaaaaauuagccaagugugguggcacgugccuuuaaucccagcuacucuggaggcugaggcacaagaauugcuugaagccaggaggugaagguugcagccagccaagaucaugccauugcacucuagccugggugacagagcaaaacucuuucucaaaacaaacaaacaacaaaaaaaacccaacacgugauucaugaugguuggaauuguuaauuccaguauuguauuuuaaaaggacagguuauuaaccacucuuuaggcuauugagcagggaagagugggaagagauagcucuauaaagauuuuucagcauuaaaaacacacccaggggccaagauugaauugcaaagaugauuuugcuccuuucuuggauucuaggagauucuggaaggagagcacaugcagguaggcgccaaauuggcauuuaaagcucuguuguuuagauagaauuacauccuuugggguguugggugagaaugaaggcuuuacucugccuagcuggugguggcagcguaauuagugagaugucagcuacaaaugaaucagugaggcaugcacuccccacacauaagcacaugcagauuuggcagcuagcagugaucuagcaguuggauccuaagugugccucgugccacuuguugagccuaaugcaaagugcaguuuaaucacugaugugcccgugagcaugauuagcuguuaaccgauuagugaacugucugaggccccagagucauugauuuggacucagccuucuguuccacgccccccaccgcagcccccagcauccuuccuucuccuccccucaaucuaugaggaagaaaggagaaggagaagaggagaaaagguccagaugggaagaaaagaaugcugaaaagauccuguaggaaguaggucagguacuuuggagauuagcuugcuucaucccugaaugcgagagccaggcacaaguagcauacaauuagaaggaauuagaacagcaacaaguagcuuggauuuaucagcuuuaauugucuauugucaggacagagcucuccucccagggaucaugguggcaguacacauccuaauacuuuuaauggacauccauugugggauuaucucuccuaaaggcagugccuguucucuucaaaggaguuguggggauccugccugaaaagcaccaaaccgcuccuucccuguguuuggucccauucuaggguaaagcaggguugcccuucaguccuccagaggugcaccuuaagggggcggaugccuacugaacaauaacuccuuugcccugcuuccccggggugccugcuugaaggaaacaaugggcuguagauggagaacagauaagccagggcugauggcuucuggaucuccaggcuaucuucagguuaaaagguuucccagcuuuuccuuagucaacauuagagaguuguucaaaagauaaggugucuauuaaaugagguuuguuauugucuugccuuugccuucucuuuccucccuccccucuccaccucucagguggguggaggugaaggacagucaugccuucuuccaaacucagacacgaauuugguuuaggcggguugaacuucuucuggugucaccaccgguuuaacauuuaaaagguucuccaauaagcgcagcccccuccuccucauuuuuaaguccauguguaccuuagguccaguaagugcuuaggauccauuacagaacccugagcuuggcuggaaaucugagaaccaaguucugauuuugcucccugagcugcagcccugccugugggcuggcauuucccagguucacaguucuauguuaagauccaguuaccaaaaaagagucugggagagaugcccuuucugcuuccugaccucugguccucaguuuccucagcaggaaaaugaaguguagaaggggauauauggucuucgacuuagauuggauacuaaauccccuuuggagcagaaugggaguugggggcuggggguggucaaaugauuucacuauuaaccuuuaugauucugucucuucuauccuaacuuaccuuggcgugaagaaagucaagccucuacagucuuguucuucccuuagaaaggaugagaagaaaucgucagucccauuuuaaauaaaaucaccuguguccuuugguuaauauucugugauuucagggaagcacacgguggcagguacaacuguagggucccuuuuccucuuccaaggggacugcuccucccugcacugggucuucugcugcuguuccugcucauccuccauagaagccuuucaccuucauuuuuaagccaacugguccucccuaaucuuauucuuggcgaccuucccuuuauuuccaccuugaguccuccccucuuccagaauggcuucuccucccacugaaaggugagagaagcaaacauuugacccacagucuugcucucucauuuguguggaagcuacucuuccgguucuccaaauaaagacaagagaugaguuucagaguggacaccuuuccuauugcucuuuuucucccuuguuaacaguucagguuuugccuucuguuaguuuaauuuuaggauuauuccuuuuuucccaccagcuguaagguuaggaagugucuucugaguucugaaauaaucuuccuucuccuguucuuucccacagacuucucagaaauuaaaauucuucugucugaauauucacuaugauaaaaauauaauuagaagggaaagcaaauuuuggaaaccccaaaccuugguuuccccacaagucaucuggaaaugauuaguauugcuauuaucauuuauuaaguugguagaugcugaacuaaaggaauaguuuaaaaaauaauuuuaaaaucauauauaaaugauuagaugagaauacaacugucuuucugaagggagggcuaaaaaagauauuaauacuuagauguaaugauacaggugguucuauaaauacucugagaccuuggacauccuguggguuuuauaaaguccucuggagaacacuuacaucuucauuccuagggugggaagggagcucuacuuguguucuugaauuuacuuaauuuuuguuucccuuauguaggaagucaaaacacugaccucauuccaaaacauccaacagccccugaaggucaccgucccaauguuuaggcccugaauauguuugucaaaaguuuuugggaggugagcugugucaugagaaggaagcuugugcuauuuuuaaauugauucaacucaucaucgaaacauaucguacacauaucacaccaaugacacacacaggcugcauuguaacauagcaugugucauacauauauucucucucacucauacacacauacucgcucuucuuguccggcuuuuaaaaaggaaggcagccagaaggccaagcccagugauuugaguugaaaaggcuguuaaaguuuaaaaaccaagugucccucuaguucucagccuggcuuugagacaugugggagggcuucaaagccucagugccccucucucaggcucaggcuuacaguugguccccaaauguuuaccagcaugaagaugccuaacuuacaggaagcgggaaauggguguggggggugagggugggugggugguagggaguaggaagaagaggguggggggguuauucucuugaugugguuagccugucauugaccuuguuuggguauggcaggaguugaaugagaaaaugaaaacauguuucaucuuggguacauuucaucccuuuuuuuuaccuuaggaaaaaaaaguuccuuucgaaaaaaaaaauuuuuuuuccccaaguggaguucaggucuccagauuuggugcucaauuucccuucauucuacaauaguccuuucccuauagagucaucuggccaccaacauugcaauucccaauccacccaggaacugggagaggaaaaaaacuggcccaguagcugaaaccgaauuaaaauuggcugauggaacuguugugaugaugccauccacgggaauagaugagaauuucugagaacagaacuauuuggcucauucaugauuugcugccauugugaacacuuuuaaugugagagcucugccugagaaaugcugauuaauaaagauaacugagguucuuuucgguguucuaacuuggggggaaauaauauagugacuaaaaaugcaccaaguuauuacuuagaaacaaacccuuugagacauaagauuccagacaguggcagccucugauagcucucucugcacagcuguacugcugccagggucucccagcuuuagucagcaguaaaaaggugcacugcucaggcccucugggaggaccgagugaaguucagaggucagucccuuuuauucccccuuaaugguuuugugcuggacaauaccuaaauauuacaauauggacauguuuuuuccuauuauggagcaagcuuccuuucuuuuauuucuucuuccuuuuugguagcuuucauuuuaaaugaugauauccaucauugacuacuauaaucauagucaaaaguugguuuggagguuuuuuuuuucccaaucacuuugagacaagaagcaaacaugugaaggacuuuacauuccaacacucugugucugaaaauuuacuuuccuuaaaguucuacccguggccuuguccagcucagcugggacaccuggaacuaauuuuaggguugccuggcuaagccccacacugguauuugaaguuugcguccucccuagacucaagcccauuucaccaccucugaaggugagugcaggcugauauuaauuaacagugaguugauucacuggcaucuuccagucauuaaagcaaauauuuggcuuaaaauagccuucuucccaccucaaauaucaaacuuuuugccuauucccuuacucuaucaugguugacucaccagcaguugcaugaugguguauguggccuaagaacagaguuugauucuaaaagggaagugaaauacucuuuaacaucugcaagugagacuguuugaacagcaggccagccuucaguaugacuacauuguuuuucuguccauuguggugcugacucagcaucaguuaauaaacccucuugagcaggcuggauuucucuuguuuaauuaucagcuuggagcuuucugaggacucuuaggaauuguucauucaguuuuccacccccagcagaucugccuucuaaaaguccugcuuccucuuggugcuagcguccccucuggcauaacaugcaaucacaggugggccacgcagcaagcagcgagugugugcuaaucauguccccuagugggaauuuaauuguucuguacugagagagagauugcagcaagacuuuagacaccauuuccuggcaaauaaucuuuugccucucccccucuccccuaaaaaaaauucuagaaaaguuuucuaaaagugagaaaagaaauuuuaaagauaaacagacauauuuuuuaggauugaguugggcuuuuguuuugcuuuguuucauuucuuccuguaaacaaauacucagauguccauuucauuguaugacuaaguugguaucauuagguuggaacuggguguguguauguggguguguguguggguggaugugugugcacacguguauuuaaaauguuagaaaagacauugcaggucgaaggagaaaugauuuuaaaaaaaccuaccuaugguaaggcaagcaggaaaaauggaagaccuggauuucaaugaucuaaauaauaauugaaaugggguguuugcuauaaacauuguuucucugaauuaaaggauuccuugcugaaggcacaagaccauugaaggaaguaaagcaucugguuuguuuuguaaugagaagcaggaaugcaagguccacgcucuuaauaauaaacaaacaggacauuguaugccaucaucacaggauguccuuccuucaacagaggacugacugggcuggaggaaaagcuggccggggcucagaauaagccccacuaauuacugccuccgaccgcuuuccacuugcagugaucaguucaauauuccucugaacugugaaacgacuaaugcucuacauuuuacuuacacuccugggaagucagccuguggguucugggaggagaggaaaggaaaacaaacaaucuguagaauuauaacuuuugccuauuucccuauuuacuaaauaguuaaaagaggaaaguuaguucugccaaguuugaacguuagcaggagaaacggaauguuacaacuuuuggggcggggggcggggaaacgugcguuacauacacaacagcuugaggaccagacagcuccacuguauuacacuagcugcaaaaacaauuuaacuugcucuuuugaaguaagauuugugucuuuuguaccuggggauuugagcugagaaaucagaaacuguguagguaaauuuuaaguuuccuuaauuuaaggaacgugcgcccccuaauucugccgcgccaggaaggagggcgaucuggaguguuuagaauacaauagagcccaaguaagcguugagguuaagugccuucaaagggaaguaagaagauuccaagucaauguugaaauacacaugcgaagagaggaagcucucggcggcugugcuagcaaucugggggaaagcccugggcucggccaggugguguuggccacguuggccacgcccccacuucgcgcagccgaguggcuaaggaaaucuuaagcagggaggggaagccagacgguuaacacagacaaagugcugccgugacacucggcccuccaguguugcggagaggcaagagcagcgaccgcggcaccuguccgcccggagcugggacgcgggcgcccgggcggccggacgaagcgaggagggaccgccgaggugcgcgucugugcggcucagccuggcgggggacgcggggagaauguggacuggguagagaugaacgagacuuuucucagauguuggauauuugcuuggaaaaacguguggguacgaccuugguaaggaacuugaauuuuuuuuuuuuaauucugaaauugaucugaaaacuuuauuuucuuuuccuuuauuguuauuauuauuaauuuuuuuuggcuaaugucgcaguagaaacaugcuucugcuuuagugcacuuagugcugucaaacauuugugagacuuuccuuaugaaucauuaacccuuucaguucuagacauaauugccaauucauugaaauuucaguagugguuccagcucacacucgucaaacuauuccggguuggcugaaguuuucuauuuuauuuuauuuuuaacauguguuuggcgucaugacucuacauguuggaacuaaauaaaaauaagcagguuugcuuaaaucauaacugagggaaaaacaacuuugcauccaacuuuuuuuuuuuuaagagcauccuauuuagagaaguggaagaauguaaaaaccuccuugaaggacuuccacagaauguuauguuuacauuugaacaaacacacauucuuacauggaaaugauacccauauuccucauuuuuaucaaacaugucuauaugagaaaacccuuacagaaguuguuuaccuuuuuuugccuuuggaaaacaguuuuuuucugagugugagggaggauuuugggggaauauccucaucaauguacaaguggaagcagagcuuguccuccaagucuucuaaauuuguuauaacuuuaguuacaguaaacuguaguacaucagugacuucugggaauucauacacuuucagauuuaaauggaaagugcuauuuguagcugaggacuccuaaaggaauucucuccagggaauuuuauuaaacgguuuuauguuuuguuuuugccuuuucaauuugguaugagaugcuugcaagucagaagacacugcaggcuguuuuccccuucacccauuuuuccuccucuuuuccugugguccaagugauuucuaagaggccguagcucagugaugcuggcaggaugcaacccuuuucagucuuccaugugagaggaugaaagagagcucgcagcagagggaggaggcaguuguuuugaaaguuguuuugcguugggagcuggugggaaaguucggucuuccccauuuggaaaaggcaggcuggguuccgcuccugcaccacacgcgcuuuccauuuuuagcuucauucagaggcagacagagcuccuuccucuuccucuccuuguuugugacacuuuucugaggcagcuuuuccacagugccgagggucuggcggccaugaccccaggcauucugggacacuggacugugugcccagaacauuuuucugccaugagagguaaagccagggauuguucagaggugauucuuuuuuuuuuuuuccuuuuccccacagugagguugccacauucuuuuuuuuuuuuuuuuuuuuaacuaagaguagcauuuaaaaaccuugcuucuuuucaaggcaguuuacuuuauacggcuucuuggcucuuucucaacuguaccaagcacucugcaucugcuuuuaaagucuucagacuacuguauuagucauagccucucagaaggagccacaggaacggcgggacaauggggauuaaaggccuuuccuuucucuuccaggcugcccccaaguguaacuccagcacugugagguuucagggauuggcagaggggaccaaggggaccaugaaaauggacauggaggaugcggauaugacucuguggacagaggcugaguuugaagagaaguguacauacauugugaacgaccaccccugggauucuggugcugauggcgguacuucgguucaggcggaggcauccuuaccaaggaaucugcuuuucaaguaugccaccaacagugaagagguaagccucugguuuauugacaagaagauuggggaccuggugccaaaucucccuacuugcccuugaggccuuguauaucucugaaaaccucugagaaucuguaaguaucaguaaauaauugauugcucuauucaauucuugcauugcuuucucuuucccuaaaccauuuccuucucauuucuuccagccuucaacuguuccucacuaauuaguaaacaguuaaauauuuuggcaaauuggcaugucuuagaaaagcaacuugcagcauagggugggugaaauugucagugaacuucaagaaagcucugggcccacuggcccuagugucccuguuguacaauaucucuuaagggagaaaacuuuuucuuggaaaaaaaaguuuuaauauuucuuuugucugucuuugguaauuaguuggcuuuacucuuuuuaacaagccagcuuuauuagcuggguuucuaaaacuauccucaaaacuuugacguguuuaugaagugaagugaugguauaagccgagaaagggggucauguaaaaguguccucugucuggaugacuucagagcuaaccacuguuuaucugcagcagcuccuuugcuggggcugggcuggcaggccaauuccuuacuggccucugaaguggguacacucuuuguuguuucaaaggggaugaaaacccaaacuuggaaugagcaacugauuuguguuuaccuuuaauauaaagauuauagcuaggcgugauguuuagcugugaaauaacuugcagaaccaccucuuguuuucagaauuuggcuuacuguaguugcacuuacuagucuacuacuggguugaguugaaugaaaggaccccucagcagacuucccauaccaccauuagcacagagcacugucaauucuauuacuuccuucagaaaguagggaaaggggaugguuggccguagaaauccagaauuugcuacugggacuauuccuuacagccgugucaaaucacuuucccccuucccuaaggaacaguauuugaaggaauccgggagacuaggaaaugcuuugucucuuuccuguuugugugucugaguccaguguuuuuggugagggggagacacagcugucuaaaauuaaauagaacaacgaugcucagucuuucuuuuuucccccacugcugcgugaauggaggcagauuuuauaaaaaauaaaauuuaaauucuaguuguaguugaauguuaccaaaaaauuuaaccccagaggucagccuuaauuauaccucuuccugaaaguaaugcucuucuuauagaaagucucucaauauguggcccuuggaaugaauguaggauuuguuuggguauaugagguuugacuauggcuuuaaaaaguguaguguguuuuuuccccauaucaaguuugaccaaauauucgucuguucccaagcuucguuugugcuguguugcccuguccaguccuuugggacugaaguaaaaaucuccauucugugggucaucuuugccuuuuaauucuauaauguucuuaucgucaguucagcucuuagcuuaaguuuuucaauuuccgucauucuccuuuaaaaucauagcuaagucaaguaaugcucuuagaucauuuaguucaagguucagaaagacagucacuuacccaaaggcauauagguaaagccagaccggggacuugaagcaaagcuuuucugacuucuccaaugagugcuucucgauuaugcuacacuggccccucuuggugucacugugguuuuaguuaucaucuuaauauauuucagaccaauccuuaagcuauuuuguguuuuuuucccucugaauguauaacuuccuauuucaauauauuaagcaaccaaaaaacagacaaugccuguguuccugaagaagguccuucgaaacuaaccuaagaggugaggguucucuuauccuauuucccuaucuugcauuuaacugaagcgcuugaauagaggauaguaugucuuuaaacccuaaucauaaagucaagcaaggaguaaacuugaauguaauacugucuuaagcuuacucuggaauuuguaccuguuuuucuguuucucuccuuuguuuuugaacuuugggaaaggacagcuuccuuuagaaggugaaagaggaugguggaguugagccauuaaggguaggauagcugcaaacuaguuccgggacagcaacauuaaggauugaugaaauguuuacauuaucuuuauucaguuaguucuuuaaguuccaugagccauugaaauaggaagagucuuucuacauguacuuuuuaucugacuuauuaaucuugcccuucuuuaaauguuuucguuuaaauagcaaaagauguuacaauauguacuauugugcugacauaccggggaauuuuuuuuuuacaagaccauuuuucauuaugaauuuguaccaugugucagcaccuuuuuuuuuuuuuugguuaaaacaaaacauacaaaucauauuucugaucuugacccucauuuuuagauuggguuuagaaucauucugcaccuuuaaugaaaaacuguucuuacuuccuauuuccagaacugaaaucaaauauagaccuacuauucaaaacuuugaaaauguuuuaaacugauggguuauucuuuuauggggguuuuccccuuguccuccugaaauaaucucuuaugacuacuugacuacagaaaaaucaguucaagcauuuauauuuuagaagcguuacccuguagaguuucugccgucgguugagacugcuugcacucaagaggcacuguggcucugugagucucaccucccuguaucguggcugauaaacaucagacagauugugaggacuccuuugguguccauucugaucgaaauccauuauuaacucaagccaucuguaaaaaguaucucaccauaacaugcaauucucucuucauguugccuuuuauuugagaaaugauguaccaaggcaucaccaugucuccuuuaauagaaagauaaugaagaaggaaaccuucuccaaacaacuuuguucacuucacuccuuuuaaaaauggggugauugccgggcgcgguggcucacgccuguaaucccagcacuuugggaggcugaggacagcagaucaccugaggucaggaguucaagaccagccuagccaacauggugaaaccccaucucuacuaaaaauacaaaaauuagccgggcgugguggugggcgccuguaaucccagcuaccugagaggcugagguaggagaaucgcuugaaccugggagguggagugagccgagaucgugccauugcacuccagcccaggcaacgagagugaaacucuguuucaaaauaaauaaguaaauaaaugccauugcacuccagcccaggcaacaagagcaaaacccuguuucuaaauaaauaaaauaaaauaaaaaugaggugauugcaggcugaaggucuuggucacuacugaguucuaguucucucaagacaaauauucauauggucaaaacagaauuauaaucuaacgagucauucuuauagagugggauucggggagggaaaacagauagcuaguaauuuaaaugaucuuaauguaauuuggggagaggaugaucagaugacauuuagacuuggauauaguuucugcuucaaacccacgcugugugugucuguuugcauacucucuaaagaaggaauuugaaaaaaaaaaaaaaaaacaaaccuauauuguccuuguuaucagccuuccauuaagcgcuccaacucaacccauccuaagcugucaaaucuccuucauuguguaaaauugaaaagaagcccuguguuuuguccggaagcuguggaaacuguggacggcgggguguguucuguaacugaggccacagacagaaacaaaucugcucaagugguggaggggucugcaccgcacauaaagagcuucugugggagcaggugaagcaaggagguauugaagccggguguccucuugcuguugaguuuauagaaggcacagagcggccuguccccagcaguaauucuuuaggacccuggucaguuccagugaaguuuccuucuugaguuaggugaacacauucuuugucuuuuuagcacugugaaguuuaagcuacacaccaaguuccuccuuaguauuugcuugguucaaagauaaacuguuacaaacuaugggucagggagauggguagucuaagaugcacauucuggaucuuucuaggaccagagggagacuuaguacuugguuuuuucacuucccuuuaaaaacaauccugguuccuguucccccuccaaaguuaccuggacaagcaccauagucuuagaguuucagcuuuuauggcgucugugucucagacgugcauuugagaugaagauguuuacuguauauuagaacgcuagacuuagaauggauauaggugguuuguaagugccuuccaguuuugaaauuuuaugauuuuguaucuuuaucuauaggugugaguuuauaugugcccuauagcacuguauguaauugaaauuuaaaauauuagggcgcucugucccuuuccuaaugauaagcuaauauugaagcucuuuaauuugucugggguuugaggauuaucauagaccucucuucuaccacagagccuucucuuuuuaauuguucuccugucuugccuguugaauugaauuuguaagguuagagauggcaagagcuacuuccggugcugcuuuauagcuuacuagugaugagucuauaguugugcucaaauagguauuggguagcuuaugcuuucuaguugacuucuuuuugggcacaagaaaauguguguaagauggauaacugaaaaccuagaggcccauucuguaaaagaauggcaauuuggaagaagaaccacgaccucagugcagugcuccguuuugguaaucaagcucugacucccaagacaccaucuguaagagacuauaauuuaaaacaaaguugaugaaccaguugagugccuuucuuaaaauuacuguuguaaaguagauauguugaaaauaucaacugcuaauuauuggcucaccaacaaauggcaugauuuguuuuuccuguuugucauucuaauauuauggaauaaucacugaaauaugaauguuaaaugauuugcaugucauagaauucaauuccauuaauuuuccaaauuaauuagauucaauaauaauauguccaaaacaaugagccucugaauaagucuacuaaagcuuuaaauauauauauuuauaucucaagacugcucugagauacucuuguccccaguaguuuuacugccaacaaauaccaauaaugacaaacggugauuaaaagggcagauagauguaaaugaaggcagaggaggaggaugaaaugaacaucugcuuuuuucagcucucugacagaaauucuuaaaggaccaaaaauaacacucuuguuucaacuuauguuagguguaggaaaauuuucuuuuuuucucuuuccagucugaguaugcuucauugauuuguauauugaauacuaaauuguuuuagaaaaaaaaaucauuggcugauaagacacuuaaaugagaaaagcuagucugucacaggcauguaggugugccauaucuauuuaaauagagguuuaaauuauugaugagacuuaaugaggaacugguguauauuguaaccaaaauuguagauuccacugugaacaaucugugcauggaucgauucacauauuugagucuaccauuucagguacaugaauguacaggagcuacugggaauauaaaaacuggaaaauaaacauuaucaucuauuaccacucccuccuccuugguccauuuuaguaaagaauucaguaaagugauagguaggcuaucuugaaugagaagaaaauaaaacuaggaaagugagagaauaaaaaccaaaacaaaacuguaacugcaaacuguuguaaaggacuacucacagaggaguucuauugaauagugacgaauugcuuccugauucacgguuggugauuuuuuuaccccuucaaagagaaauuuauuauuaaggaggaacugguauaguuaacauguuucuuuagcaaggccccacaaaguuaaaaugugugaugcauccagucugaggucauuuccucagaucuuagaaccuacagcuuuccuccguauaaacuuaauuucaaaggagggcuuuuggccaggcaugguggcucagccuguaaucucagcacuuugggaggccgaggugggaggaucgcuugaguccaggaguuugagacaaggcugggcaacauggugagaccccuucucaacaauaacaacaaaaauuagcugggcgugauggugcaugccuguagucccagcuacucaggaggcugaggugggaggaucucuugaucccaggaggucaaggcugcaaugagcuaagaucaagccacugcauuccagccugagugauagugggagaccuugucuuuaaaacacacacacacacacacacacacacgagggccuuugaccacucuugaguagaagacucgagaagaacaaaguagaaggccagagaagaacaaaguuacuugaaagaucucuuauuaaagagaauguacaagcuaugaaaaaaaaaaaacacacacacacacacaaaccucaucuggaaugaaaaaaacauaaugcauuugguuucugguuccuuaggcuguuauggaacaaccaaagaacauuauuuugguuucugaggucagaacuauuuuauuccccucaagcacacuaugcuuaugguuugagggagaaugagaaauaggaaacuaggaacaggcugaaauggucuaaucuugaccaucuaauucugcagugucuuauucucauucuaaaagagaaugguuauauucgcuguucuagcauaaaaaguaaugauaaaaauaaaagaucccguauuaccagacaauaauccccuagacuguuuuaaugcuugguugaguauuugcuuaugaucucagacuuuaaaagauggucucccccuauggugaagcuuguuaauuauguaggcaucauuaaugucuguuuacuuaucaaaauuuuaucauuguuaguuguauuacuacuugacaguccaauuuauuuaauugaaaagauugguuaacauuuuauagucaaaguaauuguuuccuguguuuuuuccuguuuagguuauuggagugaugaguaaagaauacauaccaaagggcacacguuuuggaccccuaauaggugaaaucuacaccaaugacacaguuccuaagaacgccaacaggaaauauuuuuggaggguaaguaagggaaauuucuucagacccauuaaauguuaggaaaaaauggagcuaaaagagcuggguggcucaccuuucucauccugugcugagaaaugcuggggcucacccauaaguauccagcauccccauggacacagggaauucugaacaaaugugaugaaaccgaugaaaugucuggccuguaggugguuagugauggagauacgggcuauaugugaaucuugauuuuugcaauucauuagagcuuuguaaugaaaggaaacaguuuguugcuugcuuuaaggauagguucauuugcauuucuccgcaaggaaguaguaaugaguuaccaagccuuagauuucaccccuuuuugauuucuugcugacuuaacuuuaauugaauggaagaguuaucacaaaugaauuaucuuuuugguuuuuuuuuuuuugagauggagucucacucugucaccaggcuggagugcaauggcaugaucucggcucacugcaaccuccgccucccagguucaagcaauuguccugccucagccucccgaguagcugggacuaaggugcgcgccaccaugcccaguuaauuuuuguauuuuuaguagagacgggguuccacuauguuggccaugauggucucgaucucuggaccucgugauccgcccaccuuggccucccaaagugcuggaauuacaggcaagagccaccgcgcccagccaggaaugacaaaugaauuaccuuauaaguaaaugccauuaaggaaggauagcuggaagauggguugaggggaauggaggaccacagaacuaguccuauuuaaauacaugugcaugguaaaaugauuccauuugacaauagguuaauuaucucauagcauaaggaaaaugcuuaacagucauaugcaagaugauaagcuuuccuauagcauccaaccaaaagaucuagccaguacaauuuccuuugcuauauuaggguuagaaaggcccccagaggugaaccaauuagauggaauccuugaauaaaacacuggauuagcagugaacagaaaaaagucagauugcuuuccuucuucccauagaugucucagggauauuuaguuuccucagaagauaaagaauuuaguaagcguuuuuuugugcauacuuacaugaaauguacauuauuugaauucuuuaaaaagaaacagcugcaugauaacaaaaauuguguuaugcuugcuuuagcugguauuuuugccuagaacgauuauaucguucggacaagaagcuauuccuaagaaacaauauuuuuaauccaggaaguuuuucauuuuuagaaauuuaucuuacuauuucccaagcaaaagaggguaguuacagauucacuaagaaucaugugcucacaauuuuuauuuaauaauuauuccuccuuaaaauauauuaaucaccugacuuacaaugguggaaccaugagugcauuuuugccuuuauugucaauaacgucuucucagaagugagccacaaaggugcauaguucuuggaguuaaaggucugaauuaagacaauccagcauaagucucauuaaugugugauuauuuugagaaaaggcaagaaguaccuaagaaucucccccucacuguccaguucccuguuucauuuaaagauucacuguaaguaacugaaaggcuuuccuugggaggauuuauuugaaucagucuuucacaugcaaaggauauuguagaacaucucguuuuugcuggcaggaauaugaacaucuguugugaggaaagaaaaaguuucaugcaaauuacacugccaaagaagggauguucaaguugagaaaccagugacauuucuuguaacuguacuaugaaucagcgcauuuuaaucuucuagauaauauauggaagugcaggaaggugguaggaaacgguguucauuuuacauaugcguuauuuuauucugugugagugacuucauggcaccgacauugcuguuuuuaaaugaggauacaguaaauugcaguccgaggaaggcuaacuggaaucaacauacccguagcuuuagaaagcaguuuccgcaccagcgaagaguacaagagcgauggaaccccauguuccuggaaguuugcacaucagaguaaacaaacuugaaaaccccucuugauagcagaauucacccagccuuguuccauuuucucuuaacaaaacacaccgcaaaagcucucacaagcugcuuugaugaagccacauguauuucccccuucacaauuuacaggaaguuacucuuaaaagaaagugauucugguguuuaccgccuguguuaaagggacagaguuccuuuuuauuucugauaacguuugagcgaaauacagaaacuaucuguagacuagcauagucgguacgugaguaaggaaaagcaauaaccugcuguccggugagcacaaaauuccugcuacgaacagugccuuacugcugcuuggagacugcaagucgcagaucacacuagguauugacugauuguauaaggaaauuucuuaaagucuaaaguaaaggugguaccuccuaaaaagaggggaagagagaaaacuuuguguggaaggauaaggaguguguuuauaguuucaguaagaguguacguuuuaauuuuucuucuuccucugccucuuugccaaguagccugagugcaucuguuauccagaaguaguauuacucuaggacaaacuucaaauucuucauucugcguugccuuuaaggaacaacauacuuucuuccuguucuuuuuccaaaaacacacgccuauggcucugugugugguguuuuagccagccuccucccagauaagggguucccuucccuccuuugcauugaaaggaaagugcaagucuggacauguuuaucaagaggaaaagugacuucucaguaauagacugucaaauucgggcugcugcccgaguguucgcuuuguuauggcaggugaaguucaccuuugccccacccaguguuuccacaaaaaggcaagguuccaaguauucauaugaacaaguguuacuuuaggacuuggaggguuggggguggaggauguuugcauaguugaagccuugggcggggguguaggaaacggcgaguacagaggccauagaaaaagcuaagacucaguuugacgucgucagccggcuuggucuucuacccagugacucaaagcacuaaaagucagcauaaucggaacugaagucaguagcaucgcccauuugccauucacugcaguagcaaaaguaguacucugugguggguuaaucgguuugaggcagcuccuuaaaugaacauuuguguuucauuuuucuguuauuuucccgaacaugaaaagacgauaaaacugaaauggaaaagguaacugacaaaagugugccuuaccuguuuccgcccugauuucugcugauucaagacuauucuggcuaaacugauuggauucuuuuucuaacuaggcaguaggggaucagaaaucacacacgguaccggcuguguuuauucugagaggugcuggggagcuuugggucugacuuccuuuuacaugccugucuucucuuuuggacagaucuauuccagaggggagcuucaccacuucauugacggcuuuaaugaagagaaaagcaacuggaugcgcuaugugaauccagcacacucuccccgggagcaaaaccuggcugcgugucagaacgggaugaacaucuacuucuacaccauuaagcccaucccugccaaccaggaacuucuugugugguauugucgggacuuugcagaaaggcuucacuacccuuaucccggagagcugacaaugaugaaucucaguaaguggauuacagaacaaaaaaauaaaaaaugccaguaaugucgguucugccccuuugaacuaauaacauguuguuuaauuauacggcuuugucauguguuggaugaaguagguggcuuaagcuagggacuaggaagaggaaaaacauuuuuugagucccuauuaacuauuaggaaacuugaucauuuaaaaguauauauauauaugaggagcuaccuugaguuuugaauucaggauguuacaggaagaaauauauguccaauucuaauuuauccaaaagcaguugggagaauuacagggauugguccagacaugcugcguaugcaagguauagcccucaucugugguacuuuggcagggcuuagacugcaucaaaauauuuauagauguacauuugaguguacaguuaggaucugauguggaacauuguaagaucauugcuagaaaaacuuugucauaauuuuucaauauuauucuaagugaauaaccguaaagauuuuacaucuuagcuuccuuccuuacaguaaaaaaacuaucugaucucuugaucaguauuauaguagccaccuaucacuuuaucuuaacaaauucucaauuccuuagguuuaugugcuuuuacuucuuuuauuugauuaaaauugcugucaugaccucucucugcagagggcugcaucauuuuggucauucucaagugaucucuuugagcaauuuaagaauugccauaagauucuaaccucugcuguaacuaugguuguguguucuugguuagaccacuaaaucuuauuagcaguuuuaaaaauuauuccuuuugguuuagaaguuaagacuaaaugcugaaguuuuuguaacuuuugguuuugauaucauuucaaacuuaagaaaacauuugaagaaaaggacaaagaauuuccacuuacccuuuacccagguuuaccaguuauugauaaguauauccauuugcuuuaccagaaggcuaacuuguuuuaguucucauuuucaccuuugagacauuuggaauaaauaucaauguuaacauaaauuggaauuuugacuuugauuuuaggaccaaugaacaagccaaguacuuacccuagucauauauaauccaacuguaugguuauuugguauucauuccacacuucauuuuacuugaucucccuuaagauugcaagauuguguuugcaguuuuucugaaaaucuggggcuauaaaagcaucaggaccucccccguaggggaggucguguguuugggguccuuacacaacagguuacccuugagcuucaggaaaagaacuggcucucaguuccccaguuccagcuuaaugggucuaauuagguccugaccaaaaagguggcaguucuuuucccucaugucucuucagcgcuccccgagacucuggagacucugucauaucccuagggcugagccucccaggaaccauucggcuguuguggcaucuguguaugccaugcccagugcugaggaccuaguaacaaacgacaaaugcacaggcacaguggcauuuuuguggaacucguauuccagcugugcgucucagaagaagcgcacagcucccuccuggcuuucuuaacauagugagccacuuccacuuaagggucuccuuacauuccuugaguuuaaucauucauggauucagaggaaagucuuuugauuuuugcuuuucuuuaaacaguucauuugaggugaccuaccccagugacuuugcaccaaccaccaagaaacuuuuuugcaugcuucccgcacccugugccaaucaagggaaggguuuaaaggccuggcguuuuuauuccucaaagaaagguuuugcacaguauuuuaagguucaagugcuucuacuuuguguucagaagcaacugucauauauacugugaaaugacaccuuuuauuuaucccuuuuuauuuaugcaguauguccccuuuuauuuuggcagaauuuuuucuaaauggugguuuaacauuuucaagcacauuucauuguccaauauucauaguaaagaaugagaguuaacaauaaccagucacauuaaaacaagauuccugcugccaguugugaaaccgguugucuuaggcguggcagcugaugauugagacugugaucaggaaaauuuccacuauuucaucaggccuaauagguagauugugucuccaaaugaacuguguuggguuuccaugcuuaaagcacaauagagguggugcaagaaucuccaugagggcuuaaauggcagugaugguucaggcgguagaguuuggagaagaagggauuugaaacaaaccaaaggaaagaaaaguaaguagccagaaaucacaaaauggcauuuuucuaaaaacaaaggaaaaggaauaaaagaacuaauaaguuugaaaccccuaccccucccaaauuuggcagggggggagguauuuuuuuucuaucuaucuaacuaacccaucuagaaaacaguugaccaaauuauagacuucuaaauguuaaucugcuuucucaguuucaguugaaaagagacuuuguuuugccuacugcagaacuucuagguucuuucuuauagucuugggguucuuauuauagaucgaaaaugugagucggcauaauuaagccauucggagucuucagaagcaguucacucuugaaaugacuccguccgccuacagccauuuaagauuucagaacaaaaacagaucuugauuuucuuuuucauguuaacucaagcuguugcugagugggagagucagaaaugacaccagcuccacugauuacucagcugcugaaggaugauuuuuuaaaaugcaccuuuacuguauauggacuuccuaauuuccaccuguagagcaucuuagggaggcuaacaugucacucuggauguucuuuuagaauaagaugcaaaucuauuuuucugaaggcauuagagauagcaaacauuuauugugaguuuacuauauacuaggcacugugcuaaguguuuugcauagaaaguuuaaaauucuggcuuuuuuguuggcccaaucauaaguuucauaucaguucaacauucaaauuauauuaagguacuuaagaagaaucccuggcuaaaugugaggggcagugccacagauggacugaaacuuuaugcuuauugcacauuuaugcuauuauuauuuguugaauuauagaaccaagggaguguggaagccacuggaaaaaauaugagacuuagauacauaauuugaguaaaaauggcucaaagucaugaggguaaaguuuuuuguauuuccauuuuauucgagcggcaucguuuuuaaaaaucauuaugaauuugacccuauauagauguuuccaaauaauucuuuuucaccuucauaaaauuccuuccuguggcugugagaugccuugccuaucaguuuucaagcuuaguugucuuucucauccuuuaccauuuuagcuuuaaaaaacaaaagugacaauuagaacuuccugccugcugggccucacugaaagaccgauauuggccugauaaggagauauuuauuuuguuuuaguggcuucagaaaucccucucccucagcaagcuuuccaucacggcccccccgucagcaucuucccugauagcguucuucucuguguuuauucuggggcuucaggcucgcccaggaggaacugauaaccgcuggcaggagauaacauucucuaaggggcucucaaauuggaaucgaaucccucaagccagucagccuagagaauacauuuaaaggguucaguucuggaguuucacagaguucauuucuagaccuaucagauagcaaguguggaguucuuucucaacuaaauucaagcagagacauuuuuuagacgaugaaggauauuugcacaaaggcuucagcaugaucccccaaaccugcugccucugaaggcaucuccacacauugacagccaaugccuucagugcguuccuagggcagguguccuggcuugagugacuguccuccaauaaucagagcucaaacuaaacaucguauguuuuacuuuugguuuccaggcaaggcugagcagggaauuuucaguuuucccugcccagauggguguuuuuuccugaaggcaucauuuauuguguagcgaggagacagggcuggcuguggcagggauagucuagaacuguccucauugcugcuguuccuaaauaguaucuuuaccaaguaauaacgugccgucuuugggaauaagugcuuuccucuuagccuguucuguuuucuugggugcgcuaaguaauugaacuggcucaggaaguaccuauugugguuuggcagaggugacugucacgccuugugacuccaggggccagcacugcugggauccuggcuagaccagacagagccuuggugaagugcuuaggcugucugcacaucgcgaggaaggugguauucacuucgcuaagcuccuuggcauaggcaguuugaacagggcuuuaucaaauucguauucaacaagaguagaagcgaaaauugaugacuguguauuacuugaaaugagucuuaaucuuucacauuuaguucucaggguaugcugauuuccuuuagguaaaccaugaacaucagaaagacuuuuauuaaccuaugacaggguccccaccccaguauuuuuccacuccauuaaaauggaaguuuuuuuuuuuuuuuucuuuuuugagacagaguuuugcucuuguugcccagucuggagugcaauggcacaaucucggcucaccacaaccuccaccucccagauucaagcgauucuucugccucagccucccaaguagcugggauuacaggugugcgccaccacgcccagcuaauuuuguauuuuuaguagagaugggguuucuccauguuggucaggcuggucucgaacuuccgaccucaggugauccgcccaccucggccucccaaagugcugggauuacaggcaagagccacugcauccagcuuaggcuaucuuacuccagccuaaacagcaauuuucuaucauaaggucuguacuaaugaaaacagaaucacccaaggcugcuguuuguucugucugugcugccauuguccgcauuuugcugaggaggaaacggaacugcacuuuugagugaguggcccagagccuucuagaaugagagugcguuggaagccagauauguggcgauugugucgccagcuguuacucagguuuucucaagaaggaggagcaacuuuggcaguuuugcuucaguucucucuagcccucuguguaaucgccccuuuuucuuuauuucagcacaaacacagagcagucuaaagcaaccgagcacugagaaaaaugaacucugcccaaagaaugucccaaagagagaguacagcgugaaagaaauccuaaaauuggacuccaaccccuccaaaggaaaggaccucuaccguucuaacauuucaccccucacaucagaaaaggaccucgaugacuuuagaagacgugggagccccgaaaugcccuucuacccucgggucguuuaccccauccgggccccucugccagaagacuuuuugaaagcuucccuggccuacgggaucgagagacccacguacaucacucgcucccccauuccauccuccaccacuccaagccccucugcaagaagcagccccgaccaaagccucaagagcuccagcccucacagcagcccugggaauacgguguccccugugggccccggcucucaagagcaccgggacuccuacgcuuacuugaacgcguccuacggcacggaagguuugggcuccuacccuggcuacgcaccccugccccaccucccgccagcuuucauccccucguacaacgcucacuaccccaaguuccucuugccccccuacggcaugaauuguaauggccugagcgcugugagcagcaugaauggcaucaacaacuuuggccucuucccgaggcugugcccugucuacagcaaucuccucggugggggcagccugccccaccccaugcucaaccccacuucucucccgagcucgcugcccucagauggagcccggagguugcuccagccggagcaucccagggaggugcuugucccggcgccccacagugccuucuccuuuaccggggccgccgccagcaugaaggacaaggccuguagccccacaagcgggucucccacggcgggaacagccgccacggcagaacauguggugcagcccaaagcuaccucagcagcgauggcagcccccagcagcgacgaagccaugaaucucauuaaaaacaaaagaaacaugaccggcuacaagacccuucccuacccgcugaagaagcagaacggcaagaucaaguacgaaugcaacguuugcgccaagacuuucggccagcucuccaaucugaagguaggccuugagagagagcaguccaaggggcugugagugcaugcuuguguuuguauuuagcuugcuuuccaugggguaucgauugcauuugcaguaguaugagcccccgguuggggauaguggguauggauuccgccuggcuuuugccacuucuagcucuuugacuuuggacaagugacuucccuucuccugauuuucuucugaauaauaaaaaaauuagggguuuggacuagaagauuaggugaaacucccugcuagccugugauuuuugugcuuuuaagaaaaacaccauucugaaaacaugaagauuucuucuuuuuaagacugucuugaugcuuuucuuaagauauuugcaucaacacuugagucuuggagcagaaauguuaggucucagagccagcuugagagcagagcuaacacauguggcuucuucccagguccaccugagagugcacaguggagaacggccuuucaaaugucagacuugcaacaagggcuuuacucagcucgcccaccugcagaaacacuaccugguacacacgggagaaaagccacaugaaugccaggugcgcaguauuuucuggguagaccuucugaccuuuguagaaaaugucugugagucacccucccauguccuauauagcccguaguuaaagccaacaccagauucugcguugucccauccuggacugauggcacuaugguccuucccaguacuuuguaucugcugaugacuugagauggcacagccagcuuccagugggugggaaaaugguaggggaaauaaacagccccucgugugcugugugcccacauccccccguuugcuuaauaccacacuggaggugccacaaggaggcuucucaccuccuagguugcugggcguuggccgguaagccugccccucccguuggcaacucuuaaucuucuggccuuccugucucccuucccugcugucucucuccccuacacuguaggucugccacaagagauuuagcagcaccagcaaucucaagacccaccugcgacuccauucuggagagaaaccauaccaaugcaaggugugcccugccaaguucacccaguuugugcaccugaaacugcacaagcgucugcacacccgggagcggccccacaagugcucccagugccacaagaacuacauccaucucuguagccucaagguucaccugaaagggaacugcgcugcggccccggcgccugggcugcccuuggaagaucugacccgaaucaaugaagaaaucgagaaguuugacaucagugacaaugcugaccggcucgaggacguggaggaugacaucagugugaucucuguaguggagaaggaaauucuggccguggucagaaaagagaaagaagaaacuggccugaaagugucuuugcaaagaaacauggggaauggacuccucuccucagggugcagccuuuaugagucaucagaucuaccccucaugaaguugccucccagcaacccacuaccucugguaccuguaaaggucaaacaagaaacaguugaaccaauggauccuuaagauuuucagaaaacacuuauuuuguuucuuaaguuaugacuuggugagucagggugccuguaggaaguggcuuguacauaaucccagcucugcaaagcucucucgacagcaaaugguuuccccucaccucuggaauuaaagaaggaacuccaaaguuacugaaaucucagggcaugaacaaggcaaaggccauauauauauauauauauauaucuguauacauauuauauauacuuauuuacaccugugucuauauauuugccccuguguauuuugaauauuuguguggacauguuugcauagccuucccauuacuaagacuauuaccuagucauaauuauuuuuucaaugauaauccuucauaauuuauuauacaauuuaucauucagaaagcaauaauuaaaaaaguuuacaaugacuggaaagauuccuuguaauuugaguauaaauguauuuuugucuuguggccauucuuuguagauaauuucugcacaucuguauaaguaccuaagauuuaguuaaacaaauauaugacuucagucaaccucucucucuaauaaugguuugaaaaugagguuuggguaauugccaauguuggacaguugauguguucauuccugggauccuaucauuugaacagcauuguacauaacuuggggguaugugugcaggauuacccaagaauaacuuaaguagaagaaacaagaaagggaaucuuguauauuuuuguugauaguucauguuuuucccccagccacaauuuuaccggaagggugacaggaaggcuuuaccaaccugucucucccuccaaaagagcagaauccucccaccgcccugcccuccccaccgaguccuguggccauucagagcggccacaugacuuuugcauccauuguauuaucagaaaaugugaagaagaaaaaaaugccauguuuuaaaaccacugcgaaaauuuccccaaagcauagguggcuuugugugugugcgauuugggggcuugagucugggugguguuuuguuguugguuuuuguugcuuuuuuuuuuuuuuuuuuuuuaaugucaaaauugcacaaacauggugcucuaccaggaaggauucgagguagauaggcucaggccacacuuuaaaaacaaacacacaaacaacaaaaaacggguauucuagucaucuugggguaaaagcggguaaugaacauuccuauccccaacacaucaauuguauuuuuucuguaaaacucagauuuuccucaguauuuguguuuuuacauuuuaugguuaauuuaauggaagaugaaagggcauugcaaaguuguucaacaacaguuaccucauugaguguguccaguagugcaggaaaugaugucuuaucuaaugauuugcuucucuagaggagaaaccgaguaaaugugcuccagcaagauagacuuuguguuauucuaucuuuuauucugcuaagcccaaagauuacauguugguguucaaaguguagcaaaaaaugauguauauuuauaaaucuauuuauaccacuauaucauauguauauauauuuauaaccacuuaaauugugagccaagccauguaaaagaucuacuuuuucuaagggcaaaaaaaaaaaaaaaaaaaaaagaacacuccuuucugagacuuugcuuaauacuuggugaccucacaaucacgucgguaugauugggcacccuugccuacuguaagagacccuaaaaccuuggugcagugguggggaccacaaaacaaccagggaggaagagauacaucauuuuuuaguauuaaggaccaucuaagacagcucuauuuuuuuuuugccacuuuaugauuauguggucacacccaagucacagaaauaaaaaacugacuuuaccgcugcaauuuuucuguuuuccuccuuacuaaauacugauacauuacuccaaucuauuuuauaauuauauuugacauuuuguucacaucaacuaauguucaccuguagaagagaacaaauuucgaauaauccagggaaacccaagagccuuacuggucuucuguaacuuccaagacugacagcuuuuuauguaucaguguuugauaaacacaguccuuaacugaagguaaaccaaagcaucacguugacauuagaccaaauacuuuugauucccaacuacucguuuguucuuuuucuccuuuugugcuuucccauagugagaauuuuuauaaagacuucuugcuucucucaccauccauccuucucuuuucugccucuuacaugugaauguugagcccacaaucaacagugguuuuauuuuuuccucuacucaaaguuaaaacugaccaaaguuacuggcuuuuuacuuugcuagaacaacaaacuaucuuauguuuacauacugguuuacaauguuauuuaugugcaaauugucaaaauguaaauuaaauauaaauguucaugcuuuaccaaa

SEQ ID NO: 16248 - RNA, 3472 nt, Homo sapiens
guuugggaagagacaggcuaugagcaugacaugcaggcugugggggcugccauuccugucucagcucucagcuccuucuugaguuuugagcaggcaaaauugccucugucuaauaacaccccccacuacuuuucucuuucuuucuuucauucuccuccugcccccuguaugacaaaauaggcaaaaugaguacaucagagggugagauggagaaaaagaacuauaguuggagauuuuggacggucucuuuuaggugggaaggggaagguaggauagugagaaacaugauugcaaagaagaagccauauaauuuuuucccuuugacuuuaaguccuaagaugggcaggcuggaggccugggugauggagcaggcugggaggacugcaguucuaacccuuggacaacgcaagugguagagcuguugagcuggagagguuuucuuugugaaaaaggcagcugaagucaucgaaagugaucuggacugagaaucgggagaaguggauucaguucauacucagccacuuuuuaugugaccuugggaagagcaacuagacuauugaugcccaguuucuuuauuuguaaagaaaacaauugaauaaagugaucuguacuuuuucucucugcuuuaaaaugacuaguuagaaguuaugaaaauugaaaacaguucacaaaagcccaguaacuugcuuucuucaucauucuaagagagaaaaguuaaagcgaacucuccaguucauuguuaaaaaacaaaagaaaagaaaagaaaaaggcaucuuuucucuuugagaaacaccaaaauuacucugcccccuaauagucgccugggcagaauuuuccaucuuagcacaaagcagcucggcucgaccuuguuucaacuaaucccuucucuguauuuaacaagaggaacuggaagagucagacagugugugggaagacugaagaaaauaaggaagguauagaaacuacuagagauggagauaaguuaaacauucuggcaaauugucaugguguauugcucaugcugaaugguuaggcaguugggaagguaguuaagagaauggcuuuaaaugcuucaucuaauugcaagcagcuguugauuaguggagcuugaccaacuguuuuuaauuccacucaguggugaugaagagaaugagacuuuuaagggaaacuggcacggucuguguauacgcauggaguugcuuacacuuuuucuggaggucauagagugcaguaacuacuaagagauguucucugaaaccauugcaggcuuucaugauaaugacuuuccuaaauuuuaccagcauuuguugggcuuuuggcaggaggcaaacuucuccguuauccaaauucuggaaugauuuuagggacugauucauucccaaucgcgagugacuggaugucuugugccaauucagaagcaacuguucaguggaagcaguaaaucuagaaugagagcugauaaugccauuuuagagucuucuucuuaggaacauuuaaucucauuuuuuugaauuggaaaauauaagaaaguagaaacaguuuaacuaguuucuguaauugaaaagccugcuacagauuaucuaaaguugagaguuuucuggaagauaaaguuucaggcuaguuuaaucaagucugaaaccuuacuugauggaauuacucuacuucuauguuauauuuucuuauuccuaacaagauuaguaaucuuuccuaauauuuauuuuauuugcuuucauuucuccucauagauucuaaaaguuauuuuaauguuucugcauugcaaacugaagaaaccauucauuugacugaaagcaaggcuucuaugaaaccaggaaggccuuguaguucuaacaguagcugccuaacuagaaauaugucagcaauucuuagggagaagggugcuagauuucuucaaugccaguuauccauuuuauauccugaauuucaguguacuguaacacaaaguaaauuuccuauguacacauguaagauuuaucaacaaggaucuuuuucacagcacuguugauaauggcacaaaaucagaaauauccuaggccgugcauuugccuguaguccgagcacuuugugaggcugaggcugaaggaucacuugaaauuccuacuuugaaacuugaaguuucaagugaaccagccugggcaacauagcaagaacccaucucuucaaaaacaaaaaaaauuagccaggugugauggcacauaccuguagucccagcuacucgggaggcugagacaggaggauugcuugaacccaggaguucaggaguucaaggcaacagugaagcaugauggcaccacugcaguccaaccuaggcgacagagugagacccugucucaaaaaaaaaaaaaaaaauagaaaaaaagaaaaagaaauauccuaaauguucauaauuggcauuagcuaaaaaguuugugguguuuguauggucugauauuuugcagauauagaaaauguggaagaauauauaaaugacauaggaaaauggucaugauguacuggaugaaaaaaucaggaucaaaauuaaucauuuaaauagauaucucuaucuaucuaccuaucugucuagauauagauccagauauaauuuaaaucguguguguauaugaaaaacuaaaguuaaaaaaauaaaauagaaacaguggugggauuacaggugacuuuuauuuuaguuuuuguguuuuuucugcauuuuccuccaaagaacauauauuacuuuuacaacuaggaaaaggacccuuauuuuacacuuaauuucccaauauaucaauuuuuauaucauaaaagauuuuauuccuugccaggaugaagcuaagggggagauucaugccuaagcaaaggagaaaaaaaaaaucaagaggacagcacucaauaaacaccuaauuuuguuucugaucuugugccuguuugaagcgcucacacuuguuuugacucagcuagauaagucagcuccucuaaaacagucacaauuuccaccagcuguuuuggauguuugagguuauguuuuuguuuuagugaacuucacugccuaucccuugagcuagcuuaggaacaauugcaaaggaagucuuugaggccgacucagaggaaagcugcuaaucuuaugacauccacaaggauuugaacaggcagcuccaucuguguuguuucuguuuuucuucuagggcaggucucgauggcagaaagauggacacuucucaggucuaguuguugcaugguguguuccugaccacagcuguacccaaggagucucacagauuccucaggaggcaacaggacguuuaucaacgaagaugugagaaacccaugccggguaccguuuacgaacccugccuggguucuguuuuccguguaguaauucuuuuccacgaguucagguuuaugagugcucaggcaggaagcuguuuaucacugaaagccaccaaaggagagguguuaucgucuuuacccaagaccucug

SEQ ID NO: 16249 - RNA, 730 nt, Homo sapiens
uguuucuuuuucuuucuuuuuuuuuuuugggaacaaaacaauaaacaccuuuauuacaugggugaagacaaaacaaggauuuauuugccuuucugggccuugauuuuccuaagauagaacuccaacucuuugcccucuagcacauagccaucugcucggccacacugucccggccuugaagccaugcacgcaagaagcuugcccugcuggaacugcucccccaggagacugcucauuuuggcauucuucuuccuuucaucauauuucuucugaauuuuuuuagaucguuuuuuguuuaaaaucucuucuuccucaggagucagcuuggcucccuucuugcggcccaggggcagugcacagugggacucguaccacugucgguagggcgugcugucgaugggcacgaugcaauucuucaccacggucuugguacgaaccagcucguuauuggaugcauuguagacaacaucgaugacccuuguuucaccagcgcagcauucugagccccaggagaaauuccccacguccagccucggggcacaguauuucuuguuaccuccucgcacacggacuguguggaugcggcacgggucagucuugcuguuggcagcugggcgccccaacucauacuuccgcuucuuguggcagggccuucucuugcccccagcuuugcggcccuugugccaguugucccgagaggugcccaucgcucggcgcuggcuggaaagag

SEQ ID NO: 16250 - RNA, 2685 nt, Homo sapiens
uuuauucccacaagguagccaggggugggggcgccgagccaagcccagcaggccaugggaccuuccuccggcggggugcacgcuggauuuucgggucugccccaccagcagguuugcaggcaggccgucaugagugccgguggaaggcuccaagggcgugggcaggggcucgggcggggccacacacuuguggagcuagaaauaguggggcagguccuucucuaucaccugucggggaggaaagcuggguuagggcagcuaccucccaagcccccgagccucaagcgggcucccuagagaggaccuaccaggggcuccuccauggguccguagcgcuucaccacgcagccguucuugucgaugaggaacuguggagagacgguguccaaacuguggggccaccccugcaaggggcugaggcugcccuuccuguccgcugcccaucugggccacggcuguggccaggggaagcugguccccuaccccccacagcccccuuaccuuggugaaguuccacuugauggcacuggaaaagaagcacauggacgugagcguccccagcagccccccacaguccccaagcuguccugucuccaggaggccacaagggugugagcuuccccggcugccuccacagccacagugcccccaagcccccccagagccaucuuaccccaggaggccaugcagugugagagucccaacagccccccacaggcccccgagccauccuguccccaggaggccacaaaggugugggcaucccuggcugccuccacagcccucuaugucccccugagccaucuuacccccaggaggccacgcgaugugagagucccagcaccuccccgcaaccgccccccgagccaugagccauucugccccagggaggugugagcaucccagcagcccccccacccccaccccagcagccguacuguccccagaggucacgcacuuucccaggaugcccuugcccuuggguuggaucuucauccacuuccacagcgggugggcgucguccccguucacgcagaucuugcugaacauaucgaauuugacguuguagcccgcggcgaacucuuugaucucuucguuacucccuggcuccuguggcggccaaggugugugagugagucgggggcuggcacccccucaguccgggcccccugcacacucccaggcccucuccaggcuggagcccaccccgacccccacccacccgccucugcgggccccggggacgcagcagcccaccugcuucccgaacugguuacacgggaaggccaggauccgcaaaccacacucagcguaucgggcgugcaggucgacgagcugaguguaguuuacuucggucuugccucacugggaggccacguuggugacgaugcacacgaagccccugcgaggaucggcggcgucagcgcagaagaacacggcccccucccagggcccgaccccgcgccccaccccaggcgagcgcccaccgguacuuguccagguuaaccaugugcccgucgauguccuuggcggaaaacucgugcauggagcgcgcacagcgccagucgucccgggacgcgcacugcaaggcaaaggaagcugagcagggagcguggacgggaggcugagcccgggacccugaggcaggaagggaucgggagcgggucgguggcggggacaccgaggcccugcggcccugaagaccugaacgcuccuccuccuuaaacgcacacgcccccuuguacuucugguccgguuuuaccggagacccggaggccgggagaggguuccaaccccaaaaugugccacauuagccggugugggggccccgcgcgcaccggguccugggacuugggacauucguggaucuccggucgcaagcugcggggacagggcuucuuccgccggcgccgcgcccuccugcgccugcacgcuggggccuuccgccgccgaggggcucgcggccgccgccugccccggcucuggcaccgcugccugcggcgcccgggggagccugcgcccgcgcggcccauacccgcccgucucccgccccuccuggcucccccaccccgagcgccgcuagcggggacaaagggcccggaggccguagucaggacugcgcgacugugacgccaccgcgcuaggccaaggugcgggggcggggcggcgcccgggggcgcgugauccgggauuuccagcccuccgcgcccccaaccgcucgggcgcagcagccccgcucggcccggagacgccccgccguggcccucaacgguccagcuccgccccagccgucccggaccccgcccccugcaagccuggacccccgaccccggccccggcacgcgcgccugcaacggccuggacggccccuuccccgaccacgacccgcgcgcguggaacaaccccuuccccuuccccgaccccagcccgcgcgccuacaacggccuggagggccgcggagcgcgucgcaguacggucacccgcguccgugcccggccggggguggggagggggagcccccagacgccccccaccaaggucacuggagccugaggguuccccacgccggcgagcggaggcagggaucgcgcgcccgccccaacggucaccgggccggcaacggccgcggcgcuagcucaccauggucccggccaggccaggcgcggccagagccccacagagcag

SEQ ID NO: 16251 - RNA, 747 nt, Homo sapiens
gaugaccagagaagaaccucuucccaagaaaguucgacugagugaaacagacuucaaaguuauggcaacagaugaguuaauucuaagauggaaacaauaugaagcauacguacaagcuuuggagggcaaguauacagaucuuaaacucuaaugauguaacuggccuaagagagucugaagaaaaacuaaagcaacaacagcaagagucugcacgcagggaaaacauccuuguaaugcgacuagcaaccaaggaacaagagaugcaagaguguacuacucaaauccaguaccucaagcaaguccagcagccgagcguugcccaacugagaucaacaaugguagacccagcgaucaacuuguuuuuccuaaaaaugaaaggugaacuggaacagacuaaagacaaacuggaacaagcccaaaaugaacugagugccuggaaguuuacgccugauagguaaacaaaucauccuccccaguuaagacuucccugacagucccacuacgagaaagcuguggugggacaaccaaguacucguuuccacaccaagacucagacuuuuugagccaaaaaaaaaaaaaaaaaaagccacauucuuacacuguccagcuuguaauguuuaauguaaaacuuaccagaugaaccuuguguuucagcuuuuuucuuuuccccuuccccuugcuucagacgccugauggcaucggacuauuccgaagaaguggccaccuccgaaaaauuccccuucuaga

SEQ ID NO: 16252 - RNA, 1424 nt, Homo sapiens
uuccucgccucuugcuuuaaaggcgccgcgcuccuuuccccguggccccugcacgcuccuggccgccgcggccacucgggggcaucucccaccccuggaccacaggagcuagagcgagagaauuccuggugucccuagacuuggauguuacgaagccuccggcuggacuucgcucccuuagcgcacacccgccuccugggauggggagacuaaggccaagaugcucugucagggagugagugaugcaugcaaagcgccgaggaauuugccuagccuuggguggugacaacacauauaaggagcccaaacacauuugcuucugggugauggcuuuuaugccucuccgaaaccauagcaacgaaacuucuccacugccagggcuuggagggcugcugguagucuccaaaguggaccucuuaguccaacuacggucauuucccugagguucgcaaaaaaagaucuugaucugcgcacccucccaccccgaccuccagcgcauagagcaaaugcgcucugguagcgcugcugcggguauucccucagaugcugggagucacagugcccugcucccugccaccauuauugagaacagaugcuuggaaauugacuuuuccugaguguuaggaggucgggcgggcugucucuguguauguauggcgccuuaaauagcagacuccccucuccccaccaaacucccgcccaggccccggaacucucaaccuaaacacauuucagaaagaaguuggauucgagaucuagugggcgccgaaccugaggucgcagacuccaagauuggagacaggagucugggaagcagcccugguuuggcggccacugguccaaguucucgggaggacucuuuuaaaggccagagauggggaggggcaacugagucccagagucuucccgcagcuuggcuuccagggaggggcuggcggcggugagcgcaccaggcucucccugcuucacuguggaaacgauuagcuuuugcaaacaaucccugaguuccgcuccucugggucggaaaagucaacaucuauucaaaaccguugcuauuuuauccucagcccuacaauauuaacuggagcugaguuuagcaguuucccccagaggaaguuggccagcucagauucgcgaggagauuuaagugaggcuaagcgggaacaggccaggcgcacugggcucaagagaccauuucaaacgggcugcauaaagaaggggccaggggggauuccacggcucugcaguccccuagcaguuccagucccuggugguucuccacuaucuaucuaauuccgagguccgggaauuagagaggcucugaguccccagggacccguugucugagcuggagaccagaacuugcccuuuugcuuccuccuucacugcagcccuaguaaaguuaagcccucgccggacccugg

SEQ ID NO: 16253 - RNA, 14914 nt, Homo sapiens
auuuucuuuauauaguuuuaacagucagaaguauuuuacuuuuaaaaucuaugaacuaguuaauggacaauauuuuaauaaucugguauauuaaauucaaaguuuaacaucuggcaaaacuuugcuucacaaauucacuuuuuuagaaugauaggaaauauauacaacucagaauccauguuuagacaaaugcccuuuuccuuuccucaacauaaaagcuuuaaaaagugcaguauaaaaguuuuagauaugaaggcacugcauaaccugcaucauauggcugucuugcuuagcugcaagaauaaugaaaauauucuaccucaauuuuauggagcauaagaaaauuuuuugaggaaggacuuaacucucaaagaaaaagaaaccuuuuaccccauuuaguuaaugaauuccuuuccaagauugcuuuucaaagauuuguuggaaaagcuaucuagaguaugucaaccacaaauaugccugaucucauucugcaugagugucagaggaaauggggaagaguacuacaggugugaaaauauauauauuuccaaaauaguaacguaucuauuauaauaaagcuaaauauaccuuucuaaauccaugguuuuuauauaaauacugccaauaacaugaucuauuaaaagaauuuuuaaaggucaugguauuuuuagaaaucaaaugaaccaauuugagccauuguaauccccuauucuuaaacacagggaguuuguauuuucucccgauauuguauuuggucuugaauucacuggacaauaaugauguaugauucaagaaaugcucugauauucuaaacucuguuauaagaacaaaaaccauagccaggggaccuuauuaacaauuagccauauuuguucuucucuuaccaaacaaaccaaaugcuguccaacaucucaugaacuauaauaguagccauaagaggcuucacgguggcuuggaaaauuggauccuaaaguucuugguagcauauaguugauuucaaauccucuuuuuaaggacaugccaaaaaagaauggaaaucugccccuuaaauuaaaaugauaccauaugucuucacaggaagaaacauuuuaguugaaguaaacuuuguucuuucaaaggccaguaaaauagugguccaaagacugucugggaggccaagacaucuuuacaaccuggucuaaugauuccuguuucuuuauaagugcuuucauuacauauaaaggagaagaaaauaauauauaugcuuuaaucagauuaguuucagaacaaauaaaauaacacauuagagaaaaaaauuacuuaaaaauaguuguauuuauauuccacaauuuguucaaauacugguuuucuuauaaacuuucuacaggauguuuuuaaacaaauucuucacauuguguuuugacuauguacuuacggaauuucagggaaauaguucuguguauuuuuaauagcuuaauuuguacuaaagggaugguagguggucacaugcaguccaugugggauucuaacaugacauuuagugaguuuucugauguggaccaucccuuugaugcugaagguaaugcaucuguugaaagaagugacuguagauuuggauuacugcucucugcaucuuccaguuuuucuguguuaucuucccaauuaauguggaaucuugugacccugggauuagaugccaaaauauuccuuugaagcuagaggaaaaaggaaacauacaaaugguaaacacuaagaaaguuaaaucaccauauacaaauagaagcuuaauaaaaugguucauguuaguacuccuaaagggcuaaguucauauacaaagguauaauucaaguuaaguaccuuaaauauaacuaauaagauguaacgacuagggcuguagcaaagaaguuauuuuagauuaacagaaacaagauacggagaaucugaggggauucaucuggcuuuuuaacuauuuaacuccuauacuucuguuuucuaaaagaaagaaucuccucauuuuugaaaaugaaugcuucagaagaugcuuuauuuaacaagcuacuauguuguuuagauugguauguuuucaaaggaaaaugaaaaauugucaaauacaacuuauuauuaaugguuuccuacaccuuuuaaagauggcucauucuuagaaacaguccuguuucuuuugugcuauauaaggugcuucagggauaacaaauuggaucaauggaagguacaacaagggugaaaaauaguccggccuuauuaucagaaagaacaugagaacauucuauucuauugucauguaauuuuucuugcaugguucaacuucauuuacucugcacucucacaaaaucaccaguuaccaaacuguuauaguucccagugaaaaaucagaaaauacuaaguaucuuuaagaaugcugaauccuagauuucagcuucucacucagaauuuaagcuguuuucaguaccagaaauauuuaagacuguuaguuuaacuucuaagaauagcagauaaagcguauagguguuuugagauaaccguauucauaggaaaaacaaacauaaaacuuucauaauuuugggaagaguuacacacaaaaauaucaucauugaauaauuaguacaacaaaaaugcauuuguuuguccuaaagguugaaaugaacagaaucaugaugggaauaaucaauaugggaaaugcuauaaagaaagccauaaacaaaggccugucuuacaagaaguacuuucucugggcgugguggcucacaccuguaaucccagcacuuugggaggucaagguaggcagaucacuugaggucaggaguuggagacuacccuggccaacauggugaaacuccaccucuacuaaaaauacaaaaauuaucugggcguguugguauacaccuguagucccagcuacuugggaggcugagacaggagaaucgcuugaaccuaggaggcagagguugcagugagccgagaucaugccacugcgcuccagccugagcaacagagcaggaaaccaucucagaaaaaaaagagguacuuucauuuuucuaaaccagaaaugcucaaggugucugccuacauuaauuacuaaugacucaucugaagguaggguuugaagucauccaugguaauggaacaauaauuaguuugcccaguuggcauaaggaccucauauuuauuuuaucucaaagccauuuuaauaguauacuaugaaauugcaauagcaacugcuuuaaaaauugcauaguaaaaguaguuaaaaaggaauaguaagaacauuaccuuagaaaagucugguuuuacugguggauuuucccuuaauucugucucaguauauucauuauuuacauaauagccaacucuaauaaauucuuguccucgauagguacaaguaauuagcacaacaguuacgccuacugcaucugcaucuggaaugaguccuggauuaggugcaucagccuagaauaaauuaaaaagaaaagaaacacacacacacaaaaggcuguuaguggcaggcaagacuggaguuucaguuaccuagaaccaucaguugaggaugcaacaagaaaaacuuggaaaucauacugggaaggaaaaugcucauuucugacugacuuauaauaagcuggaaaagacaguucauguuuugccacaauauauguaaggacccuugauacuugaaagcaugacuacacuuguaaaaggaagaaauucuggcuacacugcauggugguucaugaaaggauuauacacuauucauuauaaaaccuuuauagucagcaauugauuuuaaccuuuucagucauaauuuucagaccuaaauuaguaaguauuaaaugaucuccucauagacuguuggccacaaauguuuauuauaccaguuucccucuucaacccaggauacuuauauucucauacccacucaaccacccccacagguauucuaauaguaaauuaguauaaaacugaaaaugagguugggugugguugcuuacacuuguaaucccagcacuuugggaggccaagguggguggaucaugaggucaagagauugagaccauccuggccaacaugaugaaaccccaucucuauuaaaaacacaaaaauuagcugggcaugguggcgggugccuguagucccagcuacuugggaggcugaggcaggagaaucacuugaaccgaggagguggaaguugcagugagcugagaucgcacuacugcacuccagccuggcgacagagugagacuccgucucaaacaaaacaaaacaaaacugaaaaugagauggaaauagcuacauagcagauuuucaaaaaauauuaauaauccucuauuaugaauaguuacuuugcuagacucuacaauauaguaugcucuuuaaaccacacauaauguggaaaccagugaagguaaggauugcuuuaggcagaugucaaagaccuuguuuuaaaucaagcuauuguaaggugaaccuugaggaaugcagaaaguaaacugaguuagacuagacuaagagcaugagcgaagggcagggccccauccgugguagggugcagguaguaaugagacgaccggauggaaggagccagacuggggaacacaggcagugauggcugaggcaucugaggcagccauucugggugguaaauggaucaagucccagcaaauuagcuuaccuguugccagggcaccaaggaauauuccugggccuagaugagcacuuuagccaaugccuuagcuugugaaaauugaagacuguuguuuacuguaugccuaacacagguagaugauacaaaaaggcauaaaaucgcuaccuaguguccuaggcuaaaaaccucagucagcuucacucccuuaucuccuacaucuagucagucucaacauuuuuuucauuucuggaggcugaauucaugucaucuccuaucuggaauauugcuuagaauuuucuaacugaucuccccagcucuagccuaucauuugcacugcuaccagcauuaacacagauauguucuuucucuuugguuuuaaaaccucagauuauuaaaacccucagaagaguauucccuuuucuaagggauaaaaucucaguucuuuaacuucauugacaaggcccuucucaguuugucuccagccaauaucuccauucauaccuccuuuaacuccaccauuguucuagagauaugaaucacacagguucuuuaaaacguggugauaaucuuuucacgcucugagcacgguggcucacgccuguaauccuagcacuuugggaggcuaagguggguggaucacuugagcccaggaauuugagauuauccugggccacauggcgaaaccccaucucuacaaaaacaaauuuaaaaaagaaauacuucacccccugugcuucuaacauacuguucccuuggccugaaagguccuucgcucacauccugaaaaauucaucuuuuaaucuuuuuuggagcuuacaucgaguguauucucagugacgcccuuucuaacucagaagguagaaucaauagauuccuuuuuuaugugcugauauuucuugucacaaauuaucuaagaacguaugcccugugaucuaaacauguuuauuuuucagucuucucuucuagaugcuaugcuuuauccagggcaggagucccauccaguucaucuuuauaaucucguguggcucagcucugagcacuuaguauuuuggaauucauuuguaaaucaguuccugcccugaagggguuuaugaucucuuggcaagacaccaggauaggggacagccagccuuguccuggagaauaugcuguuugucuuagagauucuacacaccccugcacagagggguuagauuacuuucaguguacccaaacggauucuaauauaccugaaguggguggagaugggaaauauauaauaguucaguacugcuaugagaacucuuccccuucccuucaguaaauugguucccuucaguaaauugguucuaggcauguuucuguuuuaaaaucuguuguaaauauaaaacaucuuuuaaaaagcauuuuacaauuugaaaaagauucaguuugagcaaauuuaaguagagaagcuuacaggccuuucaaauaauuuaggaugcagaaguaaugagcagagaucuuuguuuugacucuagcuggcaauacuaggcagaugucuggacaucuuccugcuagccuuugacucacucagaagaaagacauguuuaacuauuuagagaggcaaaaucauggcagaccaagagauuacuauaguaguuuuaaaauacaaaacaaaagcuguaauuuagucucuuucuguugauaauggugaauucuguaaaaccuuuaggcugaauauacauuguaccuccucuguucuuuuuggcaacauguacacugacaccaagguaaaacuacgugaagaucaccagcaggaaauacuuuugaauacauuuuuuuugcuacagcacuuucagccaaaagcuuaggaguaugcuuaauaacaaacacaaaagauuuucaaggguuuguuucaauaacaaggcauuuauuuguaaguucuuauaguagccaaaaaaaaaaaaaaaaaaguauuaucaguaccugucaacccagguuucuuuuacuguaucaugaauuaucaguaaaguauggguuccuuaggccugugggucagagcaaguccugcuuuuuuauauaacaauuucaagaaguuaagagaauaaaaauguaguucuaauuuuaggaauagggcacucuuuaugagugacugauuauacuguuuuauuccccauaacauuuuaaugagauagaauauuauccacauuuuauagaagacuggaaugacuaagggaggagguuagagagguaaagccacacauggcuaauacagaggugucgggauuugaccuauaucuauaacugcagugcuuccuucuacagaacagggcauucuguuacccaugucuuuuacaugguuaugcacucacacaacuuugauuaacagcacuuuuaauucauauauuugauuaguauauuugagcuuuucuuagcuauuucuuuagauacaguaaauuauuuguugcuuuuuaaucaaaaguacuaaggcuaggaaaccaagauucuaaauucuguauuuaggacaggggagggaaagguagcagcucuagagauggcaugugucuaagugauucuuugccaguuucugaugggauuauuugaccaaugguauucauuuaaauuggucccaucugugaagugagaaaacagaggucaggcauaggaagaguuagauuuucuuucuggauuaagucuuuucagugaguuccacuuaacugaugggacauugcuggguugaaauacuuguaacagaaauuaauaguaguuuuaaaaaaccuauggcuaguuacucuuuggucuauuacaaacaucucccuuauaaauaagcaugcauaauugaggaauaacugaaugguuccauauagcaauuuaacauggauuaaaagaaauaacacuuuugaauauagaagacaaugucugaagccuugguauagauccaaauacucucagugguaucuaagaacaaaauuuuuauuacuagaaauucucuucacaaauaccuagugggguaguaaauuugcaaaaguaguccucuuauaagauaauguagauuauaagaugcuuuaguaaacucuggaaugucauuccaaugacccaagaccacacaucucuauccacuaaacguaucuguuaaccuagcucaacuacugauuaugcugaaauaaaguuguuuuuguuacaucaccaucaguuccaguggcugaaaccauaaacugaagaugcauauuacuaacaaugccaguuaguuuuagauauuuugaauccauguuuuggguugcuagacagccaccuuggaagucugauacugaggugcuauucacaggaagagccccaaauucaccacccugugugccaugauacaguauaaaauuuacuguagguuguucaucucucuaaaguaaacgucacauuaacaucucucagcauauaaaaccaggaaguaagaguuccucugugacacagagacugccuaaaacaugauggaaacagauuuaaagugaaugcagcagaagcaguucuuuaacccaaaaggaaagggauaaggguuauaagauaauagauaauauagucuacuucgaaacauauuuggcauacacauuuaccaagauuaaucuuaccugaaauacaaacauaugccuuccugcgggaacaggacccacuaaaacagagucuaaaacuugaucguauucuucacuuucugcagagcccacauagauaauuuuccauuccaagucuaggguuaaaaaaccaaagcauuauuucauauucaguaauuacauuaccagaugacaucaaagacccuuuuaauguccacuuagccacuuacuggcuuuaaaauuggcuucucauagcaauccagaaaggcagugaaaugcuccuuauaaaguuccuaccagaguucacacuuugaucagaguuucucaaaauacucuuuugugaaacacuaguuccuggacagugccucacaaacaagauaacauagccaaacacuugggaaaugcuguaaaccuugucuugaggauucauaaagcaugcuggcacaguaaguuuucugagauauccuucaguaaagaacaccaguaacauuaauccagcacuucccaaauuuauuuggcuauggaaucccccuuuuuuuguauaucaucuuuuaaggcccuucucaacacacuuuggaagggcagcccuauacuacgcugcagagauccaaauaaucacagagcuccaaaguagaaaaauuauuaguaaaaccucccucauggcucagaaguaaguggcuucagcucaucaacugucaacgaacaaugguaggguuuuucccuuacggcaccccccugugucauacauucuuuaaauugggcagaggaaaccaagaucuuuacaccacgugauacaauagaguauacacaguggagauaggcaggaggaaaagacauucaggugcaauucaaggcguuauauguaauucaauauagcggauuuuacugagcauguuuuacaauguguucugugaagugaacccagagaugaguagaacucuuuggaggagucuccuguuuagcugaggaagaagauaacuuuguaauacaaaccaucucugagagaccucuucaucuucuuuggguauuuugcacuguguggccugccucuugcauucaacacacuguuacacaagcacucccaaagggugaguuucugggucacucaugacaaucuaguuagugccaccauguguggccauuuuuguguaacuguagauauuuuuguucccuaaauugauaauagaaauaguaacguacugcuuauuuauauuguauuguaaacuacaaucaacugaaagcuccuuuuuuauuuucucuuauuaagucagcaaucauuuucugaggaccuauuaugucauggcucuguccuagaacuaaaccauuucuauuuccagcuuccagcacacuuccagaugcagggugcugcaucugacaucuccugagaucaucuguugauggagauagagaggaaguaggcaauauaaguaucucgccagagggaacagcaaauacaaaggcccagggguagggcacacuuggcaagaaaaagcaaggaggcuagggcuggagcagaaugaaaggaaggaggaaagcaccaaacccuaugauugaggaugaggggaacagccagaucaugcgguuuugaaggccaucauaaggacucuggcuuucacacugcguggcaugggaagccaucgaaggguuuugagcagagcaguaacaggagccaacuuucauuuuaaaaggaaugcuuugauugcuguguucaauauagaguguaagaggacaagggaagaaacaauauuucaauaauugaggcaagaaauuaugguggcauggaccucguguggccauggggcugugcaacaguuauauucuggauaaaauccugaagaugaaagcagcaggagccacuuuugcagggaggugaugugggguaggggagcaaucaggaguucauuuuagacauauuugagaugucugcuucuaagcagagauacugaauaggcaggauaaaaauuuggaaccugucaaugauauguaaagccauaaaaauacaugggcuugcucuagggagugagauuugagcccuccaaagauaagaggacaaauuaaguuacaaaacaaguggcaaaugagguaggugacccaaaagccaagugaagaaacuguuuuaagaaagugaugugaaagguacuaaacuagccaagugaggauaagacuaagaauuaucacauagaguggcugggcgcaguggcucacgccuguaaucccagcauugugggaggcuaagguggcuggauggcuugaggucaggaguucgagaccagccuggcaaacauggugaaaccccaucucuacuaaaaguacaaaaauuagggguggcacaugccuguggucccagcuacucgggaggcugaggcacaagaaucgccugaacccuggaggcggagguugcagugagccgagaucgcgccacugcacuccagccugggcaauggaacgagauugucuccaaaaaaaaaaaaaaaaaauuauuacauaaagguuuucaugaauuuuaauuucauauauaauuguaucacuacauauaaugcccuugauccuaagugguauaaauucgcauuuguggacuggcauaggaacauagccauaauuuauaaaccuauuuuagaaaauaccuacuauauacugggcauuaguucuacuucauaccuauuguuuaaaccucaacagcuucaucauguagaucaaauuauccccauuaugcaaauaacuugagacucugagagguuaaguaaucuacacaaauucauaauuuguacaucaaagaaucagaauccaagcuaugccucuguaacuacaaaccccgggcuucuucugaaaaccuaacugggaagauaaauucuuucuagcucugaaauuagcaguggaauaagggaauuuauuugcaggggaagugagagcagaggagauggagagagaaucuagccuuaacaagaacaggcugcaacucagggaacacuuguacauugauuuuuauguuuaugggaugcuugcuacaguugcugaguuuuacaugcucaauacccuuuuauacauuggcaucaguuuuuuuguuguuuuuuuuuuuaacccagcuuucauuuaauuccucugcccccuguauuugagggaggaaggguaaggucagauguuuuacauaaguucucaggugaagaaauuuguucauuuauuuuaaaguuaacuuuuauuuaaucacaguaaucaugauuaaaugauuuacccagccugaaaguauuuacauuuguggugaaagagugagugaaugagggaagucaucaagagaauuuuuagcuaauuacacuacuugggaagaccuguggucuaguggaaaguauguaggcuuuggaauuagaacaagcugaaguuggaaaguaugaagcaccaugcucaauucugguauauuauaaguauucaauugacaguagcuguaauuaagauauauauauauauaaauuuaagaauggcaggauggucaaucaaaacuuguacagucuuggugaccaucaagcacauccagccagggucucaggcugucuuaacccuugauauaagcccuauauuagaaagaaccaaauuaucuuaagaccagauauuccucaaggcuuuuucugaagcaaagcuacagggcagcucuuaaaggaaagugaacguuuggggcuacugaugaaaguaugaaaaacgguggccaaacucugcuuugagacuugaggcaaaauaacuuauuaagaaaauucuuuucaaaauauucuauaguuugggcugggugcagugggcucacuauaaucacaacacuaugggaggcaggggugggaggacugcuugagcccagggguucgagaccagcuugggcaacauggcaaaacuccgucucuacaaaaaauuaaaaaauuagcccaaugugguggcacaucgacuauggucccagcuauucaggaggcuaaggugggaggauugcuuaagcccagguugaggcugcagggagcagcuguguuugcaccacuguacuccauccagccugagugccagagcaacacugucucauuuaaaaaaaaaaaaauucuauaguuuaauuuuaagaacagaauuuuuaaaagaacuguaauauaaaaguauggaaccuauuagaagccuuugcuaaguaaaaauuuccuuaauccacauagccucuagguggaguauacaggcauggcaccuuuuugaaagauuccuuugcagcuucaguaugacucagcuuaaaauauuuuuuaaaauacuaaauaaaugcucaguaauggugccuaggaagugaaauauaccauuggaaauaaguauguuuuugacaccaguacuguaaaucccugaugugauucagcuggguucugaauggaucccaguuaaaaauggaacguuuuggcuuuaugaauggcugguuucaucuaugcaauguaaaagcccuguaacgacauccugagucaucuaucuucuuuguucagagcugacuccuaaaauggaaggcaacacuugagaaauaccuguaauuugaagaacuucuggugguauaucugaaaaacagugugguauaaguuggaauggaccgaucaaugguuuuucuuuugucuauuuuuauaugcaguuggcaauaaaaaaaaaauuacuguugggugugaaaaaugggccugguagcugcaaugcuuauauuaauaguaguaucauaggagaguaaucaaaugacuucagaguaauaagaaaaauaccccuuaguguuaucaauggccuauuugaaauuauuuuaauaaaugaaucaucuuucaaaauuugcccuauauauguaugugcauuuaugcucuauauagguuuaaaaaaaaaaaaaaaaacgggggcacauguuaaaguaauaauugugauuaccgaaaggagauagggcaaggcacugaguacagagaacuguuaacuuuauauaugccuguacaacuuucuaaaaguuuauuacaaugaauauauauuguuuuauaauuaaaauuaaccuuacauaugauauauacauuuuagagauuaaaaacuaguuuuuaaaaugaaaaguuuuacaugccacgauuaccuaaaucaucuucaaugcauuuuuuacauauacuucuaguucaaaguaugucccucaucgaugaaguuaaacuauuuccccuucaaaacuggcaaaugaagcacugaauuacuuuaguaaaagauaauuaaagcaaagauaauugucguuuuagcuuucuaaauauuuauuacuaaagauauuaaaaauacguauuuuuaagaccuuaaaauauauguagaaaaaauaccaagaauucuuggacugacaugaggaguugaccuuaauuuccuagccuacguuuguguuuuauguuuaggguguguucuguauuuggauguggaguuauuuuagauuucaacacggucuugaagaaagucuuccuucagacuauuuauaaggcagagauuaaguccuggaaauuauuuaaguaucuuauuucugcuuuuagguuaaauguaacuuccuaccucagcucuauuucucuuccugaaauuagcuuuucgucauuaggggaaaggaguccacguugguuggggagccugcgcgccagcaucccggcgcaucccgggcgccggccgaggaggaccggccgaacaggacccacggcccccggggagcgccggcgcccagcccgcggcgcggaggggccgagccugcgcccgccucccccgcugguuggucgaggaagccagaaaucagcgcgaggacagccucgcucuccuccccgaagcggccaggcauggccagcccggagagugcggcgacuccaccgugagcucucgagagugccugccugccuuucgccgggggcaggcgggcggcggggcaagaggaggcgccgugcgccggggucgcuggcccaauucucgacucgggguaagauggcuccgcuccgaacucgccggcgcgaccacacgcacagccucucccuucccagccucccugcucgggcccggagggucgcggaggcuguuggcggcgcggagccagcccggcgcgaccucaggcggcgcagcgggagcgagugcgggucuccgagcugcccgcccgcagacaaagcugacaacauggcuaccuccgcuccuccgcucaaacaaguuccucgcaaguugagcccggcaggcgccugggcugcggcggaaagccgcgcgcgccucggcggccgucguccaucaacuucaaguuucccuccgcagagcagcccgcggccgccaggcgccgaacacagccgcccagcgcgaggcccggcccgggaaacuuucaacgucugcagcccgcaacugacagcccgggcgcacgggcgccgcacucaccuucagacagguccucgaugcacucgaaggugaucucgaacuggaacggguuguagaaaggagaaggguuauccagcaccacuacauuguucaccugaaccuuugccauauuuugaaaaaaacacaaacaaugggaacuggggcugguugcggcacaauaaaguccagcgcgcggccgcucgggagagcgcagacccccgcuccagcgccggccagacgucgugcagcggcgacuugagaaacuuuuuuccucuuuuuauuuacacgggagcacuccacaguguuuugcagcuuuccuauuucacuaaacuacagcccauucugcucugauaaguagcag

SEQ ID NO: 16254 - RNA, 4811 nt, Homo sapiens
gauuaaauccuugcauacaagucauauaaguauuuuauucuauuuuuauuuaagcacuuagaaguauuagggauuuuacaaguacuuuacaaauaucaaauuaugauucuaacaguuaagugaagaccuuuucauuuaugaaaauuuuaguaacuuagugaaauauguaucuuaaaauaaguacucauuuugcaaauguaacauaaauaacgugcauauccuaugguacauaugauuucacugaccaaguuucuucagcaauucucaaguguuuccuaaauacauuaauaggaaaccccuauuuaagcucaacauuuggcagagugccuugcaaaacaguaggugaucaaaacauauaaggacgccuuauacuuacuauucuauacuguacuauaugguuuucgagucccuacuaacagccugauuuauaacaaugcccuuuuagucuuuugguuuaauuuuugguuauuauggcccacguacagggccguaauaacccguaugccagacucugguuaaguguguuagcugcaaaagagcuuucugccaucuggacauaauuauacacuuaagaguaaucuuuucuugaaggugugaccugcagcagcaccccauggcagauggcacauuugcuaucuaccagcagaaggagaaucagcaggcagaugacugaaagcagcagucuaagagaaacacagugacagccacagauggagagacgcugacuggagacauuaaaauacacuauuucuaaucuuuuuccuuuugaaaacagaccggggauccaacaaaaaacacaguaauagaaacaaagauuuuauuuuguggcauccuuauaggcuauagcaaaaguauaugccauagaaaaauguaacuucuuucagucuuucuggaacucuagaaaguagcuucugauauacagaugcuagacuaaguauaagauauucagacaacugucaguuuuauaagauuacaauuggaaaauaaaacccaacgagcaguuuuuauuugggaaagaaaaaguucuagcuuccauccaugugucaauauuacucaaaauuucuaaauagguacuaaccucugacccguguuccuguagcaucaguccuuugaaucccaccagccagcaccauggccacagcaagcuuuacuagauacauuccaaacacuugagggcacaagcuagccaauauuacauuccuuccuaggaaaagcagaaagaucagaaaucagcaauaauuuucaagaaaccccaacugaaauuucccuuccuuuccuaucugaccauccucauuuaaauauacucuacuaugugaagugaucaggagguccaauuccaaaugaccaacaggauuaaaggaggaaauaacuuuguuuugguucaaaauguccuguuuuuuugagacagggucucacucugucaccuaggcuggagugcaguggcgugaucauagcucauugcagccucaaacuccugggcucaagcaauccuucugccucagccuccugaguaguugggacagcaggugugcagcaccacgcccagcuaauguuuuuuuucuuuuuuggagcaacguggucucacuauguugcccaggcuggucucacuccugggcucaagcaauccuuucauaucagccucccaaagugcugggauuaccacccagcacucaugagugguaugagccaccguauguacuuucuaugugacaauuucaguaaaauuacuccacugccuaaauaaaaggaagguauucaaucucagaaauaaugagucagaucauacaagucaguaaucuuuaaauacagagguagcuggagcucaugaagcugcuccaaagguauaagaaauaaguaaaaaauccacccuccaagucaauucagcauuugcucugagcagucugguaaauucuguuuucucuggaacaaaguuacaggggcaucaaggcauuaagaagaucacugcacaccacaacccuagcaguguaaguaugagaucucgaauucuucugaucaugugcuuuaaauaaaagaacaucacuguuugggguucuguuuucagaaauaacgcaccaaaucugagaaucugccuaucucuuccaugaauaaagcagguauuucauucagucauuggccuaaccaaccuauggaauuccaacaagccauuccugagccuuuccacgacuuauggcccuauacacaaaggcuacuuuuuguaaugaaucaacauugauucaguggcaacuaaucuaugaugauguggccugcgauggcagaaauggugaagaaagaaaaucuuuuaguaaaaaaggaaccagaagauuuaguaaauccaggaaguucauuacuugcugaaggaaucccucccuguuuggaguuagaaagccuggagaaaaggucaggaauccaagcagauaagacuugacagcagguagguaaauugugaccagaaucuagugauuacauguggaaggaaagaagaaacagccccaacaaacagguucaagaguaggcaaauugaucugggaauuacauaagccaaaacuuagagccaauuuuacugaguaacaugcugaugggaagcauaucccugugguaagaggacaggcucuggugucauguuuggauucaaaucccagugcuauuaauuaccaacugucugaccuuaggcaaguuucuuaaccucugccuccauuucuugucugcaaaauggagauuauaaugguaucaagacagaauuguugagaaucaagggaguuaguaaguauacaacacauuaaauaauaacuggcauauagugggaacuacuuaacuguaacuguuagcuauuuuauuaccuguauuauuugugcaucuuucugaucuaaagauuuccucacacuguggucaacacaaaagacuacaaagguaggacuggggucccagagagaagcaaaaaggaagggccaaauguguugucuaaguugaaaagcuugauuccuuagaucauggcagcagaagaucucauggcuauaucauggaagaaaaugcauuagcaccaguacuacccccauccucaccucccucccaaauuucuaguucuagaccaugucaauaguguggcaaaggccuaguuaucuacucuuguguggcccucaguuaucucaaugaagagaacuuaguaggcccuuaguaaucucagaauuaagauaagucagugacccccaaagaggguucagauggcccaaaacacuccaacccuuacaucuggguuucuaacaucuaagcaccagggucaaggaaucccucaggugacagcagaucagaauaaggccccuagguucauccuagccaguacccacaggaucaggucuuaagcaagucaaccuccaagugcugaucagugaagcauucuccagcuuuagaccagcaaaaugaagauguucuguuggauacagcuucccaacuucaccucuccucccuccaacacacucaccaacacucugaaauggaggaauaccaguacacuggugcugguccauaggaaacugagaauccauucauacuaacaagagaaacacugccuuauuuucuugcuaucuuccuacuuauauuucucacaagacuauuauauuuacuucugccuuuuauccaauaaauggcucaugcaacaguagccuaauuaaaacaagacagauucuuuaauugccagcacaaagcacgucugaagaucuaguuagaguaccauaugauggccuucccuucauuguuaagagguagaacugagcugugacacuguaauaaauaaauaaauaacagugguccaaggaagaguuacaaauuuuuauaaggauagaauccuaagaaaccauuuucaggcuguucaggcugggcacaguguaaucucagcacuuugggagacggaagugugaggaucgcuugagccuaggaguucaagaccagccugggaaacauagcauagugagaacccugucuacuuuaaaaaaaaaaaaagaaaccauuuuaauuuuaaaaaucauuuaaaaauguaugauucuuaaagugccugcuucauaaaucuauaauguagagaacuuuugcuucuuucaauacagaucagaaaaaagaaagaucaggaacuacuaaugugcuauacauuuacacacacacacaaaaaaaaaagaaaaaagaaaaaaucccauaaaauaaaacuaucccuauuuagggaaauggaagcauuauuauuauuauuauuauuauuauuauuauuauuauuauuaugagacagagucucacucugucgcccaggcuggucugcaguggcgcgaucuuggcucauugcaaccucugccucccgggcucaagugauucuccugucucacccucacaaguugcugggacuacaggugcacgccaccacaccuggcuaauuuuuguauuuuuaauagagacaacgccaccacaccuggcuaauuuuuguauuuuuaauagagacaggguuucaccauguuggccaggcugguuucaaacuccugaccucaagugacccacccaccuuggccucuccaagugcugggauuacaggcgugagccaccaugcccagcuagaagccuuauuuuuuaaaauaauaucuaucuaauuuagcaugugauuuaagaauaaaguaaucaauaucucuuagauuugaggggaguguuauuagaaacgucuauuacuggcuucaguuuauuuuucucaaaagaugucuccauggagaaaugaaaacaggcacuugaagauuuaauuggugcuuuacacacuugagauuuuuuaauaaaauacacuacaaacc

SEQ ID NO: 16255 - RNA, 65959 nt, Homo sapiens
caugguucaagacugaacugauacauuuggaguagguuuauuucaaguaucuggcuuuguggccgaguggaauggugaugguauaccaucacucauuacucgcacaacaucccuccccucuuuugacuggugguugaacaguuacuugcuuuaggauacccaauuuccaaauccccauguaacagggaauaaaccugucuuuccucacuaaauaaaaugagguaauuucacccgaaagaacacagauggguggaagacagucaauauucauaauugcaauauacaaaauuuuguguucuaccuggauucuuuguaguuccauauugaguaggccaauaagaacauccucuuuucuuuagcaauuugccuaacauuugauacaagccauuuccaaauacguuuuugguguguaucaaacuugagaaacuaggagcucuggaaauuaugcagcaguuugaauuuacugccuuuaaauugucuuccuuacuuuagaaugaacccgaagcguaaguaaugaauuuuuuggaugucaguggcucuuaggaauugucauuuuauuucugcuacaaaauuuaccagaaaaagguacugcaacaaucuuguauaaagcaaaucuuuaacgaaagaacaugguauagacuuucuaaaaauauucauacuuuaucacaauaacuacaaggaaaaauucaauuucuaucaucagaaccaagcugcaguuucugagguaguagagacagaugacagaaaaguuugaaacaaaaccccuaaaggaaauagucaacuuguuuaaaauguaaaaauuaaucgaauaucuaugaaagggcacaggaagcuagauauuuuaaggaaggaagguacgcuacuuacaaaguuaacuuguaaccacacaggagguguaaagauucuagagaagagcacuuugguuaacucuauacguucuguggcucuacccauucauaaacgagucucuaugcauaaaugaguacaccaauaguuaagauuaccaaauauauuucaaaccuaaaauuaaauuauccaaguuguggucccuuuauucaaaugguaaguauauccaugcaggaaguccaaauaucuuaaaaggaauuaaaauuaaauugcauauaucauauuccuucaauaguuugaggucuauugcuuuuaacaagauuaguauuauuccauuuuaauacgucaggaguacauaaacacaaguacaccugaaauacaccaguguuuaaacuuuuauuucacaccaugcaaggucaauuauaacacauuaaaaagugacaacagcuauaagcugcaauuuuacauuuguaaaucggaaacguccauuuucaaaagcugaacauaacuaucaaauuguaauagcuaagcuucaauccaacugcuuauacagaugaaauuuucuaugaacaacaaugauuuuauaucuguccacauucugugauaguuauucuucgacaaacagacccuuugggagaaccaaaugauucaaucuuuuucacaguauccaugccauccuuaacaaacccaaauacuacaugcuuaaaguccaaauguucugcuuucuucaguguuauaacaaauugagaauuauugguauucuggccuugauuggccauggauaguaaaccaggaccaguauguuucacaucaaaauuuucaucuucaaauuugucuccauaaauggacuguccgccuguuccaucauguuuggugauaucuccucccugaaaaaaagauuuauaauaaaaaaguuaaaaauuuuuuucaauuaauaggaauccugaguaaaauauuaaaauacacacagaacucaucacuacauguuaaauccuaaagcccagcuuuccugaguauaguuugaaaacuaagaaauucauauuguuggaaagaagaugaaaaaugaaaagguuuuucccaucccuuaguuucuacuagaucucaaguacugaaaauuugauuuuuuuuuuuuuuuuuuuuuuuuuuuuuaaugacaggcugucucacucugucgcccaggauggagugcaguggugcaaaccuagcucacugcagccuuggccuccuggaugcucccaccucagcuuccuuguagcugggaucacagacgcacaccaccacaccuggcuaauuuuuguauuuuuuuguccagacgagauuuuugccauguuacccaggcuggucucaaauuccggggcucaagcaaucugccugccuuggccuccuaaagugcuggaauuacagguaugagucauugugcccagccucaauuauuuuagguugaaaguuuuaggcaggagcagggaauggguagugaugccaugugauuccauguguggaaaaccuaaagaaaucuuuaacaaaacuacaggaugaggucaaggaaaaacacucaaauuucccauuaguguggugcacucuucaagaccucaauugugguauguacuuaauaauaccuacuuggcaaacaaaaucuggaauuacucugugaaaaauggaauucuugaaaccaaagccuuucucuccagugcauagugcucugaaguucucagcaguccgaggaacaauguuugaaaauaauuccauaguuauccgcccuagagguucaccguccgcacaaacaucaaaaaacaccacaggauuggucuccuuugauaauucugcugccagugauacauguccuuucuggaguuucauuaaauucugcugacauucuucaaauguuuucuugaaacaaucagcuacuucuuuaguuuuaaaucucacugcaagcuguucuacuuuugcuucuccaucuggcagggagggaaaggggaagcagugaccuuaguauuaaaauaacuguuauaaguuguuuuguuuguuauagauuuuagaaaaguccaaaaaaugaaaaguagcauuugaauguaaaaacucaccagcauaaucugaggcaguccaaacuaaagcauuauuugaaacauuuaagggcuuuaauuccauuguuuuaguaauaacgugguuugcacacacuuuaaaaaccuggucucuucucauuaggauccgguaauaauucuucauuguaugccaaagaaucuuuauaucuccaacaccgcgcuccuuccacugacugacaucccgaucccaucuauaaaguuuggcucucucuuuaaacaaaauuucuucaucuucuucuccagauuuuacuucuaccuauaauaggagaugaaauucucuauaagcugcugcuuauaauaaauuccaugacaaauuucaaagauccaaauucuuuuaaggcauuuucuuugugaugacaaagagaauuuguuaaugugauaacugguuauauaucuuagggcuaggaauauaucugauuuggcugagggaguaaagaccugauuuaucauuaaacauuuucuuuuauauaauauucauuuucccuuuggaaauuaaaugcuuuucuuuauaggacagagagguuucaaaaguguuugcuacugaagagaaauauuagcuacugacugagguuaaaaaaugacaaaguaauuuuccuagaacaauguucuuguccaaaaaacauacaagguuaacauuuauugaaaggacuuuagugaguaugagguuaauuuuuccccagaaucauguuauaaaaacaaacaugauauucuagaaacauaagaaaaaauuauuucuuaccaauaauuacauauagaauuuacaaaccaauauuuauguaaaaacuguaaaaagauaauuuauacuuaaaggcuagacaucuaauaaauagagcuuccauuucaaacaguaaacauucuuaaaugcaaacaauuauacccugacagaucaagccaggguaaaacuuaaaaaugaaaaauaaguuauuaguaaaagguuaauuccuuaacauuuaccucugguagugacacuauugguucaaaauggauaucuucauuaugaacuacuucuucaucacuaccaucuucaucuucaccaacuuuaccggcugacuggguuccgacugacuguguuccaaacacagcugcuccaguauuugcccauuggaaauuuuuaucugaugaauaaaucaggauauuuaaacacuaguaucuauuuuuuacauuuuucaucccccucuuauuuuaucaaucccucuaauuccugaugauguaauauguacaucaauuuuaaauguuuaaaauuauauuauucuaguaaauuccucacgccuguaaucccagcacuuugggaggccgaggucaccugaggucagggguucgagaccagccuggccaacauggugaaaccccaucucuacuaauaauacaaaaauuaggcugggcgcaguggcucacgccuguaaucccagcacuuugugaggccgaggugagcgcaucuccugaggucaggaguucaagaccagccugaccaacauggagaaaccccgucucuacuaaaaauacaaaauuaaccaggcaugguggcauaugccuguaaucccagcuacucgggaggcuggggcaggagaaucgcuugaacccaggaggcggagguugcggugagccaagauggcaccauugcacuccagccugggcaacaagagugaaacuccgucucaaaaaaaaaaagaaagaaagaaagaaaagaaaagccgggaguggugguaugcgccuguggucccagcuacuugagaggcugaggcagaagaaucgcuucaaccuggggggcagaaguugcagugagcugagauugccccacugcacuccagccugggcaacagagcaagauucugucuuuaaaaaaaaaaaaaaaaguuagcaguguguggucaugggugacugaucccagcuacucaggaggcuggggcaggagaaucacuuuaacuugagaggcagagguugcagugaucagauaccgccccacugcacuccagccuggacgacagagcaagacucugucuuuaaaaaaaaaaaaaaaaaaaaaauuagccgggcgugguggcgggugccuguaaucccagcuacucaggaagcuaaggcaggagaaucgcuugaacuugggaggcggagguugcaaugagcagagaucgugccauuguacuccagccugggugacagagcaagacucugucaccaaaaaaaaaaaggaaaaaaaggaaaaaaaaaaaagcuaguaaauucaacucauacuguugaguacagaguacauuuauuauuguuaugcuuagcgauacaaagauaagacugucacugccuuggauaaacuuccuaauacuaaacuacacaaggacuuccaaguaaagaaguagguucuuuuuaccuacuucuaaaauuucaaguacccaccuugaaauuuuguaaacuuagcucagcaggccaaaccugcuacuuccaaauuagccacaauggccuaaacauguuuauaauuucugcaucucuacuucuuccugaagaagcuaaugcuggaauguagauuucuugguugggcugguggaaagcagccuugggagaaucucacugacuucaacugcccaaaggguauuagauuguuaagcauccuacuucuguaugggggaacaaugauggucucacucucgcauaccugcaagaaggugaaaacuagaaacuucuccaucccauaccucaauuuagaugaccaaguccccacuaucuuagaggaaagaaacaccucucaacuuuuuaucacuugcugaaucacugucuuaaagaacccuacaccuucugcuaaaaacucucaugaaaaagaaaaaaugucacaggauacauaacucaguaccuuaaagaacacaauaaaaaaucaacucucuuucagacagauuuaauggaggggaaaaaaaaauguuuuuaaagaggagagagggccgggugugguggcucaugccuguaaucccagcacuuuaggaggccgaggcgggcuggucacuugaggucaggaguucgagacaagccuggccaacauggcgaaaccccaucucuacuaaaaauacuaaaagaauuagcgggguguugcagugcaugccuguaaucccagcuacucaggaggcugaggcaggagaucacuugaaccuagcaagcagagguugcaguaaacugagaucugcgccacugcacuccagccugggcaacagaaugaucgucucaaaaaaaagagacagaaagacaaaaauucuuaaggacauauugcaaaggaaugaucugagaacaaaagccacagguugcaugggaacuuccugagaacaguaaccacugaucuggaugagauaccaacuugggggcucaaaaauaacuguucagggccaggugcaguggcucaugccuacaaucccagcacugugcaaggccaagguggcaggacugcuugagcccaggaguuugagaccagccuggguaacauagugagaccccugucucuacaaaaaauguaaaaauuagcuaggcauggugguacacaccuguggucccagcuacuugggaagcugagguggaaggauugcuuuagagcccaggaggucaaggcagcagugagcuguguucaugccacugcacuccagccugggcaacagagugacauccugucucaaaaacaaaaacaaaaacaaaauuguucagcaacuuuuuugccaaaagcaaaaauuuaaaaaauaaccccaagggacauguggcagaagaauucaaaauuauuucaaaauagugguucucuacccugggaacacauuagaaucacccacuuguaaaaguauuuguaauauaucaauaucugggucucacaggucauaacugggccuacaguaauguuacuguaagugaauaauuaauuuggcaagcuuugagacauuagagaaaauaagauugaaacucuaaauuaucuggaaauuuacaaaaguauaaagauucccuaugaaaaccuguggauacaaacaaaacugacugcaaggcauuuacaguuucaaauacuauuuuuaacaagcacaaucuaaauuaacuaaaguaagcauucaauacacaagagcuuggugaauaaaaaugacaagugguagugagaagugaauguuaaugcauaaggcuuauuuaggcaugguuuccucccgauaugugaguacugccuacuuuucacuuuaguguccaauauugacauaauacuucaaagaggcuacacugaguaacaaggagccuaucuauuuuuuugggauuuuuuuuguguaaguguaccuacuauauugcuuauuuacugacacauuacccuuugauuucaggcuauuucauaaauuaaaaauaaacgacaucagugaagccaugaauuccaacauaacaucacaucugaagguaauuucuaaaaguuuuauguguuucuagguggcaggagcugugaaaaaagugcaaauauagaggaggaaagaacagaauucugaacugcauuaaucauuuaagcacauauccucaauaaaauguauuccauaaaucaaacaccuuguacuagaacuauuuaaggggugcuauaaagagcaaugugaaagauauuacaagaaugaaaaaauauaauggauggccuuacacuaguaaaccggauacaaucagggaaauggauucuuuucuagaaauguuaccaaaauggauuaaaaauagaaacuccacuaaagaagaugggcaagcacaccaauuauaaacuuagcacaauaaauuagcacaacccuaauacugaaauccaaagauaguacaaaaaagaaaacuacaaaaucauauccuuaaaaaguauaaacucacaaaaccugaaauauuaacaaaucacauaugaaaguauaguuaaaagaguaaggaucaaagucagagucauuccaaagcucaaaaaugguucugcauuucagaauggggaggacuaucagcauggcuuauauaaaauuaagagaaaauucuuaagauuauauugacgucaaaaaauaaaguguagaagcccuucauuauuaaaacacuaaaacaaacugggggguaagggaagaaacuucuaacuuaguuauauacugcaacaaaaaacuaguuuuucaguugugcuugauucuguaacaaugucauuaaaagucucuccucuugaucuuaccuuuagaaccaaaagcaaaaucuccagaauuacuggaagccaagucugcaaaugagagcccugugcuacuuccaaauccaaaugaaacuaucuugcuuuccccuggcaaaagaaaaaaagaacaauuuacuauuuaauuugugcugaauaucaaagcuuuaccccaggaccuagagagaacaguagagacuuguauacucugggaugaggggaguuauuuaaauucugucaaguuacaaaauacauccaauucugagcuacuucaguauuacuaauuuuacaggugcuauucacaaagaauacuacaauacuacaccaaaugcaugccaaaaauuauuuuuuauaaaugagaaggagagcuaucuauauuaagccagauauuaaacuacaguuucugcucuauggagccuacuauacucuaaagcaagcauucagucaaaggcaggguuuuaggaaacaucuguauaaaaacuuuuuguguucuguacuauaaauaagcucauaaaaaccaaaugucucauuuacacuucgucauaaggacuuuugcggucuucucuuaauucugcuaaugugaagcugcaugaucucugaaagccccaugccuuauuuuccucauaugaaaauguaugagguuuuagguaugaagucgucuuccucuuuuagcacauuaagacucucaaaugccuauaaauguaauauuugugacacugaaggcuauuuuuaaaaaguagguaagguacacaaagcaauacaacuuaaacuucccacuuccauccccaaaaucgaaaugaaaaagagagaaagcaauaccaaauauguuacuguaacugaauaauuaauuuaacaagcuuuaaaaguauuagagaaaauaagaaacauuuaaguaguaccauaaaacuuucuuaaauccguaauauuucuacaauuccuucauaauuaaaacacuuugaauaugcuugagugauaauauaauucaaacaauauuuaaaugaaaacacuaucacaaaggaaauuacauguaacaacacuauugucuuuuaaacucaggaaaauaggucagaaucauaaugcuuuguauucccuaauaaccacaacucuaucaauaaaaacauguuuauuuguuggcaacacaguauaauuuuucugguuauuauuacuacuacuacuaagaugccccuuuauacauaucaaaauguguuuuaaagggaguuuucaggaucagccuuuaaaagucuaucuucucaaauauaaggugucccuuauguaacacaugauaaacauauaucaagauuuaccuuggcuuguagaaucuguaucaauuuccuuucuaguugacaaaucuacagguuuguccauaguuucagaggaaacagauggugaacuaauggauuugguaauagaaucagguucuucagauuuacagaaagaagguaccaucacuucagucccaccuguauauacacugucaguugugcuaguuauuucuucugucugagauuucugcaaagaggaagucacaaaauacuaugccacuuaaaugcuaauuuacaaaacagauuauauaaucuauuucaaagggaauugagaacuugggcuucuggagaagauagaauaaacacacuucacccuaucucuccucaaaaccuauaacuaaaugccuacacugaaacauacagagcaccucuaagaagccuuagaaagguggauaaaaacaggaagaauaaggaucuugggaccagagagauaaucuggagguuaagauccacacggaguuuuucugccacuccuguaacccagccugggugcuacagcagcccaaaaaaacuggaacugccaauggcacaaugucagcaaaaaaagagacucuacuuucuucucaagugcacagaagacauucaccaagacagaccucacaacauuuaagagaacugaaauuauucaaaauauuuucauaaaccauaaaggaauuaaacuagaaaucaauaagagaaugauauacagaaggaaaaucaccaaauauuuggaaauggcacaguagcaucuaacguacagaucaaaaagaacgucucaaggaaaauaaaauauuucaaacugcaugaaagagaaaauaucacauauuaaaacuugccaguugcagcuaggaagugcuuagaaggaaacuuauagaauuaaauacuuauacuagaaauaaagaaugaucuuaaauucauaauuuaagcuuuuuuuaaauuaagaaacuaggccgggcccaguggcucaugccugcaaucccagcacuuugggaggccaagucaggaggaacacuugaagucaggaguucaagaccagccuuaccaacauggugaaaccccgucucuacuaaaaauacaaaaauuagccacgccuauaaucgcagauacucggguggcugagacaugagaauugcuugaacccaggaggcagagguugcagugagcugagaucaugccacugcacuccagccugggagacagagcgagacugucucaaaagccaaaaaaaaaaaaaagaaacuagaaaaaaagugcaaaauccaaggcaagaaggaaauaauaaagaagagaaaucaauaguguuuuuuaaaacuuaagaaaacuccagacgugguuucauugguaaaaacugcucaacauuuaaagggaaaauggcaccaagucaacaaccaagucucuuccagaaaacagcaauacagaaaauacuucucaauucauuuuaugauaccaguauuaccauuuuuuuaagaggcggucucacuauguuguuguccaggcuggagagcaguggcuauacacaggcacaaucauagcgcacugcagccuggaacuccuggacucccgagcaauccuccuacucagccucccaaauagcugggacuacacacacauaucacugagcccaaccagcauuacucuuacauggaaaccaaagacaguaucagaaaacuacuaguauccugauaaauauaaacccaaaaauuuauaacaagauuuaugcaaauugaaugcaaccacauaacaaaauuguaccaugaccaagugagguuuacgcuggaaugcaaaguuaguuuucugaacauuugaaaaugcaaugucauucacagauuuaauaaaaaucacgauuguaucaauaguuaaaaauuuuugacaaaaagguaaaaacauuaggugaugaugugucaauguagauucaucaacuguaacaaauauacaaucuuuucuuaccauagaaauuuuagaauucacuuguguacauccauaaagaauuccuggccaggcgcgguggcucacgccuguaaucccagcacuuugggaggccaagguggguggaucacgaggucaagagauugagaccauccuggucaacauggugaaacccugucucuacuaaaaaaauacaaaaauuagcugggcgugguggcgcaugccuguagucccagcugcuugggaggcugaggcaggagaaucacuugaaccugggaggcagagguugcagcgagcagagaucgccccacugcacuccagccuggcgacagagcgaaacuccauccccccccaaaaaaaaaaaaaauuccuggagggguuuugacugguguuguguuaaaucuauagaucaauuucggaaaauugauauucuaguuauuuugaguuuuccaauccauaaacaguauauaccuuuccauuaauuuagauuuuuuauuucaucaguguuuuguagcuuuuggcauauagccccuguguagaacaaaauuaaaauuccuucuuuccuggccauagcugauuagucuagacccuuaaacccauuuaguagccacaacccauuauuauuauuugguaagaacauucuaggucaggcgcaucaccugagguccggaguucgagaccagccuggcccaacauggcgaaaucccgucucuacuaaaaauacaaaaauuagccaggcgugguggcaggcaccuguaaucccaacuacucgggaggcugaggaaggagauucacuugaaccugggagaugaaggcugcauugagccacgagcaugccauugcacuccagccugggcaacaagaguaaaauucugucucaaaaauaaauaaauaagaacauucuaaaguuuacugcaucaacaaaggcaauggaacuagaaggaaaauuuauuagagauguucuuacuugagcuuccugaacuuuuugaagcucugauugaaaguccuccccauuuccauugucuucaucaguaucacuacagacuccacaaaaaaauguagguggaaguuuuaacguaucugcuuuugccuucucuucaacuguugguuucuuuucccaaacaauaauacauucuuucucauuaucugaaaaaucaguacaacacaagcaaacgaaauuagaugaagcccaacuucucuacaacaaugguagucaucaacauaauccacagacccagguaacaagaccuguacauacuaaugaaaaacaaggaccacccagaaaagaauauuuucaccuguuaguuuuaaguuuuuuaaaucaccaugggcaucguaaaaucgauaauuauagaaauuaucagacuagguuauuccuucuaaauagaagacuuguuaaaagcauuauaaauguccuuuacacuuaacauaccugcuguauuuucuuccaagggucuacauuuuucugagccauccaaauauaguuuuccauuaaguuucuugacagcuguuucgaaaucuucaucuuaaaauacaauugauuaaaagaauuucuaguuaauuuugggggguuuuccuugcuuagggacuaccuccaacuucaccauuucucacucuccacaucugaauugcagccaauuuuauaucuuuaauaccucucuuucugcuagagcuuuagcucagccucucaucuuguuugagcugcucucauuuuaguucaucuuccgaucuccuugucccauaacccaauacuauauaccacuguccaacugauucuauugagacuuuuauuuaacuguccagcuuaaaaacuguuacugcauacaaaguuuuccacuggaaccuuguccgccuucucucucucuuccacaucuuuaagacuccagcaaaauuauaauuauuuuaaauccccucaaaacacgugccuggcacauuagccauccaaaaaaugcuugcuuaaugauugcaguccuuuugaucacuauauccauugaccauuuacacauacauuuaggguaaauaucuaccugcaaggauauuagugauaaguucuaagaggcaggcuuaaaauaauuaaaccauacucccaauuuuacuaagauuagcgggaacagaggauuuuugaaauaacaaaaguuuuaccauccuccucuucuucacuaacauaaucuggucuauucuuguagcagaagaaaguuggaggaaguuuaaguuugguugcaagggcuuucugcucagcgguuggaguuaguucauauacaaugagaacaucaucaucugagggagaaucuucagguuuuuucuucucuuuugcuguaacaccagucaaaaaaauugacaaagauaagguauuaaguauugacguuaauacucuaacugaaaauaaaaaccauggaaccuaucuauagguuaaaacagcauacugauaaaaaacacauauacuuugaugcagagauguaugauaaucaugaacuagaauuagcauccugauuuaguguucuaccaaaaacccuaagugaacacagaaucuauuuaaaaccaaagaaaacaaaaaaaaauuuguguuuacuuaauagucauugaaaagaauuacuauaaauuucuagaauuuauaaagguuaaaaauuuuaaaguguugccuaacuauacuuagcauacaauaguuuaccaaaauauccaugcauuugcagcaauugaaaaaaaucuuaaaacauaggcaaguauuacuauacauaugaaacuaauccaaagccaacugugauuaguuucuguaaggaaaguuaacaauugccaagaauggaaggugacuagaguugcaucuaguuugccuauguucaagcaugauacuaaguaaaauuaaauaacaacugugacucuauagguagcuaacacuauaaaaucuaagaccauucauauggcuaaaaacaacccauccccagccaccaucaaugcaaagggcaaaaaauuagaaagagaaaaaacuucuauaugcaaccuguucugaacuucuggcuaaaggaguuuaauaaagcaagccagucaugaagcaugccauguauaccaacuagugauagggaaacauucugagagcuaugguguccaauaugguagccuagccacauucuauuaaaaccucacaagguggcuaguccaaaucaagacgugcuaacaguaaguguaaacacacacacuggauuuugaagacuuggugaaaaacaauaauguaaaauaucauuaauuuuuauauuaauuagaaguuaaaaugauauuuuggacauaaguuaaaucaaaucuaucaauaaaguuacuuucaucuguuucccuuuuuaacuguuucuuuuuauucuuuuuaauauggcuacuagaaaauuuauuuauuuauuuauuuauuugagaugcagucuugcuuugucacccagagcuggagugcagugaugugaucacaguucacuaaagccuggaacuugugggcucaagugaucccucugccucagccucccaaguaacugggauuauaggcacaagccauugcaccaaaugacaauuuuaaauuacauacacagguuauauuuuauuucuacuggaugacacugcucugcagaaccagugcccuuccuuuuacaauguuaaauuugucccucuccuucauuauaaacaaaaacuuaguaucauuuucuagcuaggagaaauaacaguacaccguaagauacagauucuuguuccacuucugcuauuacucaguaaagacaccuuggguaaaucagauagccucucuuggccucaguuuacucaugucuaaagucuucauuucuaaggucccuugggacaaugacauuaucagauucaaaacaaaauaaggcucuauguucuacaguaguauauaggcacauucauucuuaggucagggauuccuaaccuagagcucacagaaacuguacgcaaguauacauccacuuuuaaguuaacacuuuucacauuucucaaagaccguaucuuuaaaaauaaaagauuaagagcuaccuuagcuaguaauaaaacugguauacuuaaaaaaaaaaaucagagauugcuacuuuaucauuguacuuguuuggcauggcuaagauguguuacuggucacuaagggugagauuucacuucccuaaccuguucuugaaggccuucaacagaucccacuucuuguuccacucuaguagccacacuucuaaaauugaucggugcaacauauauaauaugcaagcuguagaaugcuggcuguuaaaaacgggguccauuuucaaauacaacauuuuucuaaaccaugcacaaaagaacagcccuacagggacacucuuccauauuguauacaugccguugccacuacauuugaauacuggcagacguuaguggcuaaacauaaacauuagauaaaacauaggucuucauugagcagaccugaaauagcagagcaaugaaguacauuacaaaucagcaucccaguacauuuuaaaaaacaaaccaacaagggugucaugccaccagucaaaagguacuuugcuuaaacuggcauucuuuaacaugcauguuguagugguaaguacuucauuucauacagccacaguuauuaauacuuugcuaagggcuacccagcugcuaaaaacugcuguuaucucauacugagaaugcuaguucuauaccuuugcucucaggcugugaggaaggggugcuaguccaaaaggccaugggauuagauuuaaaaaggcuaaaauuaaauccuagaaaauaaagaauauuucguuuuuuaacauuuuaggaaacaaaaugaauaugcuuuuaaaacauaaaaagccagaaucccucaauuuauaccaccaaucugauugucuuacauauucauuuaucccuguaguuucauucuuugcucauuuaauacaugagcaagacugacauacaacauauaaaaugagaacaucucaauaucacguuguuuuuuuuuuuuuggagacaaagucucagucacucagucaggcuggagugcaguggcaugauuucagcucacugcuaccuccaucuccugugcucaagugauccuccugccucagccuccuaaguagcugcuaauuauaggcacgcaccacgacgcccggcucauuuuuguauuuucaguagaaacaggguuucaccaugcuggccaggcuggucucgaacucuugagcucaagugaucugcccaccucaaccucccaaagugcuggcauucuaggagugagccaccgugcccagccucaauaucauguuuucugagugacaaaagaaacugaacaaaugaaaaugaacacuuuaaaaaaagacucacguuaaugugcaugauucaagcaugaguccguauaccguaccgaguucuuuugcucugcccuagcaugauaaaaguaucuuccaguuacugaaaugucuuaaacuaaguucucuugcucuuugaaaccucaccgugaacuuauuaagggagaaaaaaaauugcucaaauauuuuggggguguucacaaagcaucauuuauaucccaacauuaguauccuacaaagagucugcaucaagcuaaacauuaaaagaaagaaaaauugugcuuaacuuuaacaacaaaguacuuacccuuuucugguguuuuaaauguguaguugauugaagauucuuccguuggaaaggaagcaaagagauuuuugacuuugcuaucugaagacuguucgauaucagaguucuuugacaguucacauuuuuuagguuccacuuugcuuucagauccacucugggcuacugaacuaguuucacuauuguuacuuuucaaaggugcauuaaaacuaaauccaaacaaagacccaguggcugaacuguugccgaaugcaaaugguuuugauuuuucacuacuaaaaaugcuuuuaacagacucugaaccaaauacaaacuuuggaggagaaaccacugcuuuugguguuguuucagaugugcuagacacuucaacuucugaaguugcaucugcuacaucaucacccugaauaacaucuguccucucucuugugguuucuucuaauacagcuacagcaauuuugccacauggugacucucugggagugcuugaccgagaaacaugagguguuaucaaagaaucuuuuuccugggcuguuuuugcuucaucaaaaauuuucuuaaacgagucugcaacauccuguaguuuaaaacgaacagcuaaaugcucuacuuuucuuucuccaucugcaaaaucacaugcaguccacaaccauacucuuucugucccuuucauauuuugcaaagucaugucuggaguuauucugugauuggcacaaaguuuuaauacuuggucccuucucaucacuauacgaacuugcuuauuaucauaauucuguaaaaucuuuauaucaccaaugccccuuucuuuccauugaccaacaucuuuaucauaucuguagaguuuugcccugugacuaaaaacaacuuguucauuuuccucaccacuggauacuucaacuagaucagguaaaggaacaacagguucaaaguacuguccaucucucucuucuucuugaguaacaucagauucuucaucagugccaacugaagucccacucugauucaacuuggcaggagacuuagauggacucaaagcagauuuaaaacugaaguuaaauccuguuguugacucaccaaaacggaaaagauuuuuucucacagggcuacuugccaauggagaagcauguacugagcuacuacugacacuaucauccaaagcaucuucccuuaaaucauaguuaucccauucuaaugugggcccaguguuuucaggauuggguuuuauuguugugucugaggcaccggccgcaccuguaccugaacccuuauuuucuuccucagugacuuuuguuugaucauuugucaaaaauguuuugaaaucuuucaguccacucuucauuucuucagcucucuguauuaacuuggcagcucugccaguaucuacaaguuuauggggaguuugaagugguaugucuaacagaagccgcuggcauuccucaaauuucugcuugaauucuucagccagcucugguguuuuaaauuuugcugccaacugcucuaguuuggcaucaccaucagagaaaucacuggcuaaccacauccaugcucuaucugauccagagagaggcuucagguucaucguagucguuauccaaugauuagcacacacuuuuaguacuuguucucuucgcaucagcauucuuaguuugccauugaccucguuuuugagaauuuuuaaguuccccaagccccuuucuuuccacugacuuaccucagcaucaaaucuaaauaguuuuacccgcugugaauacagaacuuuuucaucuucuucuccuguuacaaguucuacuuuuucgggcauuugaacuacugguucaaaauggaugucaucgcuguccucagucuuauaggcaucaucaucuuucucaaagucaccggaaguguuugcuuuauuggccauuuuaccguauugugaugagaauaauuuuucuccagcaccugaaaaucccuugaaauuggggucuuuuuugccaaacugaaauccuucuccugaaguugauuuugcaagaucugcaaauguaaaagugcuacuuguuuggccaaaaaucacaccacggccauucuucuggccacuaauauccugagccuggaagccaguaccauuuucaagaggcuuuucacuuuucuuuucuugauuuccugguuccgaaaugccaaauuuaaauccaucagcagacacagggauggaaaauccuucuuugguugacuuaaauucuguauuagaagaacccugaaacauaaaugaaggugaauuuucuugauccacaugcccaaauuugaauccuugcucuguauugccaaacuuagaagcuuuuucugagaaauuacuuuuaaauccuguucccaccugacuuccagaagagucaugcaacuucauuucugagcccagugugaaagcugaaggagcuucugcaauagguuuaugaguugguuuagaggcaucacaagccacacauuuuaaggaagaacucucauuuuguacacagcaaacacuacaaucccacuguccuuuccugaugaacauuccuucaaauccacucuuuggagccuugcuuaucuccgaagaggcagguguugaaauugcaguuguuugauuuuguuuacuuggacacugacaagcaauacauuugguagcacuggcuucauuucuuacuaagcacacacugcaaucccacuguccuuccuucuuagugaacauucccucaaauccgcucuuuggagccuugcuugucucugaagaggcagguguugaaacugcagaaguaguuugauuuuguuuaccuggauucugacaagcaauacauuugguagcacuggcuucauuucuuacuaagcacacacugcaaucccacugucccuccuucuuagugaacauucccucaaauccgcucuuuggagccuugcuugucucugaagaggcagguguugaaacugcagaaguaguuugauuuuguuuaccuggauucugacaagcaauacauuugguagcacuggcuucauuucuuacuaagcacacacugcaaucccacugucccuccuucuuagugaacauucccucaaauccgcucuuuggagccuugcuugucucugaaguaccaaacuuaaaagaggcaggagcuggaacagaaguagauggacuugguuuauccggauucugacaagcaacacaucuuguagcauuugcuucauuucgcacuaagcaugaacugcaaucccacuguccuuccuucuuagcaaacaugucuucaaauccacuuuuuagaguuuuacuugucucugaaguaccaaacuuaaaagaggcagguguuggaauagaaguagcagguagacucuguuuucucggauucugacaagcagcacauuuuguagagcuccccucauuuuguaccaaacaugcacugcaaucccacuguccuuccuuuguagaaaaaacagaucugaaaucacuguuaauagguuuaggaagaucucccuggccaaauuuaaaugaagcuugaugaacaaaugaagauccacuuuuguuagcagauuuuguauucugacacgcaaugcaccuagauacaguagguucauuucuuacuaaacaaauacuacaaucccagugaccuucuuucuuuggagucaccaaugcaaaucgaucuugaacauucucugggcugguuuuaggaguaaaaacaguuucagcuaauggugggccaacgagcucuuuauugcuuggguuuagauuuuggcaugauacacauuucuuagcaguugaagcauucuuuaaugagcagcuguuacaaugccaccaagacccuucuuucuuugcaaccugaaauucaaaauucagguuuccagcaucagauuugcaaauauccuuguuaucaugacuuguggguucuuuuacaauucugacagccugauuugacgccauggcuacauuuguuccuggggcuuuuaaaaugcucugggcuucuucaaacuugcauuuaaaaagugcugcuuccucaggaguuuugaaccuaauagcaaguuguucugguuuuggcaacucaucugcauaaucaagggcaugccauacaaaagaucugucugauccagcauuuggugucaauuucauaucuggacugauguaaugauuugcacagauuuucaauacuugcucucgucucauuagaaggcgaauuuuaccagauguuuuaugccucaguauuuuuacauugccaaucccacguucuuuccauucuuuggauucuacaucgaaacgaaacaauuucgcgcgguugcaaaagaauucuucuucaucuuccucaccaguuuuuacuucaaucuuaucaggaagagguacuacaggcucaaagugaggaccgucaucaucaucauccccaugggcacuuccuccaucugucucaugauucuuguuugcugucucuaaaguggguguuccaaauacugauuucccuggaccauggaaaguaaacauaucaucacuucgccgaaaaccagaauucuuuugcugacucgaccccauguuuucuguaaaugaaauuccagacacauuuuugcuuccaaaauugaauguauuucgaggcccaaugguuugaccaccaggaauugguuuggcuccacuauagccaucuccuugcaaggguuuaucugaagucaggagaccuaaaaggcuuucacuguuacuguaagcugcaggagggggcugugucacaaccuguggugaggaaaacgugaagucaccaucauuugauuugaaauuugaguuaaauuuaaaaggaguuggcuguguugugugugcuuguguuggcaaagauggccuuaauccuucacccggcaugggcugaacaaaauuaguuuucccaaauucuauagucuuagauucugcagaucuugaagcaugagcugcaaucggagguuuugugaaauauccugguucuggcaaagguggauuugugcuugucuguugaacauuguaauuaaaguaaucaucaccccugggcgauagaauucccguugcaggagacucaaaacgcaaugcaggaggaccauacaucuccugagagaacauacaagcagaugagcuuugcacuggcggugugugcaucuguugcggauaggcauaaauaugcuguugggguggaagccuauucaugccauagacugggcccuaaaagacagaaaguuaaaacauuuuguagauugucuacaaaacuacagauaacuaaaugcaaaccaauucucacaaacuucaaacaugaauaugaagugaagaagaucucauuaggggauguaguacacaucauuaacccguuuaugccagaggcugcaaauuuucugugugaaaaaucagaccuuggcaaugaccuugagcaguaggauauaaauaacucccauaagcuuaguguuccaauaauggagcacuaggcauaaguagguuaagagaaaaccacauuacuacaaagauacuugcauauauacuuggcauauaaugaaaauuauguauagcaucuuaaaaucuacagcuaaagucauaaaauaaauaccuucuucauuccuaauuuaucaaaugauguuaaugaugaugaugaugaugaugaugaugaugguaacauuuauugagcauuuauuaaugugccagcugggcacuguucuaagcacuuuacauuauuaucucauuuuaauauccucaaaaacccuaugaauuaagguauuauuauuauccucauuuuacauaugaggcaacugaugcauugagagguuaagaaacuugccuguggucaaaauaagcagaagagcaagggucuaaaugcaccccaacacucuguccucaaagcugucacauucaacuaccacuguaauauugagucuucaaucaauuguuauauauauagcuguaucaggccugaaaguacuuaccacauagugggucagcaagggcauuacaguucuauuucuguuaaaacagaacgaugaaggauccaccaccaccacucccauuuuuaaaauauucuaaauauucacacuuauuaacacaaaaauaaggugacuaagaaggauaauuucuguauuuggagauaaauuuaaaauaucuacauuuuaagggacauaaaaguuuuaauagugaacugcucucuugaauuuauuugaaggaacccuaaacaauuuaaaaaggaaauaauuauaaauguauaaauuauuccuuuguuaccuuugugggaguaacauuagcugcuggucugagaagauacugggaauuauaugcuggugacugacuauaauauacugaagggccaguaguugcaacuaaaaaaacaaaaagaaaauaaagaaaacacuguuaaagucuauacuacaguuaagacuaucuaggcaagagcuauaaauacaaaggcaauagaaauuaaagaaagauuuaacuacauaaauuuuaaauuucuguacaucaaaauacaccaaucaagauuaucaaaugacaaacuagaaaaaaacugcuaaauaugacaugaagaauaagagaauagcauugcugugaucaacaagaacaacuaccucacaagcauuaaaaaaggaauaaagaagaaaguaacuguugccuuuucuaagaaagaucaguaugauguggaauuauggacauucagucacagaaaggacguaaggaaccaagaugccaucugauggucaaugcauuugaagugggccuagaaaaucugcagaaagacuagguuguauuuuguaaacuaaagcuauuacugagaauguucagcucaaaaaucaccugacaaauucauggacaggaugucauaaauaacauaaaauguguucccuggcuuaaaauaaaaagcacaucaacacucaugcugauguacaaacugucugcucccucuguuuuguguguuuuaccaggaaacaaaaugacuagaaggcacccauguuaauggcaaaacuaccaauagucauuugcuugaacuguuuuaugauaguuuuaccagaaaacaaccaaaagaccuuuuaugccuguacauggaaaaagaaacagaaacugugccaagagguuccaaacaauugccucuggaaagcacugaaaaaucaagaccuagaaaaggcuagccagaagcccaaguuugauuuuggaaaccuuacagaggugaggauagcuauuuugaaauuacuauggggaggaagcaggcacagaacacagaacaaccugacagaaauggcccaagaaucuuaaagucuugcaagaugucugucugcaugaaagcaaaaagaaaaaauaaaauauuaaauaaaaaaaaaaucuuagucugaaguuuaaguagggacuuuaauugacuacugacucuaaacugugcggcucuaauaaaucuacuaaaaguaaucuaacuuuuaaaagcaccauaugaauagacaauuuaggaaagaaauguuaauaggccucaaggaacauguuuuugaagugagccuugaaaaauccgcaaaaugaugagguugcauugggcaaacugaagcuauuaugagaauguucaggucaaaaaaauuaccugacaaauucaugcaaaggagaucacaaggaacacaaauguguucgcgggcuuuaaaaaaaucacauuaacauucauguugauauacaaacucuucuccaucuguuuugugugaguuuuaccaagaaaccaaacaacugggagguacccacguugaagauggcaaaacuaccaacugccauuugcaugaauuguugaccaugacuaguauuaaaaaaacuuaaaaauugauaucacuuuuguuccuacaaauuggcaaaggauuuuauaaaccaguaagucagcauuagcaaagugcgaaaauggcacuaucagauacuagugguaagagcauaaacugaauauucugaauacccuauaaaacuaggacaguguccuagaauuuguaauggcauaaaccagaaacaacauaaauaaaggaacagaauuuacaguacuuccaugugaugggauaccaugaacucauuaauguucaaaaaacauuuaaguuuaaaaaugcucagaacuaaaguaacauuuaaaaaacaggcuagcucaucuacacacaacauaguaacaugguaacaaucucauaaaaaauacuauauguauagagaaagaacuagaaggaaaugcucucaaauauaggaaauguuaauaaggugguuagcuuuuaguuuucuucacccuguucaguacuucugaguaucuccuaugagcucauuaaucuuuaauuuuaaucaucuuauuuuuaaaaaacaaggaccaucuugauauauguuuacuuuuauuaaggaaaaagaaucuaugaacacaggaacagaaaucaggagaucuuggcucucgcccuuucagugccacaaagcuguuuugugaaccuguaaauaauccauuuggagucuccauguuucucaauuguaaaaugaggaugugcugcuucuacacauuucacagggucauugcaagaauaaaaugagacaaugagaauguuggauuuacaugcuuguauaagaacagaagaucuuuuaugccuguacacagaagaaauggaaaucaugacccacaaggcaccaaauaacugacugcacacaucacuaaaaaagccccaggaaaggcuagccgguuuguuuauccucuuacaaggaccuauaugauguguaagguuuuaagaaaacaagguuugaacguuagacauuucauauacuuaucuaugacuuaugacauuuaauaagcuugauuucacaaagauuuucuguuauuuugcuuguguugagaagauacuaucacaaaaggcuagugggguugccuuaacuauaugaaccaucacacaaaugugcucaucuaaacuagauuuuauucuaaaucuuuccugggcuaaaaagagaaaaaaaaagggcacuacuacuacuaccauuucagaagucugucguacguaaaaggaacaauuuuguuauuucucgcugccugggagcaauguauuauacuggcaagugcuuuggaguuacaccaccggagugugaaucucagcucuaucaauaacuagcuguauaauaaugaguaaguuaccuaaccuuucuuuaauuuccuuauuuauaaaaaagggauuaauaaugguaccggccauucuaaguuacuguaauuaaauaaaauuacauucacaaagcacuuuugcacauagccaacccacaguaaacacuauuaguaaccuuaguucauuaacuguuuacuguauacucuaauaaaugucugauacacacccacgcccaccugcacauacacaaaugcucauaguaauuauguaaggcaaguauuaucuccacguuucagacagguuaucuuacacagcuauuauaguaagugauagagcagaacuuaaaaacccaguaugauucagguccaaacuccuuuucuuucuuuauauaaccauaauauuucaaauuaaguaagauuuccuauauaacguccugccucucaucauuaucaucaaaauaauuccccagagguguagguucuuaauuaagcauuucuuagugcauaacucuauucauuaacauuuuucaauuuaaggaauaaucucaucucagcucaucugagguguggauuaaguguucuuuaagccuuuauauacacgugaucacauacggcucguuuuuucugcuugggauuauaaaaaucuccguaacaccaaauacagcuuuugaagucacauauaaacagacguugacauguauauuaacaaacauauauaaacaaggugauuucacacguuaucuacuuaaaagagggaaguaaaguaguuuuacuaaaauaugcgauuauccacuugccagcucaccuguuaguggagccccaugaaaugucugugaccccugauauccaucaggcacugagucugguccauaauucucugugggccaacgaugaggggaugcugaguuacugcuauuuaguuucaacuccugcauuucuuucuauuggaagaaaaaaaaaucaaauaauuuuaaacauuuaauuauaucaugacagaaacagugcuggggaaacuuacucuuuuaaauuuaaauaacugauuuuuuuuuuuuuuuuugagauggugucucgaucugucguccaggcuggagugcaauggcacaaucuuggcucaccgcaaccuccaccuccugggcucaagcaauucucccacuucagcgcccugaguagcucggauuacaggcgucagccagcacgccuggcuaauuuuuuguguaauaguagagaugggguuucaccauguuugccaggcuagucuugaacuccugaccucaagugacccaccaccucagccucccaaagugcugggauuauaggugugacccaccacgcccggaccugauuauaucuuuugaaaguuucuauuugccagugaguucuagguaccuggugcugauuuuaaaauaugauucuuaauuuguuaaaaauuuaucugcucccauuuucauuuauuaauacaaaaccuaauuuauuaacucucaccuaaacaaauaaccuccuaaaugaucacaccuucauuuccauucuacacuugccuacauuaaccuuucugacguucaccuccagccaagacaauucccugcucaaaaaaacaaguaucuacaaacuaaacuucuuuccucaacuuucacaguccucuaacauuacacugaccauccuuucaguguguucuuucugcacugcaaucuggacuaccugacauuccgcguuaccuccccaaauuagcuuuucacuuaaccccaugcugaaacaaaauacaacuaauucucaaggugauguucaaaugcuccaccaggaaagggaaaaaaguaguagcugcagagaauuuauuauguauauaauaauacguccaaugcacuuaaacucuuaauuuuuauacuaucuacacuguuagguaaacaauauuagcuccuaucuuaaaaugagagaaacggaugcagggaauaacagcuggaauuugaaccagaucugacuccaaaaauguuuucuuaacacaacucugcugccuugacaagauggcagauagauacaaugccgucuaguguagcuauguggcuaccucaucucugcugaagaaaacuaaaugacagcaccauacccaacccuagaaccuacaaaauguccccuuacaaaacagacacuuaacaggaaauucuuuuuccaaagaaauuguagugguaucagaaaacagguaaauuuugaaaaguuucaaacuucucuguaucagcccaggaauccgaccaguucuaacaagugaggucagggacagaucuagcaugucugcuuucuuuuucuacaaguguuucaauuaaaaauuucccagaaagaccuaaccaugagguccaaaacuaucucaauuuucaagcuaaauaaaauuucccccacucauccaucuacagugccuaguccagaugcuacacauacacauccaauaagaaacuaguggaaucaccuagaaaacuuuauggucacuguugguauccgcaccagagcuuugaauuugcaaucacugcuguaacuguaauuuuuaacauucagugugaugagaacuggcuucaguaauucucucauuuuaaagauaagaagccaaacagucacaauggaagugacuggcccaagaucauuaauuaauggcagagucaguacuaguaccaagcuuuucaagcucauggauuagugcuccacgauacuuccacagaauacaauguugggagccugaaaccuguauguuaagucaaaauuguauguaauugucauaggccaugacuacacagaauuaacauucaaaauuuuugugcaaauucaaaaaugucuuccccaccacacaguauucucuuaaguugcaaauacugcugaucacacuguaauaaucgccacacaucagcauauccuugauguaaccuuagcaguaugaguaauuuaguucuugccugauaaacaugaaagaaccuacuuuuauuuccaauuccaaaaaagucaagcuccuuugaacccuauuguuaaaauaagauauauauacauaacuauuuccuuacauaaugaagucaaauucauauggaaguauuaaaauauaguaagacuuuuugaagcucagaccacuuuucaauuccuagcuauacauuugaaacacauguaauccacagcuaaucugggaaugaacucauagaccagaguaugauuaguacaugguagcaguucaaucacucaggaaccuucucugugccacgaacucuuauauuuuaaauaaaacaguuucuaccuuugaaggucucaaauuuuguggaagaugaagagagagacacauaaaguacuuucaaaaauacgguaaagggcugggcucggggguuuacaccuguaaucccagcacuuugggaggccaaggcgggcagaucaccugaggucagaaguucaaaaacagcuuggccaacauggugaaacucugugucuacuaaacauacaaaaauuagcugggccugguggcgggugccuguaaucccagcuacucaggaggcugaggcaggagagucgcuugaaccugggagguggagguugcagugagccaagaucgcaccacugcacuccagacugggcaacagagugagacuccaucucaaaacaaaacaaaacaaaauaugguaaagggucaagaccgagguauguaggcugggcacaguggcucacaccugcaaucccagcacuuugggaggcugaagcaggaggauucuuugagccaggaguucaaggccacccugggcaacauggcaaaaucccaucucuauaaaaaauacaacaauuagcugggccugguggcgugugacugucuguaguccuggcuucguggcaggcugagccaagagccucucuugagcuaggaggucgaagccacaguaagcugugaucauaccacuguacuccagccugcacaacagaacaagacccugucuuaaaaaaaaaaaaaaagaccaaaauguccccuugccauacuauuuggauggcaaggggacauucugaccagcuucagaaaaaaagugagagaguggccagggaaggaaucuuggaauaaaaaguacagcuagagaaauuaagugacuuaccuuaauggccucuacuuguuggcaaaucauuuucaguaaagaauucugaucuucugcccaucgaggugguguuuugggagaauacuaaaaaaaaauaaaaauaacaaaacagcauuuaaaacacuuagaacagaaacaauuucacaaugaaaugauuccauucuuuccuguuuaccuuguaacuuuuacuuggugauagugaauaucugguaggagacgguguagaauguuuuauuucugaaucugcauuucgcaaagaaccauuuuuauagagaggaccuccuucacuauagucuucgaguuccugcaugacugaauuaagcaucucuuuuacagacuccaggggcacaggcaacuaaaaauaaaagacauuaauuaagggcuuucauuugcaaaaaauuccaaaaguaaaaacucuaaaaugauauauuuuaucuuauuuacauuuuugccacuuuaauaggcacuuuacacuuuaaauaauacacgugaaaguguuuuuuaauuaucuuuuuucuuuuucuguuguuuuguauuauuauuauuuuuugccuuuauuauauuuuuuucuucaugaacacagaaaaguguuguacaaucuaacaucuucugauucuaaaguccaugcucuuucuauuacuucuguuaaccaugauaauuguagaggaauguuaacuuggaaagcuuuuccaagugaacaaaauaaguuacugauguuuucuaacugauuuucaauggugacagaaauacagaugcuacaauacaccagacaacauaaauccuaauaaaagaguaguaacacaaauuaaucaacaaaacacucagaagacugaacauaauuuaacaucaucaugacaaucucaaacagcugacagcaagaaaacaagggcguucacaauggcugaugaggaugagaagaaaugcucuuaaguugucagcaacaacuuucaauuucagcaaaguucauuaagaauuaguccugagguuauaauauuuguuuugauuacacugcuaagauaacaaaaucaaugucuuaucuuagaaaucuuuucuaauuccccaagaaguacuuuuuaagagcauauaccuagauucccaaguuuaaaaagacacaccaaaccuaagacaaagcaagcaaauauaagcauuuagacacacauaucccuucugugcauuaauaacaacauauuacugaguauuuuugaaauuaccaaaauauaagaccaacgcaaaaacauugaccaguggguuaucaguaagaacguacauacaacaaccugcuacuuacuuucuugaccacugaaagauuugaaucacugucaucuauaaucuuuauuagguagucccuggucuuucucagauaauuuuugcauucuucuuguucuucaggagaaagggcaucauuuucaaugucuucugccuuccugugaaaaaucuauacaaauagugcuuuuaugaaaucauuagguuuuuaaaacaaaaaacuuuuagcuuggccacgcaugguggcucaugccuguaaucccagcuacucgggagcugaggcacaagaaucgcuugagccugggaagcagagguugcagugagccaagauugugccacugcacucuagcccgaccaacagagaaaccccgucuuuuaaaaaaauaauaaauaaauaaauaaaacuuuuagcucaaguacugcaucuacuuaccagugcaagauuccaauaagaaacaacacuuuuuauagauucaaaagcagucacagcaucuucuauauuuccauuuacugcauccaauauagcaaaaguuaugugugcgucuucuucauauucaacaauuucugaugccuaaacacacagaauaguuuuuagucaaauuguuuauacucagaauauaaaacccaaaugauuuuccaaagauuuuauaugaucuuaagagacaaacaucucauuauucuucucugucauaucuuaugugugagagcuagugaauuuagaaaacaagauuaccauuaaauaacaaggcaauuaauuuaagcaguguauagcucuaugucuuuguuuauaaacuggaaauucccaucuccaauaaauucauaaaggaacucuguuaccugaaugucuacacuaugaaaauguuuaaacagaggaucaauagguucaggaauacuguucuucuuuuuuauuaucuucaacaauggcaaaacuuucuuccaauaaugaacacuucucccuauguauucucguugaucauaaaaagaauuaagaccgcugcccuaaaaaagaaaguuaaaagcacacaacuuuaaggaacacgcaugauuagaucuaaaguucauuuacaaguugaaagaacuggcuaaaauuucaagucaaaaccaaaugguaucucaauagucauuuguucaacuuccaaauacuguaauaacuaaaccaccuuaacaccagugaucauucuacacucaacuuuuuuuuuuuuuugagacagagucuugcucuguagcccaggcuggagugcaguggcgugaucucggcucacugcaagcuccgccuccuggguucacaccauucucuugccucagccucccaaguagcugggacuacagaugccugccaccacgcccggcuaauuuuuucuuuuuuuuuuuuuuuuuuuguauuuuuaguagagacgggguuucaccguguuagccaggaaugaucucgaucuccugaccuugugaucugcccgccucggccuccuaacgugcugggauuacaggugugagccaccgcacccggccucuacacucaacuuuuaaacgcuucuaaugauaccauccuaacguagcaauccaaacuacuuuuuaacaguugccauuuuuagauagcugaaaccugccucuucuguagugucaguuuguucaaaaggcugaccaucuacaccucauggugacacaaaacacaccuuaaguauauagaaagaucuauaauggucuuaccuacaaagccuugugcuaauuuuuuuuuuuaauuuucaggcugaauaauuaucagaacuuaauuauuaaggaauaacaguaacagcucagcuaauauguaacauucacugugugccaggcauugcuccucuaagugcuuauauuuaacuacauuaacuauuuugcagcaauaaaaaacacaucugucauaaugugaccaagcugcuguuuucagaacaaaaaaacuuucaauaaaaaguucaugauuuuaaaaaauuaagguaauguucuuuaaaaaugcuuauacuuuaaaacucaccguuuucugaaggcauucugcccaauguacaagcagagcagguugaaggccauguuuuuccugggcucuuagaguguuuauuucaugcugaacuagaagucucaauuuugcuacguuuccaggucuaaaaaauaguucaauuuacuaaaauugcuuucuaaauacacaguucagggcuuacauacauauauguuaaugggucacaugacaaauuaaaucuucacaugaggauuaaauccccgguaaaaccuacgcacuaagugaaagcaauauuuuuguuuuacuacuuacacugcuuuucugugaaucagaguacaaaccgcaucccaccaagauuuuugucuuucuguacaaagcuguuuacacacaggaaggggcaggcauaacggcugauaggagcuguggugagaauuacauuucuccuuuaauuguaaguggcugguauauacuacuccaaggagaaauaccuguuuuauuuaaggaaaaguuaaguuagaaaaaaaauuaaacaaaauucagaauauuuaauuuguuaaaaucuuugcuuacuucaagaucuaaaauacauauugauucaggugcauuuguuucaagccuugagguuucauggggcaaaugauggaaaagcuguuuuagccauuuucggauuccagguaaagcaggcaaugaauuccacuguaagccaagccaaguaaggugcugaagacuaccauuaugugcucgaauagcaccugaaauaaaauuaaaaaauuggcuuaaggguuugaaauuuuuccuugugccauuaguuuugccaacauaaacaauucacauuauauauaucuuaauuauauaacugcuuuucuauaucaaagcugaagggaauucuauguuaggcaaaaucucauguucuuauuaaaugcauucucacuugauuauuucuagaaauuuuaauaaaaauaguagugaugaagaauguuuaaguccaucuuaaaaaaugacacugacuagaacucaauaaaccaaaaucaacugacaaaagccaaauaaagaacaccuaaccuaauaagaaaccccaaaacgauggguuuuccuuuaagucauuaaagcaauggaacaccacuauauuaauccaucgguacaguaaagaaaucuguuuuucuacaagaaagucaauauugaaaagguucugcgcagucaggaguucgagaccagccuggccagcauggugaaacuccgucucuacuaaaaacacaaaaaauuagccgagcauggugucacgugccuauagucccagcuacuugggaggcugaggcaagacaauugcuugaaccuggcaggcggaaguugcagugagccgagauugcgccacugcacuccagccugggugacagagcgagacucugucucaaagaaaagaaaagaaaagaaaagaaaagaaaagaaaagaaaagaaaagguuaugugcuucuggaagcauaaagagguauaaucuuucugucauuuuggcaauuugcaagacuuaaagauguucauggccuuugucucuaauucuguuuuuagguaucucuauggaaauaacuugcaaugaagacacuuuuuguugaaguuuuuaucagaguaugauuauuaacaguggaaaaguugagaaaacuuggaugcccaauaacagaaaguagcaagcaaauuaugacuacuucauaaaaaagauuauauugccaauaaaagugauauuuauaguuuuaauacagagacugugggagagaauucaugaaggaagcaagauaaaucauacauaaacaaccauuuagaugaaaaauauggccagaugcaguggcucaugccuauaauuccaacacuuuuuguuuuugagacgaagucucgcucugucgcccaggcugucgugcagcagugugaucuuggcucacugcaaccuccgccucccggguugaagcgauuccccugccucagccuccugaguaggacuacaggcacaugccaccacccccggauaauuuuuguauuuuuaguagagacgggguuucaccauguuggccaggauggucucgaacuccugaucucaggugaucugccugccucggccucccaaagugcugggauuacagauaugagccacugugccaggccuaaucccaacacuuugggggcuuagguaggaggaucacuugagccuaggaguucaagacuagccugggcaacaaagggagacccugucucuaccaauuaaaaaaaaaaauuaucugggccgaguggcaugugccuaugguaccagcuacucaggaggcugaggcaagagaaucccuugagcccagaaguucaagguaucagugaccuacgaucaugccacuacacuccagcccaggugacacagcgagacccugucucaaaauacaacaaggcuggucgcaguggcucacaccuguaaucccagcacuuugggaggccaaggcagguggaucaccugaggucaggaguuugagaccagccugaccaacaugaugaaaccccgucucuacuaaaaauacaaaaaauuagccgggcgugauggcgggcauuuguaaucccgcuacuugggagacugaggcagcagaaucacuugaaccugggaggcagagguuacagugagccgagaucgcaccacugcacuccagcaugggcgacaagagcaaaacuuggucuuaaaaacaacaacaacaacaaaaaauacaugccacccccacagcaccacauucaaacuccccccagcccaacccacacacaaaaggaauacaggaaaauauuaagucguuauuucuggguaauaagauuaugggcaauuuauaagaauuaagacggagaccauuuccucugaaacauauaacuuaccaacaucguaucuagucaaaucuucaagcucugguucucguacaucaauguuuccaauaucaucgcuaccaagaaaagauguauccuuaggugacugacuagaaaacagagcaucauauaaugcagacugcccgcuuuuguuggcaaaaguuucaacaaucucuuuuaaaaaaucuugcuugccacgacuuaaguuuagcaacaugugcccugaaaaaaaaauuuaaguuauuuccaucacuuuaaaauuacagauuguauuugcucacguugucucauuuguauacccaaaggggaaauaacaugauuacugcauaccuaacccuccaacccaaaaaauacagcuggacaacaaaaccggugcuuauguagcaaaugagaagaguacagguuuaauauucucaguaucuacauaagacagcagaagggggaaaaaagacaggaauguguaugaaaaaugccaaacauauuugcauuucagaugaaaaggucuggauuuaaguggccauaggagaacagggacaaacucuuauucucugaucugauacacugauuucugaaccuggcugaucagaauccuccuuuaaacagcuuuuaagaauuauuuccggcugggcacgguggcucaugccuguaaucccagcacuuugggaggccaagcuggguggauaaugaggucaggagaucaagaccauccuggcuaacacagugaaacuccaucucuacuaaaaauacaaaaaaaaaaaaaaaaaaaauuagccggcccugguggcuggcgccuguagucccagcuacuggggaggcugagggaggagaauggcaugaacccaggagguggagcuugcagugagccgagaucacgccacugcacuccagcccgggcgacagaguaagacucugucucaggaaaaaaaaaaaaaagaauuauuuccaggccucguucccagaguuuuuuauuccauagguuuacaguaagcaaucaaaaaaucauagucucggauaaaguacugauacaugcuauaacacagaugaaccuugaaaaccuugcuaaaugaaagaagccagucacaaaagaccacauacuauaugauuccauuuaugugaaauguucagaagaggcaaaccuacagagacagauuagcaguugccaaggcugagagguuuggguaaaaugggaaguaacugcuaauagguaaggaauuccucauggagugaugaaaaucuucuaaaacugacuguggugacagugguaauacucuaugaacauacuaaaagccacugaaccguacacuuuaaaugggugaagcguaugguauaugaauuauauuucaauugaacuuuuuuuaaaaacccuccuucgaguuaauucugcugggcaauuagguuugguuaccacuacacaguugugucucagcacacuuacagaggcacccucgggaugcccagaucaaagacauuaaaaaaaauacaggcaauuuuuaucuaacugugacaccacgcaaaggcacuuaugagagcccugcaaggguagaaggaaaagagaaaaggaaaaaaguagaaagucacuuuaaggacugaaagccuaacucccacaaaaaaaagugagcuauggaauaaaagagcaaugugagcucuggccaacagccuaacuauacaccaaagcuuauaauaacuuugauuuaauauuacaucuugcucuuuacaaaauucauccaauuuuauaucaaaacugcuccuuauagaaagcauuauguuucuucaguucacugcuugauucaauggccaccuaacuaccuuaaaguuuguaucuuagcaaaaucacagguaauacgcaacagaccuuuaggauuuaucccaagccaaaaaugggggaaaaaauccacaaauuccaagagccuaauauaagguaaguauauaucuucuaucuuccucccuacgcucucagcucuuuaagacagauccguaucuucuucaucuuuauauccccacagcaguguuuuuagaaucagcugguguuaaaugguuggcaaaccaauaauuauacuuaguucaggaagugacuaaauauucaggauagaggcucuagcagccagauaaagaaagaguuaagaaauccucuccaccuaggaacaaacaauaucaaauauucauuuuuuuaaagaaugugcuauuuuucacaucucuuccauaccuauugcucuuaacugauacggcaaaaagaaauaauuuugacaaauuaucuccuggacagaugaagauuuuaucauaagauaugccuuaacagaaauuccuuuuucuuuuuaaauuaaauuaguuuaauauuacuauuaccugauuggcucagucggucacaggccaucauuuccagcagauuuuguccagcuucaccuuuuauuaauuuaaucuuuggucuuggaaccuaauaauuuuagaaucaaaaaucuuaauuugaugauacccauacuucuaauaguaacauggucuuaucuauuacacuguacuuuuuuugauaaugaauaaacaguuaaccauuaauuaaacugaauuggaaaagacugcaaaaacugggaaccaaggaauuuauauaaccuaugaaagauaggccagguacaggcgugguggcucacaccuguaaucccaacacucugggaggccaaggugggcugaucacuugaggucaggaguucgagaccagccuggccaacauggugaaacccagucucuacuaaaaauaauaaaaaaaaaacaaagagccaggcgugguggcacacaccuauuaauuccagcuacauggaaggcugaggcacaaggauaguuugaaccugggaggcagagguuguagugggcugagacugcgccauugcacuccagccugggugaaagagcgaggcuccaucgcaaaaaaaaaaaaaaaaaaaaaagggccagacaugguggcucacaccuguaaucccagcacuuuggaaggccaagguggggggaucgcuugagcccagaguucaagaacagccugaacaacacggugagacccuaucucuaaaaaauguuuuuuuuaauuagccaggcaugguggcccacaccuguggucccagcuacucaggaggcugaggcaggaggaucacuuaaauccaggaggucaaggcugcagugagccaugaucaugccacugugcuccagcuugggcgacagagugagacccuaucuccaaaaaaagaaaaaaaaaaaaaagcauacacagagcaacucugagaaauuaguuucuacuaaaagcacauucauguuacauucagagaaauggaaaauuuaauuacauuacuuuucgacccugcauaaauaggacaacagcagauguuguccuauuugaguagauaugacacccuacuuuaaaaaguacaggugaaaugacacuuggaaaugccacauuguagauaacacauuuucagaguauggauaauaugggauagcacuggaauaaaugggacaaccaggaaauuaaagagauccucaugcaauaaccuaugaaaaaaaaaaagcaugaugaauagaauggcaaagggaagacgugacagcugccuucaaauauuaaaauuauuuuauaaaagaaaucaucaaaagaagaaacaagaccaacagguagaaggcuugaagaauauuuuuauucuauauaaggaaguaccaagagccaaaccaccuaaagaugcacugggcuaucuugaaaaguaaugaauguccaucacugaaaacguccagucauaggcaaugcccacuuacuagaaacaugccaaaaguaacuauaugggugacuagagcaucggcuuuuaauucuaucaccacuuucuuaauuggugguggaaauguaauuugauacaaccucuuuaggguuagauauuuggcaacagcucuaaaaauuauaaaugcacagauauacuuugauacugcaauucuuucaggaauucauggcacaaguuaaucauugcuaaauuacuugaaguagcauuaaaaaaaaaaaaaaguaaaagccagcuaauguccugguuuuaggacccugguuuuaaaaacuccaaaacuacaguacauccauacaauggaauaauaugcaagcauccaaacuaaugagaaugcccuuuauauauacugacauggaaacaucuccaagauacaguuaauggaaauaaaguaaaugcaauguucaaauguuuuccuccuucuuuuaaagacaggagauauauauguguuuacuuggagaugcauaaaacauuuccugaagaacacacaagaaagcaauaacauuaguuucuuuggagguggagaaaguaaauaacuagggaacagaaaggagucuucauagcauauucuuaagagccgccagaauuuuaaaccauguauauauaauucuuuccaaacauguucauuuuucaaaauauaugauuuaugaaccuaaaagcuucugauuuugaauuuuagaaauauucauauugccuauccuuuuacucacaaguuuucuaaacaucaugucaaagcccuuugucaucuauauguugaaaagagcacacaaaauaagaaacaaaauguugacaucauucuuuuuguuuugaaacugaccucaauucauaaacccggccucuuuuacaaaauuauucaacaguugaaucugugaccaguuaauuaguugugaauccacucaaucaaaucaucucaauucacuauuuccuuuuuuuuuuuuugagauggagucucgcucugucgccaggcugcagugcugcaguggcacgauuucagcucacugcaaccuccgccuccugguuucaagcaauucuccugucucggccucucaaguagcugggauuacaggcacccgccaccaugcguggcuaauuuuuguauuuuuaguagagaugggguuugaccauguuggucaggauggucucaaacuccugaccucaagugauccgcccgccucagccucccaaagugcuaagaucauaggcgugagccaccgugccuggcuauuuccucaucuuaacuaaaagguuucaagauacuuuguuaacuaccuagcugcaaugcagaugcacuuacuagaaccacaguauuccucugauuaagagucugaaaaucuugccauaaaaguuagccaauucuuaaauacccaaaugccagcacauaaccuacauuuuaugcuuauaaucauuugaucauuaagcuuuaaaauaaacugauaaaauaaaauacaagcaucuaagauguuucuauuauauauucauucuacagaaauaugugguaguuaauaaagacugaaguagguaucucugugcugaaguggaacaaugaagaaacauuuagaaaagcaaggcaucuggcaauagguaaagcacacccacauugaggcacaauauuuuuuaaaagcagagaaagaauguauugcacauuugcauaugcaaaaaauauuucugaacacccaagaaacuccuaacaguaguugucaucuaggaaaggagaccugagugaauggauuaagagggaaacuaacuuuuuauuauuaaaaguucacagucaggugugguggcucauaccuguaaucccagcacuuugggagggcaaggcagaaggaucacuugaagccaggaguucaagacuaaccagccugggaaacauagcaagaccuugucuuuacaaaaaauuuaacaauguagccaggcaugguggcaggcaccuguagucccagcuacugagcugaggcugaagcaggagaggaucacuugagcccaggaguucgaggaugcagugagcuaugaucaugccacugcacuccagccagagcaacaagagacucugccucccaaaacuacauaucaaaaaauuuuaggcugugcauaguagcucacaccuacaaucccagcacucugggaagcuugagcccaguucaacguuacagugagcuaugauuaugcaacugcacuccagcccgggugacacagcaagacucuaauagacacacagacagauaaauuuuaaaguuuccauuaaaaauaagaacuauuggcagggcgcgguggcucacgccuauaaugccagcacuuugggaggccaaggugggcggaucaugaggucaggagaucgagaccauccuggcuaacauggugaaaccccaucucuacugaaaauacaaaaaaauuagcugggcgugguggugggugccuguagucccagcuacucgggaggcugaggcaggagaauggcgugaacccaggagguggagcuugcagugagccgaggucgugccacugugcuccagccugggcaacagagugagacuccgucucaaaaaaaauaaauaaaaauaagaacuaucaguuacuugagaauuucuauaagaaccuuuuaauguugguauuaccuagugaaccucacuaaauccauuaauuuucacuaauccaauuccuuaugaacacagaaguuucuacugagcaaauauuagcacuuaacaugugaacugucuaucaacgguguuuuuaaaagauuuacaggccgggcucgguggcuuaugccuguaaucccagcacuuugagaggccaagucggguggaucgcgaggucagaagaucgagaccauccuggcuaacauggugaaaccccgucucuauuaaaaaauacaaaaaauuagccaggcaugguggugugugccuguaaucccagauacgugacaggcugaagcaggagaaucacuugaacccaggaggcacagguugcagugagcugagauugcgccacugcacuccagccuggugacagagcgagacuccgucucaaauaaaaauaaaaagauuuauauuaggcagggcaugguggcucacugccuguaaucccagcacuuggagaggcugaggcgcgaagaucaccugaggucaggaguucgagaucagccugaccaacauggagaaaccccgucucuacuaaaaauacaaaauuagacgggcgugguggcgcaugccuguaaucccagcuacucgggaggcugaagcaggacaaucgcuugaacccgggaaggcagagguugcagugagccagaucgcgccacugcacuccagccugggcaacaagagcaaaaccccgucucaaaaagaaaaaaagauuuauauuagaaggaggcgccuucucuaaaaguaaugaauccuuuuuuucccuccccaagcaaaaaauccuucucuaaaauuaacaaucauuuuucuaagcgugguuuaaugcuuuuuuggaagacuacuuauuucuuuuccuuucaaaaguuaugcaagcucauuaaaaaaaaaaaaaaaaaaaaaggcugggugugguggcucacgccuguaaucccagcacuuugggaggccgaggcagguggaugacuaggucaggagauugagaccauccuggcuaacacagugaaaccccgucucuuauacuaaaaguacaaaaaaaaaauuagcugggcaugcuggcaggugccuguagucccagcuacucgggaggcugaggcaggaaaauggcgugaacucgggagguggagcuugcagggagccgagaucgugccacugcacuccagacugggcgacagagcaagauuccaucucaaaaaaaaaaaaaaaaaaaaaaaaaaaaggccaggcgcaguggcuugcgccuguaaucccagcacuuugggagaccaaggcaggcagaucacgaggucaagagauggcgaccauccuggccaacauggugaaacgccaucucuauuaaaaauacaaaaaauuagcugggugugguagcacgggccuguagucccagcuacucgggagacugaggcaggagaaucacuugaacccaggagguggaggcugcagugagccgagaucacgccacugcacuccagccuggugacagagagacuuggucucaaaaaaaauaaaaaaauaaaaauuaagaaaagguuuuauguuuucaaagauuaauagauauacuguuacauauacacaauacagucauaaauguuauauacauguguuucaauuaacauguuaaauugcaaucauauucuucuaucauaggcuauaaagccauugcccuacaucuacuuauuaagauuuuguccaaguaacacaucuuucugaaucaagcuuuacccauaauacgagauuacaucuuuaucauguucccaaaaauggcagaguaaaaagaucaaacucuucaaauuugucuacaaacaaaucauggcaaugcaggcuuucaacaagagugcauucaacaucccuguuucaccagccucaccaguauuguguaugcuuaguuauuuuccacuguaucaaauugacuauuucaacuuuaauuccacagguuuguucacauauugucauuacauaccagagcacaccuucauuucaaacacaucaagacucagugaaaugucaauugcuccuacaaguggaagacuuaccugaaaugcuaugagauagcacaaugcagccagcucagaaagagcucgccauugaacauuacuacuaugcugacccaucuucaaaagcagagaaccagcaugcauguagaaauguccuuucauuucuaagaaaguagcugacaguucaucauuuccacccaaagauuucacagacugaagagcacuaucaaaacuguaauaugaaaauaucaaacagauaauacacacuuacugcacugugaauaaucaugguuuauuuaauucaaaacaaaauaaaaauuuuauuucaagcuucaucuuccacauucaacuaauaauucuuauuccccauguuauaaauuaugaaucaucuaaugcuuuuuuuuauccugcauacuuccuauacuucaugcuuaaccucucaaaugauauucccaguuauuuccagcccuccaaucacaggauaaauauaagaucagugauuauaggugcacauuucaaaauaaaccaggauaaaguugggagacuauuuuguaguuucuuccugaucauauaauuucauuauuuaauuaacaguuguaauuucucaaauuagacauaccauuuccaaauuauaaguaaauaacugacagguauuugcguaucaauacaguaauugcucuuuuuacuauauagaucauuacagcguuuaaaauagucugccuuuuuuuuuuuugagacggagucucucacuaucgccugggcuggagugcaauggcacgaucuaagcucacugcaaccuccaccucccagguucaagugauucuccugacucagccuucugaguagcugggauuacaggcaccugccaccaugccccgcuaaacuuuuuuuauauuucuaguagagacaggguuucacuacguuggccaggcuggucuucaacuccugaccucacaauccacccaccucaguuuaccaaugugcugggauuacaggcaugagccacuacgccuggccuauuauuuguaaucuauauucuaaauuaguucuucuaaauccuauuguuucuccaaauccucacuuuggaagaaaaguaaaagcaaaaagcaaacacuuaaacgugaagcaugauuuuaaaguggcuuacaauaaagcaaccagagcaagugaggucuaaagaucucugagggugcucaaaaaccccuucaggggauccaugaaguuaaaauuacuuuuacgauaauaccaaaaaaaaauuuauauuuuacauacucauuuucucauguauguagagcugaguuuuuuuguuuuuguuuuuggagacagaaucucacucugucacaaggcuggagugcaguggcacaaucuuggcuuacugcaaccucugacucccagguucaagcgauucuucugccucagccucccgagcagcugggacuguaagugcgugccaacauacccggcuaauuuuuuguauuuuuaguagagacaagguuucaccauuguuagcugggauggucucgaucuccugacuucgugauccacccgccucggccucccaaagugcugggauuacagggcugagccaccgcgccccgcugagcugaguuuucuagaggcuucaugacauguaauaguuuuacagacugaaagaggaaguaaaugagaaucuagcuauguucuauuaagcgagacauuaaaaagauucacaaaaaugcaaaagcaaugacacuuucugacuacuuuuuugcuguugaaaaauaauuauuuuucauaaaaaaugcuauuauuggcccugugcgguggcucacacaaguaauuccagcucuuugggaggccaaggcggguggaucaccugaggucaggaguucaagaccagccuugccaacauggugaaaccccuucucuacuaaaaauacaaaaaauuagccaggcguggugguaggcaccuguaauuccagguacuugggaggcugaggcaggagaauugcuugaaccugggaagcagagguugcagugauccaagaucacacuguugcacucuagccugggcaacaagagcaaaacuccgucucaaaaaaaaaaaaaaaaagcuauuauuauuaacacacaauagagcuucuuacauuuuuaauggauuacauuuuuuguuuuaauuucuaauguaauaaacacugauagaaauaacccacauacagccgggugcaguggcucagaccugcaaucccagcacuuuggaaggccaaggcaagcggaucacaagguacuggaaggucaagagauugagaccuuccaguacuuugggaggccaagguagacggaucaagaggucaagagaucaggaccagcugggcgcgguggcucacaccuguaaucccagcacuuugggaggccgaggcgggcggaucacaaggucaggagaucaagaccauccuggcuaacgcggugaaaccccaucucuacuaaaaauacaaaaaauuagcugggugugguggcgggcaccuguaggcccagcuacuugggaggcugaggcaggagaauggcgugaacccuggaaacagagcuugcagugagccgagauggcgccaccgcacuccagccugggcgacagagcgagacuccgucucaaaaaaaaaagauugagaccaaccuggccaacaugaugaaacccuguuucuacuaaaaauacaaaaauuagccaggugugggcugggcgcgguggcucacgccuguaaucccaacacuuugggaggccgaggagggcagaucacgaggucaggagaucgagaccauccuggcuaacacggugaaaccccgucucuacuaaaaauacaaaaaaauuagcggagcgugguggugggcgccuguagucccagcuacucaggaggcugaggcagaagaauggcaugaaccuggcaggcagagcuugcagugagccgagauugccccacaguacuccagccugggugacagagcgagacucugucucaaaaaaaaaaaaaaaauuagccaggugugguggcgggcaccuguagucccaccuauuccggaggcagagacaggagaaucacuugaacccaggaggcagagguugcagugagccgagacugcaccacugcaugccagccuggcgagagcaagacucagucucaaaaaaaaaaaaaaaaaagagcuugagaccauccugaaccccgucucuacuaaaaauacaaaaauuagcuggguaugguggugugcgccuguagucccagcuacucgggaggcugaggcaggagaaucgccugaaccagggaggcggagguuacagugagccaaggucguuccauugcacuccagccuggugacacagcaagacuccaucucaaaaaaacaaaaaaaaaaaaaagaaagaaagaaagaaaaaaaggaacccacauacaaagaucuucgauguccuuaacaaaaauguaaaaggaacuugugaccaaaaauuugaguauacaaagaauacaaaauaaaacauccuacauguuuucuaaaauaaucuuaaaguuauguuaguucuuuuagauacugcucuuacccuaccaauuuagguacuuuuauguacuuuuucaagaaaauuaccuacucccugcacucagugaaaugaacuucuuuccuuauaccagauggggaaauaaauuaacuuccacauggacagccuaaacuagcaaucaguaaacuuuuucuacaaaaaggaggagaauacuaaucuggcuuuacaggcauacaaucucugcugcaaccacucaacuccaaccuuguaguauguaagcagccacagacaauacauaaacagaggcaugcugcauuccaauaaauauuaacaaaauuaggcaggggccauauuuggcccacaaguucuaaucaaccccugcucuaaacuaacaucuuuauacaaauccaagugauguuuuuguucaauggaauuuauuuucaaaauggagacacugguuuucaaaaucaaaauuuaggaaaaaagguaaaucacauaguugaguuauuuuguuucucagcuaaaacaguauuuucugaaauaccagugaugcuaagugcuuauacuaauacaugugaaccuagccaucugaugacagaugaacuuuaauuuucacucaagauuauacuauuuuaaaaaauaaaauaugaaauagcaguuagaacauucauuuuaggcuugacuaugacaaaacugaguauuuaaccauaaggcuaauuuuaaucaagcuugaacuauaagaguucucuaaaaaggaaagucauauaaaaccaauuagaacuuccccguaaaagaagaaaaauaagauugccuccuaguuguucacuguauuaacuauaacuccuagguacauuauacaaauaaugauucagugaagaaguuuagagcaaugaacuuacugcaaaaagaaaaacugcaauuuauacuaaagcauucuucucaaagucaacguaccuuugcaguaauucucuacuuuccugcacaucucuaguggaaagcguaagaagcauaagauuagcauaggccagcaguaagucuguauugguugcucgccagucacuuuuaucagacuccaaacacuguaaagacuccagauauuccuauuuuguggaaugaacaguaaguuacaaaacuuaaucaaauguuaagaaauuaaucauuuuaagccuacaaauuccuuuucucacuccaaccacauuugugaaacuauauugauuuuuauaucgaccuuauaaaacaccaaaaauauauacauuuaucauaguuaucuccccaaucuucccauuauaaauuuaacugauccugguaaaaauuucauuuuauaacuguucuacauaaauaaaagaaauuuuaaguccugcggggcacugcugcuuuaguacaaaaagauguaugcuaauugccuacauagaaauguaaagacccaauagcuuuuaucuaccuuaagggucuguacaacacacgaauuccauucuaaacuugaacgcaaagcuauguuccucucugccucauggcagugggccacagcauccuucaaucuuuuaguugagcgauacaccuccacuagccggauguucacauggacgucaucaggucuuacauaaaguucugacugaaucaagucaaaaaguuuauuccauccaucuucaccuucacaaucuagaagcuguuccuauuuagaggggaaaaagaaaaauuauuagaguaacacuugugcaauuuuaaacaagucaugcucccaaagagcaccauuccacuaugucuaguuuuaugaugaugccaccaaaaacaccauccuauauaccuuauucaucccuucugagaguugcuuacaacccagaaacuaagccucaagaacuguaugugaagaaaagcaucugugauuacugcaguagcucauacucucuucagagacuaccaggacuaaugccacacauuccuguccaucugagucaccaccagaagccuagaccuccccagucaauccucagcaacaagguccuuauguucaaacugcucuguaucuccuuaaaucugacucaaucccgcauccccucuccucccacuguucuguuaccuucaucaccaucucaaagcacugucaucaccuccugaccuuaaaugaagacaguaucaucucaggauaacccccacuaccaugauggcuuuuucucucugaacuuacauacaaggagaggaaguaggguuuguggccacucacuucucauuugcgaugcucuuccaucagccucucaagaagcuaggaccacaggcaugcaccaccgugcccggcuaauuuuuuuuuaacguucuguagagauggggucuugcuguguugcccaggcugacuacucaguuccuuaaucaccucaucuccagugauguuauccuccacucgaaccucaaccauccacuugccacugacacaggucuucaaaaucuguauuuuggucauaccaccgaaaccaccauaccacccuuguuauucuucuaccucacugagggccuacauacccuuacuuucagaaauauacuucuccaccacaugacaaguucccuucaagacaauaacaucaucaaguuuuaaacaccuguaaacacauauaaauauacacacuuucuucugucaggcaaaaaaugcuauaaucccuuauauccauaauuacuguuugcuuacagaucccuucaacuaauucccucuuuuccucagaagaacccccaaacugguuucugugugcuuagauuugggaaaucauaaccccaagcuaacugauuucauuugcauuaucucaaccaucaaacuggugcugccuaaaacaaaauaccauuuuaguacuaauacucacuuucuccacucugacacuucacaccuccuauuuccucaacuuccccauaccuuccuuugacccucacuuucaacuuauaaccuagauucauccuucacugagaaaccugaugcuaucacauauaaauuccauuuuaccuuaccuacuuaaacucgucuuuccccaacucucaagaccaagccgcccauuacuacucuguauuucauuccccucucuccuuuaucaauuucuccucuucuggaugagauggaugaaacccuggccucucccuauugcaaaagcccuagucuuugacucuauguuaaaaauauuuuuaaaaaccacuaugagugcuuuuuaaaaaguucuaucucauacuugagagaaaaagccuucucaacaguaauacucucauucauuaaacaaaugucagaaacuguuuaccuuagcaagccuuaaauuuuaggagaaauggaauuacuuugcaugacaguuauaaaucucauggauuucaauuccaaaaaaaaaaaaucugauacaggaaagguguaacagugccuucaaguuauuaaagaaaaucuuuaaagaaugcuucaaaguaucuaacuuguuacacugcaagaaaagaaucuccuaucauuacauauguucuuuaacacuacugacaccagauuaacuggauugccacgcccaauaugggaguuauguuugaggcauaacaccuaagagaguaaagaaaucugcacaauuagaccucacguuuuagauuaauauuuaaaauccagcugcuuauuacuggggagaaaaacuuaucaguaauauuuaucuuuggaagcaucuucaaugcuuuuucagcuucaaaaaucuguacuugauuguucauagcagcugaacaauagccaaaaccuagaaauaaccaaaaugucccucaaaagugaaugguuaaggcugggcacaguggcucacaccuguaaucccagcacuuugggaggccgaaguggguggaucaccugagaacccgggaggcagaaguugcagugagccgagguagcaccacugcacuccagcaugggugacuaagcaagacucugucucaaaaaaaaaaaaaaaaaaaaaaaaaagggaaugguuaaauuguggaccaugaaauacuacucagaaguaaaggaaccaacuauggauauacaaaacuuaauauggaucacaaaugguauuauggugacugaagaagccaaccucaaaacgucaugugcuuggcugggugcaguggcucacgccuguaauccuagcacuuugggaggcuggggcaggcagaucacaugaggucaggaguucgagaccagccaggccaacauggugaaaccccguuucuacuaaaaauacaaaaauaagcgggacaugguaacacgugccuguagucccagcuacccggaaggcugaggcaggagaaucgcuugaaccugggaggcggagguggcagugagccaagauugcgccagugaacucuaaccugggcaauagagcgagacuccgucucaaaaaaaaugaaaaaagaaaaaaacgucacauacuucaugaugacauuuacauaacauuuugaaaucaccaaaguauaaagauggagaacagauuaaugguugccagaggucaggcauagugaagagaaguaaauagcaucacuacaaaaggggcagcaugaggaagaucucugugguaauagaguaguucuguaucuugacugcaguggugguaugaaucuacacgugauaaaaugaaagaaaacuauacauacacauuguaccaaugucaaaauuccugauuuugauagugugcuuuggucggguuaaacagguugaguaucccuuaugcaaaaugcuugagaccagaaguauuucagauuuugaauuuuuucagacuuuggaauauuugcaggauacuuagcagguagagcaucccaaaucugaaaaucugaaauccaaaauucuccaaugagcauuuccuuugagcaucaugucagugcucaaaaaauuucagauucuggagcauuuaggauuucggauuuuaaaugcucaaccuguauaagcauuggggaaaaaugaaguagcauacagaaucuuucuguacaaucuuugcaacuuccugugcaaaaaaaucuauaauuauuucaaaauuaaaauuuuuuaaauuccuaucagaaacauauauaauggggauagaaggaggcuaaaggcaaauauacauuuauaauuuaauauuguacacacacgauaaaguauacauuaauauauaaaacauuacaauauacauuuuaaauguuugccaaacauauuuguguagauuuucuccagaacaguuacuuaguaaacuauauuuuacucuauaaagaauaucaggaccagucaacacacuagcaagaacuuccuaccauuuuuaguaauuacgucuuauauacuagagaaaccaccuuuugucuuuugcuugaaaaccuuacuaucucaaaaugcaaucccuucuacuuucagacaauaguuauuagaaaacacuucuuuaaaauaucccuaaauugucauccuguagguaauuuucacuuaaugaagcaaaaauuguauaccagacggaacuuaauguaaaucuuagcucuacuuaguuuacagcuacuaaacuguaaaaucccuaaaauauuaauuauuccagaaagguaaaugagaugucacuuauaaaguauaacaaugccuaauaagacaguagaugcucagaaagguuuuaacacacuuuuuaaaagaaaauuuuuaaaggaaacacuaacaccugggcuuaagguuugcuauugaaaaguaauuuaaauuccaaauauuagaaaugguuaugucuuaaguuuucucccuuuauguuuuguuuguuuaccuuuaguuuauaaauugcaggacuuccugggaaaaguuuggcugcucuuucaagccaguauuuugcucuuccaucaguaacaucauuuuuacaaagcaauucugcaaucuucaacacaagaucuuuuuguguuggguuuaauuccacugaacgcuaauaucagaaaagaaauuaaagauuaguaaauaaauuguauguauguauguaggaguauauauacuuauauauaaagguuaaaaaauuaucacuccaacccuuaaaaaauucuacuucuagagaaaacauguuacuucaaagguguuaaaauaaaagugucuuggaauucucuggaaaugaaucaaauaaaaauuauauuugugucauuugaauacaaaaaacacaaaagaacaccauuucugaccguguuagacuuacaauuuauagguguuaaacaauucuaaaucuguuccaagcugugucacguaacuguacuaugauaccaaugccuguuuuaugauauucauaaaauauauuugacuuacuuauauaaauuucucugggcaucauguguuuggcuaugcaaaggcuauauuugaauccuguaacuuacccuguaacauucaacggcuuugucuguguuuucuuccaauucauaaagaagacccagaaaucugugagcuuugggaucccucucuugcacauuaauguaaguacauauguaucuguuuuuuaaaaguaauacaaaaguaaauuaaacuuagaacuguacuuuuaaaugcuaaccgaagaauacaucuuaaaccaaagcaaccacuaaacucguuuauauuguuacucaaaacuaccgcuauucauacagauaacucagaaguacucauagaaauagauaauacuuaaaaacacguacauagaguugaccacauacucauuuuaccauuaaaugucacauuuaccaaauuuuucuccaguguuauccacacauaagaaaugaacauauaaauugcuuuuucuuccugaucacauuuuaauaaagcacuaacaguuuugcgaauaaauuagaagugauuauaguaaacauuuuuaaaguuaucauaaugcaaaauacuaaacagcaacaauuucccaaacaacaaagggaaauacauuuacccuuuaagcaagaaaguaauuucuaacaguacuauauccagcuaaaaucgaacagaagaaaaauuacucauuacaguaccaaauacaggaaauuuccauuucucaaaucaaguaacaacuaaaauaaguaaauauccucuagguuccuugacaguauuacgaucagagaaauuaggccagaccuaaacuaagggauuaaagucucacaguaaaaagguacaagaguuaacagucacagugcugcuaguuacauaauuuauguaccaccauuuuccuuucuuaccagcauuuccaucuuccuuuggaugccuuuaaaagccugccucccagcugggagcaguaacacacaccuguagucccaacacuacgggaggccgaggcaggcagacugcugugcucagaaguucaagacuagccugggcaacauagugacaccugucucuaccaaaaaaugcaaaccuuagccaggugugguggugcgcaucuguauccccagcuacuuggggcgcugaggugggaagaucucuugagcccagaaggcagagguuacagugagcaaagauggagccagcugcugcacuccagccugagcaagagagacagauacugccuaaaaaaaaaaaaaaaaagccugacucccucuuaauuuccugcuuuaauccacuccaagucaggaaaucagaaucaccaagcuucuuaucccuaggauagagccuuagagcaucacauauugugucaauuaaacaucuuuuauacaagcuauucuccugccuuacaauuacgguuuaauuuuuuauucauugcuauuuuccaucugauuaagguaucagauaucuaaccaaaaacaaauuaagauauaggcaugguccucuuuuacuccaacagaagacaauuuuuagaaaaaguauuugaagccaaacaauuucuugcccuugguauaaagcagcagcaugcagaaaacacuaauuacgguuucaaucucaauggaaucuaggcugguccuuagcaucagucugagugauaaaucccuuauuccagaauacacuuaggaagaacuacuaagaacauauuuuuaccuauuucaaagaagaaaaugagaaaaggcauugauuuuaaaaaaaaaauacauguuacaguuuguacuuacuuuuuagcaagaucauauucuuuagcuucauaauacagcuuugcaaaauagaauccuuucauugacuucuaaaaaaaauuaaaaguuguuuuacuuuucauacagaaauauuuuccaacauuuuuucaaaaguaguaaaaaucuguccuaaguugauguucaaauacgccacuuucauucacuuaaaaguuuuuuuaaaggcugacaaaugcauaauuccauguuuuauaauuuccuaucacaaaacaaaaaauagagcugggugcagcggcucaugccuguaaucccagcacuuugggaggccgaagugggcggaucaccugaggucaggaguuugagaccagccuggcuaacauggugaaaccccgucuugacaaaaauacaaaaauuagccaggcaugauggugggugccuguaaccccagcuacucgggaggcuaaggcacgagaaucaguugaacccaggagguggagguugcagugagccagagguugcagugagcugagaucgugccauugcacuccagccugggcgacagagcgagacuccaucucccaaacaucaucaucaucaucaucaucaucaucaucaucaucaucaucauaaauaagcugggugcaguuggucacaccuuuaauucuagcacuuucagagaccaaggugggaggcuagcuuugaggccaagaguuugaaaccagccugugcaacacaacaagauccugucuccagggagaaaaaaauagccaggcauaguggagcaugccuguguuccuagcuacucaggaggccaaggaaggagaaucacuugagcccaggagguugacacugccgugaguuaugacugugacacugcacuccagcgugggugacacagggagauccucucucuaaauaauaaauacauaacauacaaaaaauaaauucaagaaaguaagacaagcagacaacagaagaauuuucaucagccuuggaaaucuuggaaacccugugguaccacucucucacuuaacaaacaaaagaaaccagcuuucuuuggggaggaaagguauuccagaaaucucuuuuccuaccauguguaagccucuaugggaaagaauaaguaaguacuuaggaucuauuaaggcacugaggauucccugguccauguacuguucucucuacagaucagaucaguauuuuacagucaaggagucaaaaaggcagaaauaaauauugaauucuucaaguaauaaacgagguccacagccuggcuccuugguuacauaaacuccaaaguccaaaaugcugaugcacaccaggcugggugcgguggcucacaccuguaaucccagcacuuucggagaccgaggcgggcggaucaccugaagccaagaguucgagaccagccuggccaacaugcagaaaccuccuuucuacuaaaaauacaaaaauuagcugggcaugguggcacaccccuguaauccccacugcuugggaggcugaggcaaagaaucgcuugaauccgggaggcagaggcugcagugggccaagaucgcaccacugcacuccagcgugggcaacagaaugauuccaucucaaaaaaaaaaaaaaaaaaaaugcugauacaaccagaguauguuccauccaugugauaaagaguauacagcuacucaaacaucuuauuuuugaaauuccaagaccccagugaauguccaaaacgaugaauaguaucaaaccagguugccgucaaucgaaacauguuuccuguuuguguccuccacccacaaauuuaaugucuuguccaucucaacuaagcacuuaucacacacuauggcuguaacuuuugcaguuuggggugucacaacaaaacuagcacaaauuucuuuuuccuucuucacaauuucauggacaaaagauuuguucuuaccauagaucuuagcaacuccaguauaugaucuuuuuucuuuccuaagucaaaaacucaccucuucugaggggcgccucugcccggccgccccuacugggaagugaggagccccucugcccggccaccaccccgucugggagguguacucaacagcucauugagaacgggccaugaugacaauggcgguuuuguggaauagaaaggcgggaaagguggggaaaagauugagaaaucggaugguugccgugucuguguagaaagaaguagacaugggagacuuuucauuuuguucugcacuaagaaaaauucuucugccuugggaucuuguugaucugugaccuuacccccaacccugugcucucugaaacaugugcuguguccacccaggguuaaauggauuaagggcggugcaagaugugcuuuguuaaacagaugcuugaaggcagcaugcucguuaagagucaucaccacucccuaaucucaaguaaucagggacacaaacacugcggaaggcugcaggguccucugccuaggaaaaccagagaccuuuguucacuuguuuaucugcugaccuucccuccacuauugucccaugacccugccaaaucccccucugugagaaacacccaagaauuaucaauaaaaaaauaaauuaaaaaaauaauaauaauaaaaagcaaggugagacuacaguacucucccucugccaugugaggacaagaugccagccaaccuauaagccaggaagaaagcccucaucaggaaccaaagcagcagcacccugaucugccgcuucuagccuccagaaccaugagaaaauaaauuucuguuguuuaagccaaaaaaaaaaaaaaacaaaaaaacucaccucuucacuuaaaggaagcacuauauggcuucucucugcauaugugaacugccagcaucgcuacucuugcucuuuggugccauuuuaaauaaaauaaagguuacuugaacacaagcacugcaauacuccaacaacugaucugauaacugagaugacuaguauguaacuagcggguggcgagcacauacagcaugaauaugucggacaaagggaugacuuguguccuagguaggacggagcaggaggccgugagauuuuuaccauguuauucagaaccguuugcaauuuaaaacucaugaaauguuuauuuauauaaucuuccauucaauauuuuuggaccacgggugacacagcuaaguaaaaccacguaaggcaauacuguggauaagaagggacuacuguaccagcaacgaacaaucagaaaaggaaauuaagaaagcaauuccauuuacaaucgcaucuaaaagaaaaaaaugccugggaauaaauguaaacaaggaggugagagacuuguaugcuuaaauuacaaaacguugcucaaugccaggcuaacaccugcaaucccagcacuggcgacagagcaagccuccgucucaaaaaaaaaaagaacuacagcaaucuuaacaaaaauaauacacagcagucaggacagcacguaaaggaacaaggcuuguuccccccuuccuuuuuuuuuuugagauggagucuugcucugucgccaggcugcagugcaguggcucgaucucagcucacugcaaccucugccucccggguacaagcugggacuacaggcgcacgccaccaugcccagcuaauuuuuguauuuuuaguagagaugggguuucaccauguuggccaagauggucucgaucucuugaccuugugaucugacuuccuccaccucccaaagugcugggauuacaggcgucagccauugagcccagccaguucccccuuuucaaaaugaagaaauagauucaagguacaaugccaaaacauaauagaaaaauaauuccauuaccuucuuugcuuccaacuauguuauuaaaguagacaaucuuaagauaauuaaacaacuuuacaaauuauucuucuauaugaucuuuugccucuaaccugcucacuuuacaagggaacugaagcucaagcagguaaaugccuuguuuaaagauacacagcuaggaaggagcacagcccauguuauguaaacaggacaauaucugaugcaagcaguacuucuuuacaugacagcagaugucacuauaagcaaauaccugaauucacuuaagcugccaaauaucaagaacugaugcagggcugaaaacaggaacaguaagacccuaagagaugccacaucaucucuaucuugcacaguaagauagagauguaauuguaauuguccaaaacuuaauauuuguggccuacuuuuucacuaugcaguucuaaauuuuuuuuuuaauucagauggagucucacucugucgcccaucuugcacagucaaaugaaucucccucccccuaaaauccuccaaaaacccaucugaucagcuguucucaacaaacccaucugaucagcuccaaaucuguggagucccaacaagggugaaggccgcgauuauacaggacaaugaggaaaagucuagauacugaaccaugaguuccccaaucuucuuccccuggaacauaaggguaaggaaaucucucaaaaggcagaacaaacaaaagaggagaauaagagaaaaauuagagaaacuccagcuuucagguaaacgucauuaaaaaaaggguaagaaauggucaaagaaauaauacaagaaaugcuacagaacugaaagaaaugaguuucccaauugaaaggacacuuccagaaaaccuuuaaguuaccaagaacaagaaucucaucggacuccuaacaacagaacuucuagaaaauggagcaaugcuuucaaaauugcgaaaaaaaaauuauuucaaacucagaauucgauaaccaaaugaucaacuaaauuaaguaaagacauuuuaaagacauaccauuaguuucaagaccagccugaccaacauggugaaaucccaucucuacuaaaaauagaaaaaauuagccgggcaugguggcacacaccuguaaucccacuacucaggaggcugaggcaggagaaucgcuugaacccgggaggcggaaguugcagugagcugagaccaugccacugcacuccagccugggcaacagagcaagacucugucccaaaacaaaaacaaacaaacaaaaaaaccucucaucuacuuuuccucaaagcaagugagacuaugcuacaccaaaacaaagaaaguaaaugaagaggacaugagauacaagaaacaaagggucuaacucagaaaaaagaugaaaggaauucucaaacugaugauaaagggaagucccaagagcacagcuguguagcaaagaggaagaaaaaccaauccugguuggagaagucaguuaguaaggguauuccagguagacagacaaucaaucaaucaaucaaucaaucaauguuuuaagcugcaauugaugggauuaugugaccaguuugaccacauuugaggguguaaauugcugaguuuaaguaagcaaguaguaacacaacauacaagcaaaccaaaaaauaaagcaauuauucaguccaggaaaaacaaaaccgcacaacaagggcaauucaaaugcaaaaauauuuaccuuauauuuauauaaauguuaaauauucauuuaaacaaaaacugcaauaacaguacugaaagaaugaggggcaaaccaaagugucugaggacaguuuuggaggagcauaauaaccaguacagaaugucuaaaauggggcccggcgcgguggcucacgccuguaaccccggcacuuugggaggcugaggcgggcggaucaugaggucaggagaucgagacuauccuggcuaacacggugaaaccccgucucuacuaaaaauacuaaaaaauuagccgggugugguggcgggugccuguagucccagcuacaggcuggggcaggagaauggugugaacccgggaggcagaguuugcagugagccgagaucgcgccacugcacuccagccuggacgauagagcgagucuccgucucaaaaaaaaaaaaaagaaaagaaaaugucuaaaaugggagaaaggaaauuaaaaauaacaaaaguauauauguguguuacucagaaguaugaaguauagcuguaaagggcagaaaaaacaacuaacagcugucaaaggugccugccuguaguccuaaguacucaggaaacagagguagguggaucauuuacgcccaaaaauuugauggcagccugggcaacacagcaagacccuauucuaaaaaacaaauaaauaaaaauaagagcugucaaguagacuuugagaaguaggaaucagcugcagaauaagaaaucaacuugacagaacauagaaaaacuaaacagaagccaucuggaaaaagaaaaacuagagaaagaauuauauuuuuuuuucuuuuuuucuuuuuuggagacagagucucgcucugucacacaggcuggagugcaguggugcaaucucugcucaccacaaccucugccuccaggguucaagcaauucuccugucucagccuaccgaguaggugggacuacaggcgcugccaccacgcccggcucauuuuuguauuuuuaauagagacggauuuucaccauauuggucaggcuggucucucggccucccaaagugcucagauuacagacgaagaauauuuuuaagggcaaaagcacaugugagggaguagaaaaauggcaaaacaagagaagacuaacaaaugaaagcacaaugaaagacuagaaagauaugauauacagacgcaucaucacacuccaaaacuccgacauucuagaaagcaugggcaguucacagauggccagccucugccaaacugggggagaauacuaaccucuucauauucuucacagccacugccucuucucccuccauucuuuaccuucuauccaaagcacccuguuuugucauuucacucaaaccuaacuuuacagaauagcuucacauguuccaaaguuacucacuaguuaauccauauuccgcugaaauccccagguucuaauguaaaugacuuuaaauuugggggaaaaaaaagacucuaaguguaagagaggugucauaauaaccaauccucaaaauucugccaccacuccacuuuauuuaauggagaaguuauguaguugaaagaacauucuaacuucugucuagaccagugguuuuuaaucuuuuggaagccaagguccccacuaagaaucucagaaaggcucuaagcuugcuuuuuuuuuuuuuuaagcuuguuuaaaaaaaaaaaaaucaggcugagcagaguggcucacaccuguaaucucagcacuuggggccaaggcgggaggaucacuugagcccaggaguuggagaccagccuggguaacaugauaagaccccgucucuacauuaaagaaaaaagccgggcaugguggcacaugccuguagucucagcuacccaggaggcuaaggugggaggauggauugagcccaggacgucaacgcugcagugagccacgaucccgccacagcacuccagccugggagacagaaagagaccuugucucaaaaauaaaauaauggccggugcaguggcucacgccuauaaucccaacacuuugggaaguggaggcggggaaaucacuugagcccaggaguucaagaacagccugggcaacauggugaaacccagucucuaccaaaaauacaaaacaaaacaaaacagcgggugugguggguacaccuguggucccaacuacucgggagacugaggugggagcaucgcuugagcuggggaggcggaaggugcagugagucgagauagcgccacugcauccagcugggugacagagugagaccccaccucaaaaaaaauaaaauaacacaaaaauuaaagucuuuaauuucaggaguuacaggaacccucaauuaaggucuguuuuagacucuaucaucacauucauauuuauacuaugcuagcaguuugaaauuacaauguacaaguagauaucuauccuccuccucuggaggaauagacuguaacuuacuccacuguucccaagagaaacuaaaucagacccacugccaaaauucugcugcacuaucuauuugacccugaacaaguaucuuaaaucucuacaggucucaauauccacagggcugcuggaagcgcaaaauaagauaaccuaugcuuaguuacgauaagagacacaauuaugcuacuauuauaaucauggucauccgugaguuuccggguuuuuuuuguuuuuguuuuuguuuuuuuggagucucccucugucgcccaggcuggagugcaguagcgcgaucucggcucacuggaaccuccgccucccggguucaagcgacucuccugccucagccucccggguagcugggacuacaggcaugcgccaccacgcccggcuaacuuuuuuuguauuuuuaguagagacgagguaucaacauguuagccaggcuggucacgaacuccugaccucaggcaauccgcccuccucggccucccaaaguggugggauuacaggcgugagccacugcgccccgccaauauccuuuuaacaucaacaauaaaaagugacuuguagcuaacauuuagugcuaugugucaagcaauacccuaaauguuuaaaauggaucauccuaucaaauucuauuaauguuacaacuccaucuauggaugaaaaguguaacuggccccaaauacccagcuuauaaacgacagugcugugauuauucaagccaaagcaaacugacucaagauucugcgcacauccaccuuuaauagcuucuuccgucacucuuuagauccaauuacuaaagucuuauugaauccaaaauagaucacauuauuuacauguaaagaggaaaaauacccuuaaaacauuuguggaaaagguuaaaaauugcaagccauacuaacgauuuguaagaacuuuagaauuuuuuuuuuuuaagcaaaggcagcuaccaaaguguuccgggcggggaggggggcgagggaggugaguaugaggagcggaguggagcuggacccuuacaaagggacagcgacaaacaccucauacucaaaacaaggggacuuucagugucauuugcgccgucgggccauugcaaauguccgcgcugagaugccuaccuugucacucgacgcagccgccaaagcucacccggagcugcgucaguccccacuggguuccuccaggccaaggagguacgaccuccgccgcagcauauaaaguauauguccaggagaugggaagaaacccgccgauacagcacccgggugcccaagcccccgagaacuaggccgcgcggguacuacggggugcgcgaucggccagaaagcccgggccagggcggccccaggagcgagcaccgucgggaacaagcgucgggaacaagccgggagaaagaggaagcgccggcgccaaaggucucccgcccaccgcuguccccccaggacucuucaugcgcuugcaagcgccacgccgcccacaggacugcgccagccggccggcgccucaacagagcgcgccagggagcagcgcccgucgggagccaugacgccugagcagcgcgaggccgccgcccggccaggucgaggccgucggucucuucgagacccacucaccugucgaggcgacgggguggagcccugcaccgaggcgauguaccgcuccacgucagccuugcugcgccucaucgcgccgccaaccuggcucccgaggcgcgugagaccagcgcucaggcccgcagcagucgccacuuccaagaggaaagcgccugcaaaccagugacgcagcgccguagccggcggaggaccacugugacgaacuugcggcgcagccggcggaggaccacugugacgaacuugcguacugcgucagcagugugcgccacguuggcgacgucggcgcucgagcugcacucggccaggcuc

SEQ ID NO: 16256 - RNA, 858 nt, Homo sapiens
cauugucuagacuucccagacuccuccaaggcuggguagcaagccagaggccagaucuauuuuuuuuuaaauauuuuucuucuaagaaagaaaaaaaauuacauuuacuaguuaacugaggcuaaguuaguuaaaagaagaaaaaaaagcaagcuucuuuccacucauuagcacagucaucaugagcaauaaucauucuuuauuuuaaaaugucccuaaguuccaaaaaccauaacucuaaaaggcaccugcagcuaaagauggcuauaagagggauaaaaaugaaaagaccuacucagacaccguggacaucauuuuguccaagcugaucuagaggccaaauuugaucugccuauaggcccagagaggucugggagaacguaaagaaacuuucucuugucuugucuugcucccuaauuuuaaucuguuucuuaaugaucuuugcagaccugucccugaggcacagagucucuuuaccagcaucagaaaaccuagacgaucuaucaauuuaagccuggcuugggacaaacuugaugagaaaggucauuucucacagucucuuggcuccagucccagaguuuaccgagugcucuaaugccucuucuuggguauuccacaacuguaacaaagagcaaaugaaaauccacuaccugaucuuuagacagaaugaauuucagaguuagaauugacucaaauaaugccaccucugagaaaacugagcaguccccugcucucuuacuucacagacugauucauaugucccaauuuauguucucauuguaccauauacauaucucuacaacuguacuguacuuauguacugugcaaguauuucuuguucauuuauccuaccuuuau

SEQ ID NO: 16257 - RNA, 538 nt, Homo sapiens
uuuuuuuauggugaaaagauauauauauguauauuuagaauuaggcaucuggacucaguuuagaugaucccaauuuuguugacaacauccaaagcaucguaaucaggagccagucgaacauaugccuucuucucuccaucaggccgaaucaggguguugaccuuggccacaucaaugucauagagcuacuucacagccuguuuaaucuggugcuuguuggcuuuaacaaccacaaugaacacaaguguguuguugucuucuaucuucuucauggcagacucaguggucagcggaaacuugaugauagcauaguggucaagcuuguuuuuccugggagugcucuuccgaggauauucgggcugucuccggagucgcagugucuugggccgccggaaggugggugacguguggaucuuuuuuuuguggcuguggacaccguucaacacugccuucuuggccuuuaaagccuucgcuuuggcuucagcuuuaggaggggcaggagcuuccuucuucgcuuucggugccaucuugugaaaag

SEQ ID NO: 16258 - RNA, 2136 nt, Homo sapiens
ccgcgcuggugcuagggcgcagcaggccaagggggaggugcgagcguggaccugggacgggucugggcggcucucggugguuggcacggguucgcacacccauucaagcggcaggacgcacuugucuuagcaguucucgcugaccgcgcuagcuggugagugucccuucuguguguggguccuagagcucgcggucuggucuggucugguccccagacugacgccuggucggucccccucuugucuuacagcggcuucuacgcuccggcacucugaguucaucagcaaacgcccuggcgucuguccucaccaugccuagccuuugggaccgcuucucgucgucguccaccuccucuucgcccucguccuugccccgaacucccaccccagaucggccgccgcgcucagccugggggucggcgacccgggaggagggguuugaccgcuccacgagccuggagagcucggacugcgagucccuggacagcagcaacaguggcuucgggccggaggaaggugagcggugggcgggugccgacgcgacucgaggggccgggaagguggggaagccccggugcuggaaggggucagagccgccuuggcuuccuaucccaucgggacccagauugcuugggggcagggggaauuggaguauaaggugagugaggcggaaacugaggcacggagugggaaggagcguugguuucuuaaggaaacagcaccucccccgccugugcguuucguuuugaagccgcucuaauaccccuuccugugugcucuccuuuccagacacggcuuaccuggauggggugucguugcccgacuucgagcugcucagugacccugaggaugaacacuugugugccaaccugaugcagcugcugcaggagagccuggcccaggcgcggcugggcucucgacgcccugcgcgccugcugaugccuagccaguugguaagccaggugggcaaagaacuacugcgccuggccuacagcgagccgugcggccugcggggggcgcugcuggacgucugcguggagcagggcaagagcugccacagcgugggccagcuggcacucgaccccagccuggugcccaccuuccagcugacccucgugcugcgccuggacucacgacucuggcccaagauccaggggcuguuuagcuccgccaacucucccuuccucccuggcuucagccagucccugacgcugagcacuggcuuccgagucaucaagaagaagcuguacagcucggaacagcugcucauugaggaguguugaacuucaaccugagggggccgacagugcccuccaagacagagacgacugaacuuuugggguggagacuagaggcaggagcugagggacugauuccugugguuggaaaacugaggcagccaccuaagguggaggugggggaauaguguuucccaggaagcucauugaguugugugcggguggcugugcauuggggacacauaccccucaguacuguagcaugaaacaaaggcuuaggggccaacaaggcuuccagcuggauguguguguagcauguaccuuauuauuuuuguuacugacaguuaacaguggugugacauccagagagcagcugggcugcucccgccccagcccggcccagggugaaggaagaggcacgugcuccucagagcagccggagggaggggggaggucggaggucguggaggugguuuguguaucuuacuggucugaagggaccaaguguguuuguuguuuguuuuguaucuuguuuuucugaucggagcaucacuacugaccuguuguaggcagcuaucuuacagacgcaugaauguaagaguaggaaggggugggugucagggaucacuugggaucuuugacacuugaaaaauuacaccuggcagcugcguuuaagccuucccccaucguguacugcagaguugagcuggcaggggaggggcugagagggugggggcuggaaccccuccccgggaggagugccaucugggucuuccaucuagaacuguuuacaugaagauaagauacucacuguucaugaauacacuugauguucaaguauuaagaccuaugcaauauuuuuuacuuuucuaauaaacauguuuguuaaaacaguugg

SEQ ID NO: 16259 - RNA, 19890 nt, Homo sapiens
cgcgucuccgccccggccacgcccaccacggcacgggcgcgcgcacgccgccuucgccgcuggcuccgucuguuggggggcgaacacgccgcgguccucgucguggugagcgcagccacucaggcugguccuggggguggggcuguaggggaaagugcuaaagccgcugagguaagaggccgaggggucgagggcccucgggagcuuggugaaaagggaguuaacccccaggauccuaccugcagggacuagaaaaauggagaagguaggaggagaaacaggagacugcugcagcagacgugcgauaggaaauuuccccaggccggguuugaccgagugcgcaugcgggccgagggcuggcgccugcgcagugggacagcgccgauggcguaguuuccuggggacccagcugggugggaaaaguggcuaggaguuagcuugggagccgcugguguucugagcgcuccccucucuggccacuuuuucuccacgcccacccccgccccguucccgcccccccccccccccguuacagcugcggcaucuauuugguuuggguuguaauccagcuguuuugaaguggaacgauuuguugaugauggaauuuaaugauuacuuguaauaauuugccuuuguacuaggguaggaacuuuuaaggaauuacucuuuuuaagaaaauaggcauauaucuguuagaaaggaaaggaauuuauauucauaaauauaugaaugcgaggucaucccugccguacaugaaguaaauguuuaagcaucuuagcucggacacagcaaucuguguccacaaagcaucguuacucuccugugaggaucuccacugucagccccaacuuaccugacagggccaagucccaggauacuucaucaucaguauuuguuugacaaaauuuuacugggcaccuccggugggccuggcaaacugguugaagauagaguugugcgaauagaucugcacaaugagaaagaaaaaaauccauaaugauccaauacucaugacacagcgcuucucuaucuccugcaugaccuuugcugagcugcucgcccugcguucugucguuuguucaucauucauucauccgaaaugcucgggacuggaagcacaguggaaacacugccccagguucugugcucggcauugaggguagaaagacuuuucgaagguggcaggguguuucuuaagaucauugaaccuuaaaaugaaaguguaggccgggcgcgguggcucacgucuguaauccuagcacuuugggaggccgaggcgggcggaucacgaggucaggagaucgagaccauccuggcuaacacggugaaaccccgucucuccuaaaaaauacaaaaaauuagccgggugugguggcgggcgccuguagucccagcuacucgggaggcugaggcgggagaauggcgugaacccaggaggcagagcuugcagugagccgagaucgcgccacugcacuucagccugggugacagcgagaauccgucucaaaaaaaaaaaaaaaaggaaaguguaaagugcuuaauagaaggcacuggcccuccuccugaacagauucuuucuccugugggagcuugcugacucuguuagauggagagaauuaauacuuuucccaugagguuuuuucauaguaaguaugaaaaccugggaucugcauaggaaaaaagacucaguaguaacucuccguuaaugacuuugaauagccaagauuuaugaaguguuuacuaagccuguaacuguuccaaguguuuuacguguauuaacuaaucuuugucacaccugugugagguaggugccguuauuacagguugaguauccuuaauccagaaauccaaaauccuccaaaauuuaaaacuuuuugagcacugacaggauggucaaaggaaaugcuaauuggagcauuuugaauuuuagauuuucggauuugagaggcuuaaucauuaaguauaaugcaaauaucccaaaaccugaaaaaaaaauccgaaauccagaauacuuccaagucccaagcauuucggaugaaggguacucaaccuguuucccauuuugcagauaagacaacuaaggaacaaaaagaucccggagggggaggcggagguugcagugagccaagaucgugccauugcacucuagccugggcaacaagagugaaacucugucucaaaaaaaaaaaaaaaaaaaaauauauauauauauauauauauauauauauauauauauauauauauauauauaugccggagguugcaauuuuuuacauuuuuggcaucagaccuuggcgaugaccuugagcaguaggguauaaauaacucccacaugcuuagcguuccaguaauggaacacuaggcauaaauggguuaaaugauguguccacagucaugcagcaaguaaguagcaaaaccagaacucagagaggcuucauaaucuuacccauuaugcugcuuuacguugcacaugacaaauaacauaccaacaagccauugcuucaaaaugucacagcagauaagcuaaaauugucucuacaccucaguuuuauuuuuucauauauaaaauggggaaguuggguuagaugaccuuuaaggaaucugugguuucugugaaauauuuaauucacucagcaaacauuuacugaagugaacaacuacuuccuuacuauaggccagguguuauguuugguucuggugaucaguuaauuccugcccugagagcaguuaccaucuaggguuuauuaguuuugcuuuacucucauuuaccacuugcugguagcauucaaaauuuaaccuaaaucuuuagagcuagaaauuacuuagguauauccuuccaccucagcagaaaacugcuuauuuaaaguuagcuuuaugcuaauucugugcuccaguuuucaacccuggcuguuuuguguguggaacgauaguaguucugagaguuuggaagaaaacaggaugaaagggaguucguuugauuauauucagcuuagaagucacacuguggcuaccuuuugaagcuguccucacucuggcaguugcuugggugcucugcucagcaccugacuucaaaauauaaaguauaaagcauuugcaacugaauagagcauuuaucaggguguagguaaaauagauuagaguuuuaaaucuuaggugagauauauaaacaguucaccguggguucuacucugaacugaugggaaauaaagacugagcugcucuccaaaagauggcuaaguugucuguauacuuuauuugaaucccaccaggaauucacuuagagauuuggaccuggucccuuacugcuuaaguucaaaaacaauucaaaaacuugucaggcuguauuuugacccaguguaguccggaagauuggauauuaaucuaacucccaaaguuguugccucuguggauaugaguacaauuuggaaaguuaucagagcucagagaaaagaggaagagugaucuaauaacaagauugaaaaugucagcugagcagaguggcucaggccuguaaucccagcauuuugggaggcugaggugggaggaucacuugagcccaggaauuggagacccgccugagcaacauagugagacuuccucucuacaaaaaauaaacaaaauuagugggguguucuggcacgugccuguagucccaacuacucgggagacugaggugagaggauaacuuguacccaggaggucaaggcuggaguuagccaggauagugccacugcauuccagccugggaaacauagcgacacucugucuccaaacaaaauaaaaaauaaaaugucauuaaucaauuugcauuuuugcugacagucuaguuauaauagcuguuuuaccguucccauaccccacuucacuauuaaucaguguuacuuauagacauguaaugaaaucagaaaccaagcucugcuucucuaacagccuuaaaucuucaucacaaaauuaagcaaacagaacagccaguauuucaagacauacuauaucauuuuccuuacuaggaaucuggauuuuauguauauaaauuuauauuuguauuucauuuccucacuuuuuucuguuuucaaaaaacauggccaggugcaguggcucacgccuguaaucccagcacuuugggaggccaaggcagguggaucaccugaggucgggaguucaagaccagccugaccaacauggagaaaccccaucucuacuagaaauacaaaauuagccaggcaugguggugcaugccuguaaucccagcuacucgggaggcugaagcaggagaaucgcuuaaauccgggaggcagagguugcugugagccgagaucgcgccauuuccagccugggcaacaagagggaaacuccgucucaaaaaaaaaaaaaaaaaagaagagaaaagaaaacauaaguuucagccaggcauggugggucacaccuguaaucccaacacuuugggaggccagggugggagaacugcuugagcccaggaguucauaccagucuaggggcaacauggugagaaguugucucuacuaaaaguaaaaagaauuagcugggcaugguggcaugcaccugaggucaggucccagcgacuugggagguugagagguuggaggauugcuugagcccaggagaugaggcugcaauagcaugaucacgccgcugcacuucagccugggugacagagcgagagccugccucaaaaaacaaauauguuucaacuuuuuuauaauaaauauguucauuuugcaacuagcaaaaaaaaaaaaaaaaaaaacccgaaagaaaaauacucaggcuggucuaggugaagugguguuuacaguaacugaucaccaccaguuacagauuucuuuguuccuuuuccacucccacugcuucacgugacuggccagaaaaaaaaaaaaaaacucagcuaaaauucucucugaccauuauagagggaaauucauuuuacaauccuuuuuucucccccgccaagauggaguuucgcucuuguugcccaagcuggagugcaauggcgcuaucucggcucacugcaaccuccaccucccgaguucaagcuauucuccugccucagccuuccaaguagcugggauuacaggcgccugccaccacgcccagcucauuuuuguauuuuaauagagauggaguuucgccauguuuaccaggcuagucuugaacuccugaccucaggugaucugcccaccuuggccucccaaagugcuggcauuacaggcguuagccaccagccugcaauccuuuuugaaguccuuucuuuuaauugggcuaaaauucacauaacauaaaauuaaccauuugccauuuuaaaguauacaauucaauauaaaguuauuuuuaaucuaaauacuagaaauuuauccauuacaacagccaauagccacauguggcuacuuaaauuuuaauuaauauuaaauaaaauuuaaaauacaguucuucagucacaccaguuuauaggugcaacaugaagcuacuggcaaccauauugugcagugcagaaauagaacacuggaacauuuccaucauggcagaaaguucuauuagcauggcacuagaccauuuuuucuuuucuuuuuuuuuuuuuuuuuuuuuuugagacagagucuggcucugucacccagacuggagugcaauggaaugaucucagcucacugcaaccuccgccucccagguucagguucaagugauucuccugccucagucuccugaguagcugagacuacaggcgcccaccaccacacccagcuaaauuuuuuuuuuuuuuuuuuuuugagacagagucucacucuuuugcccaggcuggagugcaauggugcagucuuggcuuacugcaaccacugccucccagguucaagcgauucuccugccucagccucucaaguagcugggauuacaggcacgcaccaccaugcccagcuaauuuuuguauuuuuaguagagauuggguuucaccauguuggccaggcuggucuugaacuccugaccucgugauccacccgccucggccucccaaagugcugggauuacaggugugagccaccgcacccggccauuuuuucuuuaaaaaauacuaaauacacuuguuagagggcugagcgcagugagacuuugggagaccacggugggagaaucacuugagaccaggaguuaaagaccagacuggccgggcaugauggcucaugccuguaaucccagcacuuugggaggccgaggcaggcagaucacgaggucaagagauggagaccauccuggccaacauggcgaaacccugucucaacuaaaaauacaaaaauuagcugggcgugguggcacgcgccuguagucccagcuacucaggagguugaggcaggagaaucgcuugaaccugggaggcagagguugcagugagcagagaucgcgccacugcacuccagccugccaacagagcgagacuccguaaauaaauacauacauacauaccagacugagcaacauagcaagaccuugucucuauuuaaaaaaaaaaaaaaaaggaaagaggccaggcgcaguggcucaugccuguaaucccagcacuuugggaggccaaggcaggcaaaucaccugaggucaggaguuugagaccagcauggccaacguggugaaaccccgugccuacuaaaaauacaaaaauuagcugggcaugguggcucaugccuguaauuccagcuacucaggaggcugagacaggagaaucgcuugaaccuaggagacggagguugcggugagccgauaucaugccacugcacucuagcgugggcgacaagagcgagacuccgucucaaaaaauuaaaaaaggaaagaaagaaaauaccauauacacuuuuuagaauuuuuguuaaagucguguaagcuucuguggcaaagggaggguuuuguuuugaacuuuuguaaggugucauguauucaguacaguuuucucguuaacauuugcauuuuuugguaugaaauaggauuaaacacucacagguaggugcucuguucauaauaggccaugguuuccaagauuguuuccugaacuuuuuguuccaguuuugggaugccaccaagugauaaguuuggguauuacauuuagaugaaaagguuaauuuuuuuuuuuuuuuuuuuuuuuuuuugagagucccgcucugucgcccaggcucacugcaaccuccgccucccggguucaaaugauucucuugccucagccuccugaguagcugggaugagaggcguccaccaccacgcccugcuaaauuuuuuuguauuuuuaguagagacagaguuucgccauguuggccaggcuggucuugaacuccuggccucaggugaccuauccgucucggccucccaaagugcuggaauuacaggcgugagccaccgugccuggccaaaagguuaauuuuuaaugagaaagccaauauguauuuccuaacuaguuccccuucccugggaacagaacacaguguuauucuggaauguuauuuggaaaauauuauaauuuauuguuguggcuugaucaggauguauccaagaaaaacuguccuaugaagugugaugcuuuuauccucguauaacuuauuuccucugucaaauuucugccuuggcacugccauaucaccccuucauaacucauaaaucacccacagucaaucuuaguugacauaaacaguucgcuaaugguaggaauucauguuuuaaguagauauacuauucuuaagcauauuuucaguucaaaaccugacugauauuuuggccugagacaucaauaaaauauugugaaaguagagagcauagaaaaaaggggagcuaacucuuuacaaaacuguaugcuggcccuuacagcagcuagaaugaaauguugucacucucacuuccauaaacuugccaauugcuguuuuucuuucucuguagugaaguaagaacucugcuagagaggaaauggcugcuucaucaucauccuccucagcugguggggucaguggaaguucugucacuggaucugguuucagugucucagaccuugccccaccacggaaagcccuuuucaccuaccccaaaggagcuggagagauguuagaaggugaucucaugcugcuuucugaauaauuggauucagaucugcaaugcauauuaauuguaaagaagcuauuaaguggauuaaagaugaguuugcccugauuucagcuccacauuucauuucuuguccccaucucaaaauaguaucuuuaaaaacaagucuugcuccagaaucagaauuuuggagcugaaaaggacuuuggaaaucaaugaagucaucuagaguuauuuagauccagaaaaguuaagugauuugaccagguuaaaggcagagucagggcugggcacgguggcucacuccuguuaucccagcacuuugggagacugaggcagguggaucacuugaggccaagaguuugagagcagccuggccaacauggugaaaccccauuucuacuaaaaauacaaaaauuagccgggcauggugguaggcgccuguaaucccggcuacuggggaggcugaggcaggagaaucacuugaaccugggagguagaaguugccaugugccgagaucucgccacugcacuccagccugggugacagaaugagacucugucucaaaaaaaaaaaaaaacgcagaggcagcacugaauccaggaauucucuugaccuccuacuccaguuugcuuuauccuggcaccugucuaccucccaugguaguagguuugauguauuuuuuucuagggugauuaaucuacggauagauucacccugucagaaagguucuaagagggaauaaaagcuaauacauugcccuuuugugugaacaugacuccugacccacugcagcaugaugccgugugguucuuauagcaccaaagccagauuugcaucaaaucauucaccaucuuguucagcaucauuggcugacuggcuggccaagaucaggguacaggcuguaagcaugucauuugaagagcaaagagguuacuuaaaaugcacauuucuggccaggcacuguagcucaugccuguaauucuagcacuuugggaggccaaggcggguggaucaccugaggucaggaguucgagaccagccugcccaacauggugaaaccccaucucuacuaaaaauacaaaaacuagcugggcaugguggcgaugucuguaaucccagcuaaucgggaggcugaggcaggagaaucacuugaacccagaaggcagagguuuuagugagccaauauugugccacugcacuccagccugggugacagagcaagacucugucucaaaaauauauauaaauaaauaaauaaaaugcauauuucugggcccaccuuagaguuucugaauuagucuaggguguagcucaggaguccauuuuuuaccagcauccaggcccuucucaugaaggcagucuuccauauuuugaaaaacauugggaccaggagugguggcucaaaccuaaaauuucagcauuuugggaagccaaggcaugaggauuguuugagcccaggaguucaagguugcauugagccaugaucaugccauggcacuccagccugggugacagaaugagacucugucucaaaaaauaguaauaauaaauuuuuaaaaagcacugggaggccaggcgcaguaacucacgccuguaaucccagcacuucuggaggccaaggcaggcagaucacaaggucaggagauugagaccaucuuggcuaacauggugaaaccccgucucuacuaaaaauacaaaaaaauuagcuggaugugguggcgcaugccuguaguccagcuacucaggaggcugaggcaggagaaucacuugaaucugggaggcagagguugcggugagcagauaucaugccacuguacuccaggcuggugacagagcaagacucugucucaaaaaaaaaaagcaaaaaaaaagcuuuggggaauaaccuauuaaggauucaaaauuuacuugauucuaguauuuuagugcuuaauuauauauugaucuuuuuuccuuuaaguguugcaauuuuuuuuuuuuuuugagacagagucucgcucuguugcccaggcuguagugcaguggcucgaucuuggcucacuacaaccucugccucccggguucaagugauucuccugccccagccucccaagcagcugggauuacaggugcccaccaccacaccuggcuaauuuuuuuaauauuuuuaauagaggcaggguuucgccauguugcccaggcugagcuugaacuccugaccucaaaugaucugcccaccucagccucccaaagugcuaugauuacaggcaugaaccaccgcaccuggccuuaauauuucaaauuuacacaacuauauuuuaaaacuaaucuaggaauaucugugagaaagauacaaacuauaggccaggcauagugacucacaccuguaaucccagcacuuugggaggcugaggcaggcagauugcuugaacccaggaguuugagaccagccugggcaacaugacgaaauccugucucuagaaaaaauagaaaauuagcugggugugguggcacguggcuguagucccagcuacuuaggaaggugaggugggagguucaccugagccugggagguggaggcugcagugagcugugaucgcaucacugcauucgagccugggugauggagaccuugucucaaaaaaaaaaaaagaaaagaaaagauacaaacuauaguuggccuugggggugaugaauaaucagaaauaauaaaaagaguuacggguuaagcccaaaaucauuugugacaggaaaccacggggggacucugggaccauagagcucccuaggauugguuuggguuaugacuaguggugagguagaugaccagguagcauauguaauuagugauacauguacuucucucuuugccuuuuuauuuucuuuaauuguguuaacuaaauacucaaguuaguaucacugagucugguuagaaguagugaacaauuggggcccuguuaccauauuuggugcuaaaacuauauuaugacuucauuuauaugcagcaaagaccuaguauuaaggaaguuucccacaaaacaaaucaaaaaugggagacacuuaaauugcuuaaugaguuuuauagcagcagaagaauccauauucaacaauggagcucuaagauuaaagucauuuaaauucuagcuauaagaggaauuuaauacaggagguaccuccacagucucaaagcuaucagcauucuuugucaguauacaucaaauuauguggagauauugaagaagaaaggcuucugagauuagucugaauguugauguucuaacgaguuauagaucuauccauuuuuauuccaucucaauaugcuucauggagaaauguguuguguuucuguuguaggauacauuuauauuaaguauaaauacacagugcacaguuuugauuguguuucuuacauuucaaguuuuaccaauaaucuuaaaucuuaaaaagauuaagauaaucuuuaaaaaucuaaaaucuuaagaauauaaagaguauuacacuuaaagacugaaaaauaauguagagauggcaaccccuaaacccauuuaauauucuuggucaaaucaagaauauuaaauugagaagaguacucugaaauguaaggauguuggauuuggaagcauuuucuaccauguuuauaggugauacuauucuauuauacaauaaaucuaacacacauguaccugaccaauaauaguuuaauagaauaugaaaauagaggccgggcacggugccucacgccuguaaucccagcacuuugggaggccgaggugggcggaucaccugaggucaggaguucgagaccagccugaccaauauggugaaaccccaccucuacuaaaaauacaaaaaaaaaaaaaaaaaggcaucguggugugugccuauagucccagcuacucaggaggcugagagaauugcuugaacccaggaggcggagguugcagugagccgagaucaugccacugccccccagccugggcgacagagcgagacuugguuuaaaaaaaaaaaaaaaggauaugaaaauagagcaggaaggguugccugucaagaguaaggaacaaaagcaguuaggaaucaaggauggaugcuguuuuuaaucucaaaagguucaacuugauguuacauccuugugagucuaggauaguaaacccaaaucaccuguaguuaaccuugugaauuaacuuuuuugugccucugcucucugauaacagacaccucacauaagcagcauacagcaguuugcagcauucuccugcccuuggccaaaauuguccucacccaguuauuacugagcacauuagaaacugccuuccagcccaucaguggcuguauuuuagagacauuguagccacugaaguauaaauuaucuggcauugucuaauugccuacugugagguaauauucuuuuuaauguauuuguuaccauccuuauuuauuggaguuggcuaugguguuagauuuggguaauuuacuaaacuuuucccuguuuaugaccugugcuugucccugacaaggaaagcugauguauugcuaccugcuguguuacaaaggguuugauuacaguuucuaaauggaagagauugcccccagcugacuccguucuggagcaauuccaggcuuuagacugguacugauaccacaucuaauaggauguggcuaagaagcaauuggacuuggacguuaauagggagcugcaaaucagcaaaaguguguuccacaggcauauagugugguggagugaaaugcagagguuccuuuuugaaaguuuagcuuauauccuuuugcuuugaaguucauuaccaaggaaaauaugcaaauaucacaacuuaacuauuuuauccuaauggugccugugauuaaaugcaagugagagguggcacuuucaggagcuuccauauacaucuuggccugauccuuauagccuauaauucccacugccuuguguguaauccuaaaguucaggaucaaaccaucugggagguaaacucuaauugucuaugcuuuccucuuucuaaaauaaaauaugaguuauaauuggacuuuuuaagcaagaauaugaauaggauaaugacugcugacauucaaaccccuuuuuuuuuugagacugaguuugaauuuacagaauguaacacugucucugaagaauacaaaaaguauacaucccaauaauuauacuuucauuuuuuucuuuuucucuuuuuuuuuuuuuuuugaucacuuugaagaugauauuggaaggaugcccucuugguuauauauucaagcucuuuggauacaguaucuauaguuguuuuuuuuuuuaauugguuauugugacuucugaaauaagguuuccuuugugugaaacucagcaugaggccagaauguguuaguccugucugcuugccauguaauaccuggccaacacaacaacccaugauugaugggugaaugcuugaggccuaguagugcuaacgugaaguacugccugaaaaaggacagcuguguccucucuccccguuuguuuuaggauuuucgcaauaagguacaucccccaaaugguuucugcuaccuuuuuaaaaaucaaauguuucuacgugagcuguaaauuuuugagaauauguuuugcuguaucagcccuugccugacaaggaauaacaugaacuagcuuauguuucaugaucaucuuccaagugcuguggcaacugaguuggccacuucuuguuggcaguucuuggcaccaguacaauucuagguucugaacuugcaccauacucuuaucgucauccaaauugcaguguuuugguucaguuggaaaaucaagguuacaguuugcguucacagaaugaaauuucccagcaguguucugugauugucagagugauguaauuugauauauuaaaaaucaacaauuuuuuccucagcuuuguuuuuuagacugaaaaugauuuggaguuuuggugaaccuuuauauuuugacacuacaggagccagccacaaggccaaaugugucagcugccaguguuugcuugacauacaggagaacauuaaggaacucucagguugggaggagggaaguguugaccaggacaucagacggagguuucuuguuuuuguuuuuuuaaacacuauuuuuaaacucuuaaguagagggacuauuuuaauauucuagguauagaauaaauagcuuuuauaacagucuuaguucuaaaugaagcagaacccgucuuuguaaacacugagaacuagacccugaauguacaagcagggaaaagaauagacaaguuuacuugguuuaucagaagccauaaaaccuuuagagcagauuaaaaccuuuucuccuuuuguuuguagauggcucugagagauuccucugcgaaucuguuuuuagcuaucaaguggcauccacgcuuaaacaggugaaacaugguaagcacaugaguguugcguacuugacugugagaauaaauuugcuaggggguggaugaggcugugacaaaaauccccaaacucagcaaggcuauuuuaguggacuuccuaaauuaaagaacauucuaggucuuaaucuagucauaauguccacauugaggcuuaagguuggggccgagugcaguggcucacguuuguaaucccagcacuuugggaggcugaggcggguggaucacuugaggucaggaguuugagaccagccuggccaacauggugaaacugcaucucuacaaagaaaaaauuagucaggcaugguggcgcauaccuguagucccagcuacuugggaggcugaggugggaagaucacuugagcccgggagguugaggcugcaaugagccggaaucacagcacugcacucuagccugugcaacagagacccugucugaaaaacaaaaaaaguugguccuccagggagucagugcuuccugcuccucuuguguuacuuuuuccucuccugucugaaaccuccuuuuacuguuguccuccacugguuaccaucaucaucuucaaguauuuguacgauaccuccuggucugucuauacucuaacauccugauaacacuuuuucuguuacauuaggccucaccaggccuucauuucugcaucaacaaacuguguucccccuccagaccauuucuccauugaaacuuuauguagggggaaaagcuguaauugccucuaacccuaggauuuuaguccacaaaucacuauggcauagaggaugaguacuuuuuuuaggaacagagcacauccaggccgggugcaguagcucaugccucuaaucccagcacguugggaggcugaagcaggaagacugcuugagcccaggaguucaagacugaccugggcaacauggugaaaccccauaucuaaaaaaagaaaauacaaaaauuaguggagaaugguggugcaugccuguggucccagcuacgugggaggcugaguugggacgaucgcuucagcccaggaggcauacuccagccuuggugacagagugagacccugucucuggaaaaaaauagggcacauccugaaaaugugaucauuuuauuuuaaaaugacuuuuauuuuuugagacggagucucucacugucacccgggcuggagugcaauggcaugaucgcggcucacugcaaccuuugccuccuggguucaagugauucuccuuccucagccucacaaauagcugggacuacaggugcacgccaccacgcccagcuaauuuuuguauuuuuaguagagaugggguuucaccauguuggccaggauggucuugaucucuugaccuugugauccgccugccuuggcaucccaaagugcuuggauuacaggcaugagccacugcgcccagccuuucuucuuuuaacauuagaagaaacuuccaacuuaaaaaaaaaaaaauaggccgggcacgguggcucaugccuauaaucccaacaauuugggaggcugacacgggcggaucaccugaggucgggaguucgagacuggccugaccaacauggagaaaccccaucucuacuaaaaauacaaaauuagccaggcaugguggcauaugccuguaauuccagcuacucgggaggcugaggcagcagaaucgcuuggacccaggagacagagguugcagugagcugagaucacaccauugcacuccagccugggcaauaagggugaaacucugucucaaaaaaaaaaaaaaaaaaaaaaaaaaauuaagcuucugaccagcauagaauaagaccccauuaugagaauuuugagggucgggcacaguggcucacgucuguaaucccagcacuuugggaggcugaggcaggcagaucaccugaggucaggaguucgagacuagccuggccaacauggugaaaccccaucucuacaaaaauaaaaaacuuagcugggcacgauggcgggugccuguagucccagcuacucaggaggcugaggcgggagaaucacuugaacccacgaggcagagguuucagugagccgagaucgcgccauugcacugcagccugggcaacaaagcaagacuccauuccccacccccaccccaccccccaaaaaaagagagagaaucuugaggagaaaaaaaaauccaucuagaaauuuuuuuuuuuugagacggauucucacucugucaccaggcuggaaugcaguggcacgaucucggcucacugcaaccucugccuccaggguucaagcgauucuccugccucagccucccgaguagcugggacuacaggcgcaugccaccacguccagcuaauuuuuuuuguauuuuuauagagaugggguuucaccauauuggccaggauggucucgaucucuugaccucgugauccgcccgccucggccucccaaagugcugggauuauaggcgugauccaccacacccggccuagaaauuauuuuuauaccagucaucaucuugguggcugguggcagucucuuggguaauacguuguugcauaauauucuuuccuugacuccuuacagaucagcaaguugcucggauggaaaaacuagcugguuugguagaagagcuggaggcugacgaguggcgguuuaagcccaucgagcagcugcugggauucacccccucuucagguugauacugccuggauggucaccucuggugcgcagcaagugcaaagccagugggggacuuucucacagcuuacauagccauccagagauccacagcuacgucacugaauuguuaaugcacauuuguacuugguuucucuguaucuauucacaggcaacaaauacuuauaugugugaucuuucagggaauguuuuguuuauuuguuuuuaaaaguauugggaaucagauuaagacaaucaguuucagagaaccaggagguuugggguuaagagauacucaaaaauuuucacaagccaaguagggcauauaucagauuuggccaacugaauggcgucuguccugucauccauauggugccuggaaauauuuaccagucaaggucaaggucagcaucugugguuaaaaauauagcauucugaccuaaaaaaguuauuuugcagaugaauguguuuucaacucaggaccuauccaaaugaggaauuuuuaaauauucuuuuuuuuuuccuauuuuuagacaucaauucuauagauucugacuuuuucuaaccucuuauagacaugccaaaugcuggcaaaaagaagugcuuuuuggauauggcagcacuuguaaaaauaaagcaguaagcaaaauccuuuuaaacacagaaauccugaguucuucucauugguggacucaagcaauucuguagcaaauaaauccuuugaaagagcuccaaauugguggcauuauccuuucaaaaucucagggauuugggaugaagugaagaggucaaauuacuuuuuagaagaagggaaucuaaaaaccaucucuccuaaacaaaugguagacuggcuuuacuuaagggauauuugucuuuauaggaguacauaaauuuaucuuaaugauauuuaaguaguuuuuuuuuuuuuuugagacgaaguuuugcucuuguugcccaggcuguaucgcaauggcgcgaucucugcucacugcaacauccaccucccagguucaagcaauucuccugccucagccucccaaguagcugggauuacaggcacccgccaccacacccagcuaauuuuuuguauauuuaguagagacgggguuucaccauguugaccaggcuagucucgaacuucugaccucaggugauccaccugccucagccucccaaauugcugggauuacaggcgugagccaccuugcccagccaauuuuuuuuuaaagagacauggucuugcuauguugcccagguuggucuugaacuccuggccucaagagauccccccaaccuuggccuccaaagugcugggauuacaggcaugagccaccgcgccuggccucaaguaaguuuuuauaccaugauaggggaaaaccuggaaggcuaagagaugugcuguuuuccuucaugggaccccacuuuccacaguaaacaacugguauaaucauuuauuacguuguaugcaaauuuugccuuagacaacauuugucugguuccuuauuaauaacuugcaucugaucugcuuagaguugcuuaauuauaaguaaauauaaucccaguagcauuuagccuuaaucucaagaguucaaaauguuuaacacauucuaccugacgggagguggugaccucauucagucgguuaagagccugagcccugugaaguuaaacaccugcucauggucacauagcccaggcagaagaaaaucucggacuuggaauagaucccaguugccugauaauucaucucauuauugccucuaaagcaaauuggagacugggcacaguggcucccaccuuuaaucccagcaccuggggaggcugaggugaguggaucacuagaggucaggaguucaagaccagucuggccgacauggugaaacucagucucuauugaaaauacaaaaauuagcucagugugguggcacacacuuguaaucccagcuacucaggaggcugaggcaugagaaucgcuuaaacccaggaggcggagguugcagugagcugagaucacaccauugcacucuagucugggugacagagcgagacucugucucaaaaaaaaaaaaauaaagccgggcgugguggcucacgccuguaaucccggcacuuugggaggcugaggcaggcggauugccugagaucgggaguucgagaccagccuggccaacauggugaaaccuugucucuacuaaaacuacaaaaaaaauuagccaggcgugguggcgggcgccuguaaucccagcuacucaggaggcugaggcagcagaaucguuugaacccgggaggcggagguugcagugaguggagaucgugccugugugcuccagccugagcaacaagagcgaaacugucucaaaaaaaagaagaaaauaaauaaauaaaaaucagagcacaagaaguaccaguccaccaacucacauuuucuauauuaauaauucuuaacuaaaagaaguuccauauucgacagcauuuuaguuuuuuaauaguacuuauuagcaucaaccaucuugauaaucaccaagggaaaaauuaaaaauaccuagacugcaauaaaccuuuaaauuggauuuucagugagaauuuagaagcaaucacuaccuuucucguuucauuuguguaaccaugcagcauaggcacuguguuacaucaucuuuacgcuuugguauuugaacuuauuacagaauuuuuucucuaaauuggauguuucuuuauaugaccuuggaaacugaagugaucuuagcauuaaacaaaaaugcuuuuu

SEQ ID NO: 16260 - RNA, 12726 nt, Homo sapiens
agcaccuagcagagcugaaucaccagaagcagcuggaguccaauaagaucccagagcuggacaugacugaggugguggcccccuucauggccaacaucccucuccuccucuacccucaggacggcccccgcagcaagccccagccaaagguaagacaacgggcuggccacugaggacccauuuuugguugcacuggagaugagagaccaaagggacagagagggcacgugugguucuuaaacuggggcuuaucccugugcgugacucugcagucacaugagccagccuuuaaaugguuguaccaugaaguuucuaaagaaugggauauuuaaaauaugcaaagauuaauccccuuuaaaaaaauuuacuucuuuuauuuuugagacagggucucguucugucacccaagcuggagugcaguggugugaucaugguucacugcagccucaaccucugaggcuuaagugauccucccaccuuagccuccuaaguagcugggaguacaaaugcacaccaccacaccuggcuaauuuuuguauuuuuuguuuugccauguugcucagacuggucucaaacuccuggguucaagcgaucugccugccucggcuucccaaagugcugggauuacaggugugagccacugugccuggccaaccuuuuuauuuauacuaaacccccuuuuuauaccauacuguuacuauaaugaacacuuaaucgauuuuaagccuaucaguaauuugagagccuguaaagcaucuuaggaacuggucagcaagugcccccuaaugcugcagcccugaguauauaaggacguuuuccuaggaauuugaguccucuuaaguugcaaaccuaacugccucuucuguaggauaauggggacguuugccaggacugcauucagauggugacugacauccagacugcuguacggaccaacuccaccuuuguccaggccuugguggaacaugucaaggaggagugugaccgccugggcccuggcauggccgacauagugagccuuguguccuugugcauuggggauguucugggccugggaguugggcuguggaggcuggaguagggcguucagacaacauccuucucuuuuuucccagaaagcagcuugaauagguagugcagacuugaaucuauuuugguuaauggcaucuggauauguaacaaaacugggaacaaaaaguaggagacuguuucugggaagauuuuguuuccugccaggcacccuguguauuaggaacacuguagaaauacuuuuugcccccauuuuuuuuuuuuuuuuuugagacugaguguugcucuguugcccaggcuggagugcaguggcgugaucucagcucacugcaaccucuaccucauggguuccagggauucuccugccuuagccucccgaguagcugggauuacaggugugugcaaucacgcccagcuaauuuuuguauuuuuaguagagaugggguuucaccguguuugucaggcuggucucaaacuccugaucucaagugaucugcccgcuucagccucccaaagugcuaggauuacaggcgugagucucugcgcccggccuuuaccccauuuuuuucuuuucuuuucuuuuuuuuuuuucuuuuuugagacggagucucgcucugucgcccaggcugaaaugcaguggcgcgaucucggcucacugcaagcuccgccucccggguucacgccauucuccugccucagccuccugaguagcugggacuacaagugcccgccaccaugcccggcuaauuauuuuuguauuuuuuaguggagacgggguuucacuguguuagccaggauggucucgaucuccugaccucaugauccgccugccucggccucccaaagugcugggauuacaggcgugagccaccgcgcccggccauuuaccccauuuuugaaagcuuggcuaauguaugugacacugagaauuccagcugugcuccugcagcaagcauggucgcugaccaugguucaccuggaagccucccuuaguccugugggcucagaaacucauuuucuuggccccuuacuuagaucguuucauucugggacccuauuccaagauuauuaaucacacucagguggauguguaaaaccaaaaugccauuuuuaguaccugacaacugaagaaaccugcuagacuggcagcugagaagcugguuguaauuacucuguccuuugggaucuagcgaggcuuuuuggguggaguggccggcucuaggagaugaggccuucuccauuuuuuuuuuuuucuugagacaggguuuagcucugucacccaggcuggagugcgguggcacaaucauagcucacugcagccuuuaccuccugggcucaaacaauccucuucucagccucccaaguagcugggauuacaggagugagccaccacgcccagcugaggguuucucucugacuuuccguuaggaauguuaaucaggugaacauucauucauuuugaaagccuaggaauccuguagccucauuuuaagugucuuugcauaacaccauuuaaacagguuucccaguugaacccucucugagaggcuguaucauguuaccuuugguccucucucuguagaagcuccccaaauacaaggagcaauucuguggagucuacuggaaguaucuagauugucugaaaauaagcaguuaaaaaucauuauaacuugacucuacuggauuuaagcuuuauaaugccaucugagauuguguaaauggcuuugaaagguaagcuccaguuccuaagcaguguaucuccuagcugccuucucuccaaauugccacugaauaguugcugugugauccuggggcacgugagguuauaagauaaaggagacaggaggguggaaucuuuaaggucccuuaagaaacauuuucaaaacgucuuuugcacacauuuccuauaaaugauagaguaaccaaauugucauuuucaucuuauuaaagcuggcccagagcagacauucauaaaauucuacuuuagaaacuugcuugauagucaccaguugacacuguuggaaaugcugggggguuuuuguugguuggguuuuggugcauuguugcagugauuuguuuagcaaucuguuucucucuccucagugcaagaacuauaucagccaguauucugaaauugcuauccagaugaugaugcacaugguagguggcacggaggccccuuguuagcauuuuucuuuguuuuucagguuucgucauuucuaggaauuuugaaaauuauaugguuuaguuucccuuuuuuaccuuagagugcugaauugggcuaaaucgaccccucuggcuaggagacucuccacuugcaaucucaguaccuccccuguuacgggagaggcaggcugaagcaucuugaucccaggacugcccugguggcuuccuggcaauuuguuugccucugcccguucaggccagccaucagguuucuaggucuggcuuuaacccugggaucuguagaagucaagugcucucuaacuaagccaggccugagaauggcuguguugccaccugagucgggggaauacugccucccggaguuugucccgugcauggcagcagcguccgcugaagcugcugcuugagcugguaacuccugagcuggcuuuggaugcauucagguggcagggggcauuccuucauuagaaucaagaauacccauucaggaaaugagcucgcuaguccacgcagagcagggcggccugcucacguugggaacgggcacugccuccuuagaucugauuggcagggcugaguggguggggggcaccuuuucccugucugucaugcuuucugacuacuugagauugacauaccagcguuugaguuuguucucugauccaggggucagcaaacuggcccaucauguuuuguacuuaaaggguauuuuuuuggaacacagcgacgccuguuuugugcuacagcagcacaguugaguaguugcagccagaucuuauggccaaggagccugaaagauugacucucugaccugcuguaaccacucaagcaagcugaggaggaguaguuuauuugggauuauuacucacacccuaccauguucuaaaaacaguuaaaaggcagcuuacagagacaugcaccugaaguagguaaagauaagcauugacgggauuuaaucucgugaaguacuuccucauagcuaacuuaaaauauuuuucucauuauaaaaguuauacuguguagaaauguguugaaaauauggacaauacuucccacacaaaaaucauuuggaguuucagaauauaucaacggguucauauauacuaccuuguacuuuguaguuugcauuuuuugccuaaaaauauguuggccauugaauauucuuguacaaaugacuaaaugcuugcagaauaaucaccuguguacauagaagagaauuuacauaauugguccccgguggccggauguaucuagguuguuuucagguuugccuuugggaagaugaauauccuuauagccaaaugcauacauauaugcauaucccugccuuuccccuuauuauagagaacuaaagcuggaacugcugaauggaagcaugaggcuuuggauacauuguuaaauuggccuuccaggcugccauuuggccaccugcaguagauugcccuaggaucccuuaccccucagggaucccuuaccccccuuacuugggcagcccugugucuuguucuguggugcugcuggucacuaaccugugggaaagccuugugggcccggggccagugugggcuccugaguauggagacccuucaucaagcauuuucuggggcucuugcuacacaguguuuugagugugauuuaguguguaagaccuggagauggugcacacagagcaggacagcccccaaauggucuaucccugcagggccaggaaagcuuucagggcccccuuguccgcaagauagcaggaacaagguagguugcuaagaucugauugcaagagcauuuccccugaaccucuugggacauccuuacaccugguuaacugcuugauuguuguuuuaauuuuucuuaacuguuguguccuuuccuuucucuuauuuucaccuccgauuuccuguuuuuuuguucaacagcaggaucagguaugugucggggaaucugcuugcaguaguggucugcugcuuccucuaguuacuuugcuuuuuuuuuuuuuggguauggcaugauuagcucugacagauacaaggaaugguuacgagaggcaggcucccucucuguuaauaggcuggggagggcuucugcaucucuccccuguaauucagcccuugagguuuugggggucucaucuccccuucgggguccaguaaaaugaagccagcagagccuugugcucuggucacaguccacauacagcauacguacaugcaggccaccagugugacaauggggaaccauggguggcccaggaggugccucagccuccuucaacguaggccaguuaggaaguccaguguaggucuggcuuccccagggcaccuugugucugucacaacgcaaguaggcauugcaugucuuuagugcuguuuuucauaaacacagaaaugcuucugcugcaugagcaaacauuugcagacagccagcagacuguuccuggcuguuggauccagagaauuggaaacaaucucuugauuguggcuucugccccucuggguaacaggguccuuugggaucuagagccacaucagauggcaugcuacaagaaccaaaugcccaguccauacuugcucugagccaguguccuucggggccguccugaacacugccaccucugagcguuggcauccaucugcuaggauuagcauuggagcuuuuuuugaagguauuuugaagucuaaugggagaggacuuugguugaaauaccugaauuuuuaccuaggccuccucaaggaguuggaacaaagcugaucgaggcagaagcagcccuauaccuccugaauauuggcgucuuuuuuuuuuuucuaaaaagcuugcuguaucuucagcugcguucuuauuauuuauuuauuuauuuauuuauuuuucauucuuaagguguggcagagacaggguauuugggauauacuuuucagacucccccggucuuauuaauucucgaaccuucuugauauuaaaacaagaugagccauagucauggucuagcucuuuucccuuaacagguccuguuuuuagcacuuuuguuccugcugcuuuaggguuuggugcuggaaggcaaaugcacucaggcucagagcuaguugcugguugcauuuauuuccacaauauacagagucuauacacuugucucacucuuggccaucagagugucauggucaggaugucuagacuaucuagugcucuguguuuggugucuaaauggugaaaggggaucaaucuggagaccuuguggcuuaaaaugauucauccauuuggcggguuggguuuucaugugcacugugugcagcuugaacauagaaugugguuuuuuaaaaagccagcauuuccccuuaaugcaucauuuuaaaugguccugccgcugaaaaaucuggugugguuuuauuucuaacacauuuggcuuucuguuaguuuaugggcaugguaguucccccucuagaaaaaagcauagcuuaguuccuaccuagagugaccugaaaagacacauucuagaacagaccagguguccuuggagauguggaaggugcuggggagucucccucgugguggcccuggauggagacucuguuugauguuccuuaggagcuuuguguggucuccuccccgagauguaacuggcacauaugcacugcuucagacacgagcccuuuaacauggaaacuggaaucugccccguugugggagggggagagggagguagccuugaccugggcccagggugcuguccagcucccuguccucuggcuggauugggacugaggagcagugggcguaggcuugcugcugacugguuguucugugcucucuucagcaacccaaggagaucugugcgcugguuggguucugugaugaggugaaagagaugcccaugcagacucugguccccgccaaaguggccuccaagaaugucaucccugcccuggaacugguggagcccauuaagguaccuggugucacuuuguguccuggucagggcugugcaaugccacacuacucccugcugugucacaucacaucuuacgagucacuuguuucuuucgguucccugccuggcuccuaaaggucuuugaguuugugaucacugguuuauccuauccccuauacuaaugcagcccccgacccugaguucuuuugaaaacauuuuauuuccuugguuguaaacccuaauguucgugggaucauuagccuguguauuuucagcaugccauucaaaggugacuuugcagugccuggcuucagccucaccuucucacaugcacugucuggguccuuccccauccuguggcccugacagacuggauguucccagcacaccccucagaguguacggaagccucacugggccugcagccuguauacuaaguacaugugggugucuauuuuauuuaacuaaaacaccucacuuggugaagauuagacuacuucaucccauaauaaauuuguauuuggcauuuauuaugggucaggcagcauguuaggggcuguggugaacagaugaugucauugugcccguggggcuuacauucuaguucuucaaggccugggcugugugaugccuuaacacguggcacauguacacgcuucuuguucuagaacaucccacggcacuugacugccagcuguuggucucucucugcugucuccucucugcaugugcagagugugugacccaggggccaggccgaagugucagcuggaauccaggaagcacugcuucuugccuuccucuccaccgggugcuccucagcuccagccugcugaccaaagugacggccagagaaagugaagaguuauagcucgcacuccaaccacaugugacuacuuaaauuuuaaugaaauaccauggagcaaaauuaaaaauucagccccuuggcuacaccagccacauugcaggugcucagugcacagguagcuggagcuuauaguggacagcagagauagagaacauuuccauugccacagaacauccucuguaacaguauugccuuauuaaagguggguuccagaagagcauucucaagugcuaaugagacaugggagacacacgagcagaccugaaguguguucaacauucugucuucuagauaguggaccgauagugagccccucacuuugcuuuugguccuucauccuccuccccaaaaugaacccugaaugaugaaaugauuguaaccgaacacaucaucaggacagcucuucgggguggggaagggacuuucugucuccugaacugugaauuccuggguuuuguuuuggugggguuagggggaggugggggugguagaggauuggggaagggggugaauguaaaaauagggaauuaacuuggauauuagaagccacacgccauuuggaauucaggaggcaguggcccuugaugugcuaacccacccuggucucuguguccccuuuccuuuaggggagcaagaccaagggcugugagucccagcauugaaaguacucuccuucuacucuuuccacagaagcacgaggucccagcaaagucugauguuuacugugaggugugugaauuccuggugaaggaggugaccaagcugauugacaacaacaagacugagguaugcuguccuccuggcagagggagggccucuccugcccccccgagccugaaugucccagugggaaagucccacaggagagagggcuuggcccagccuugacauguguacagccauguccccaucucguggaaggcaauccucaccagugggaccucuaggcuggcggggguccggggagguggacaccauugcccugcuuuguaguuugguaguuuuuuguggguggaaacggcacccaccauugacucauuuccuggccauguuaguauuuucagaaugucccccaacccuuguccggccucccgucuucucacacgauccucucguguguuucagaaagaaauacucgacgcuuuugacaaaaugugcucgaagcugccgaagucccugucggaagagugccaggaggugguggacacguacggcagcuccauccuguccauccugcuggaggaggucagcccugagcuggugugcagcaugcugcaccucugcucuggcacgcggcugccugcacugaccggugagcgcuggguguggugcgggagaggauggugccccucuugggucugggagggcccugccagcguugagcccgcugcccucuuauguaguucacgugacucagccaaaggacgguggcuucugcgaagugugcaagaagcugguggguuauuuggaucgcaaccuggagaaaaacagcaccaagcaggagauccuggcugcucuugagaaaggcugcagcuuccugccagacccuuaccagaagcagguacgccccgggcugggcugcgguaggccagcauggcagaaccugaugaaguaugccaaggcugggguacauuuugauggaaaaccagcuguuucugccuccgggcauggaguccaaugaaguuuuacuuggaggugauuuguuggcuuaagaugagccacugggggaagcaaccugaaguagagaggccaaauguagauagggugucuggaaagggaggccccaggacccagugggcugggaaugccaggagcucucagggaacaguguauccagggccugccuggccuuuugugccccacuaugcucggacacccccagagcuggaccuguguccccacuuuccuuuauagugugaucaguuuguggcagaguacgagcccgugcugaucgagauccugguggaggugauggauccuuccuucgugugcuuggugagccucacuggguggugugguccucucgggcagcuguaaccuggggggcugcagagacccggaaggguugcucugagacuuggccgugggguggagucucuggguucugcugcgggagagccaagaagguagggagccagccccccaagccccaucgcuuuccucagcaacccugauguucugaaagagcgugguggagcugugauccuagcuccuucuggaaacuguuuucuuaguuuugaaagcgauacaucgggcagcucucauucucccccuuucuucuuuccuuuucucaccauauagaaaauuggagccugccccucggcccauaagcccuuguugggaacugagaaguguauauggggcccaagcuacuggugccagaacacagagacagcagcccagugcaaugugaguagcucagcagacagugucaccagccugucuugcccugggguagccugugugagaauccugcuuuaaugggaacccagugaucaacucuccacccugcuuuuauguuaucagaaagcugaggcccagagaggugguuaggcuuacucaugguccccuagaaaagacagggugaacuacacucuuguagugaagggugggguggauuuuauuuauuuauuuuuuuuaguauuuuuuugcuucugcuuuguugcuuuugucuucauuucccuugugacagugucagacuuguacaaggucacuccagggauuguacaaggucugugggauucauugcccagagcuuugcccagguccugucccccgggaacauguuugcccuugcugaagccgggcccgaguccucacucaaggcccugagaacuggccccugcccagcagcccuagggcacuguggcccuggccuggccuggcagccaccaguugggugacuugugcugcuucccuggguggggauguuugguucggucccuguuacuuaauguugcuuugugcaacuuuuccuuccucaccgggcuucccugugaccaugucaguggcgguugugucauuucggaccacugcagggaggggcagggggcccccauucuggccauguccagcucuuuccuccagcuaggcuccagcccaucuccaccgccagccccaccccacagcugguucugcugcuguccuggggaaaugugggccugcuucucaaggcccgagcugguguguagccuaacucaggcaaggagguucugccugggaguuagugugcaggcugcuagcaggacgcugggugccgggugcagguagaugaaggguccugagcccugccugcguggguacucaucugcaaacugcugcaggcaucugcugcucuggacucgugccuuagaaguucccaaaacucugauggccacguguucccuguuuuuaagugagauccuguccugggucuucagcaucuggugccauccagcugaccuaggacaagagaacagguccuguuuuggggugauaucugauacauugaugggccgggaacggaguuuuucauccgaagacuaaacucagcuuccucucuccuaccaggcugucgagcauugcaaacgccauguguggaacuaggaggaggaauauuccaucuuggcagaaaccacagcauugguuuuuuucuacuugugugucugggggaaugaacgcacagaucuguuugacuuuguuauaaaaauagggcucccccaccucccccauuucuguguccuuuauuguagcauugcugucugcaagggagccccuagccccuggcagacauagcugcuucagugccccuuuucucucugcuagauggauguugaugcacuggaggucuuuuagccugcccuugcauggcgccugcuggaggaggagagagcucugcuggcaugagccacaguuucuugacuggaggccaucaacccucuugguugaggccuuguucugagcccugacaugugcuugggcacuggugggccugggcuucugagguggccuccugcccugaucagggacccuccccgcuuuccugggccucucaguugaacaaagcagcaaaacaaaggcaguuuuauaugaaagauuagaagccuggaauaaucaggcuuuuuaaaugauguaauucccacuguaauagcauagggauuuuggaagcagcugcugguggcuugggacaucaguggggccaaggguucucugucccugguucaacugugauuuggcuuucccgugucuuuccuggugaugccuuguuugggguucuguggguuugggugggaagagggccaucugccugaauguaaccugcuagcucuccgaaggcccugcgggccuggcuugugugagcguguggacagugguggccgcgcugugccugcucguguugccuacaugucccuggcuguugaggcgcugcuucagccugcaccccucccuugucucauagaugcuccuuuugaccuuuucaaauaaauauggauggcgagcuccuaggccucuggcuuccugguagagggcggcaugccgaagggucugcuggguguggauuggaugcugggguguggggguuggaagcugucuguggcccacuugggcacccacgcuucuguccacuucugguugccaggagacagcaagcaaagccagcaggacaugaaguugcuauuaaauggacuucgugauuuuuguuuugcacuaaaguuucugugauuuaacaauaaaauucuguuagcca

SEQ ID NO: 16261 - RNA, 6911 nt, Homo sapiens
gauucugggggccgccgaccaagagcccagacccaaucaucuacaggaacggauguggcaggagagggcacugggcacuccuggccugccauggcagaccgccaacccucugcagggacagccagggucucacacggacaauggcuauacaagggccugaacugcagggugaccacauuccagcuacaaaguggaucccccuggaaucuuggugaccacaggcuguguugaugucucuagaggguggacaggcccugcccagggagaggggggcagaccugacuguauuggugcagggcccagaugaagaggaagcugcccacucagcugcuggaaagaagcccacgccaggcucuccucucccucagcagucuuuccucucugcugaacuagcucgggggaccucaaaguaccucacaaugagcacuaccacuuucuggccaugucguuuugggcacugugggccucagcuuccucaucccuacaaaggagaucaucucacccagggggagguggggcgaggucacaugucauaguaacagacacagggucugggccacggccgacggacgccacgcaggaagggagucacagggagggccugagacagacugugagggaaugccacgcccccccauguccucuccccacugcacuccagggggcugggguuggccuaggaagaagggccucaggccuccacaaagccgaccagcaagcugggccucugugcagccucucugagcaccaggucgugugugggcaucucacuggcagccagggacugcuaggcaagucucaccuccuucuguggugacucuaggccagccccacauucccuccaggcuguaaucacauaggaggugauacacaagauaacuaacaggcugcuauuaucucuauuguuagaaguuuauuauuacuguuagccuggccuucacccacucuaauggcccaggugcaccaugaugauccugcguccuugggcggcacuuagaagcacugggccuccacuugggcaaugguaaugggaggcucuuuccaguuccgacagccugugauuuaaagauagagaucuccuggggagaugccaggccaaggagaagacgggccuucugucguggugccaguuacuacuguuauuguucaaguacagcucagccucccagggacagagcuagaugugcccgauaagcacauuuccccucucucugcagccucccccugcucagauaauacauguguucaccagggccucuggcucacuccuggagcagacuagagcccuggagacagcacuaacccaggacacgagcuaguucucugacuggagagggcuacgcggcaguggggauauggggcauuugaggaggucuucaugugucuuuacaagccaggugccuguaggauguuucugcggggcucuugcugaagcuacucaguuacagacucucugggggggccuucggcacuggcaacccaccaagcuucucaggccugcuuaggcaaccucuccucuagcuaaagugaaucacagcuaacugagucucaagacaggagcccugggaggucuggagcuaggacaugaaacccagcugguugcuugacuucucuaagccucaguuuucuccucuguaaaaugggggccuaguucuugccuaaggaggcuuugaagaugaauagggucaauacaaguagagugaucugaccaguuccuggcauacauguaggcuaccaugaugauggacucucagacacaucaaguccaaaaacaacaacaacaacaaaauuauagaaucuuggauucgcaggcugcuaauuacaagaagcucagcaggccauccugaacuugcccuucaggcagggauuccuauuaaagucuucuucuuggcccuuggggacugguaccaaggggccugccccaucuucuucuaagggccgucaaaggaaccuuuugguuucucagccacaggcauucucaagcuagacagauggacagccagaaauaucagcuacgccucugcuguuccugcccccauccuccccucaggucuuuuagaaaugagaccgaguaguggagcgacagugggggaggaggagcaggcggcgggcagcugcugggccgggaggaaaucauugcugguagccucugcucagccgugacccuaacaggaagcgaucgugagggccccuugggaggcuggagucugaagacagggcgagggaugggguuuggaccuuccaggccucaucacccguguccacccugcuggcccugugcccacggccugugccuaucagaggcaggccacgggcaucaccacuauggcuaguccacccugagagccugccuuccuuccugggguuacugggguccccccuacugggagaagggguaucacgcucaagagguuacaugagaagaggaauugaaguauccuugguggugaguggcuggccugggccagugggcagaagccagaggaugcagauuugggccggacaccaacagcugcccaagucauccaaaaaaaugcagcaggccgcauggcagaagagugagcaugcccauggggggagggggcacagguuggcacacgagaagcgcggcucauaaucuccgggacucccuccugcagcagggcuucugagguggagaauggagagaccgugagggugggugggguagguggggagggaaggaaggcucagcaggaacagcagcuaacaugccaccuucccucacccgccuggagccccagcccagccuuuccugccuccaggcaccccacacugggcaccuguuuauuucuccaugagcccaaggccaguccccucacagaaugggcagccucccgagggcaggcccagggguuuaguauauauacagggucugccaaauccagaugugugugugcucacaugcagaucacaggagggaacccugugaagaugaccggaggaaucugggcuucagggucacccaggggcccucuggcaccagccaccauaugcucugcuuauaaucucuggggcucccacccauccagcaggggugugugcccacugcccgcccccguggaugcccugcucuugcacugcugaacagaggacuggggguggagugggcucuccagacugggccacugcagcuaagcaccagaagcuaaccucagcgcugggcagggccuggcauggaccuuuugacuaacaugcacagccucccaugaggcuggaacuauuagugauggggaaacagggcccaagagguuaagugaucagccagugacaugcaugaggagccccuaacugcucagucaggacgggcgacccucaucccacccacccgaacucgauggccacccucaggcccauucccucccugugccuggggccuccugccaccucaggcacccccucuucauaacgagguucuccuggggguggggcgucaccucuguuaauguuccuuuauagaaaauguuuccccuucccaaggccgcugcuaaaaccugccccacuacccccaaugccaucccaacgcaaguaagcccuggacacuaagguaucuacuagcugagagguuuucuggcacauugagggagaugauaagucagucuucccugggucacuggcacugugggggcagagguuggcuuaggguggcugggagacacgccacucaaaucugaacccacccucucuuccaccaucccaggacagcucaagggcagggaaaugaacaggguguuaccaggccuccauuucuaagucugagcaggcagaagccuuaacucccucgucuaaagccucuagggauuagccaggcaugauggugcacaccuguaguccuagcuacuagggaggcuggggcgggagaucauuugagcccaggaggucgaggcugcagugagcuaugauugcgccauugcacucaagccuggauaacagaacaagacccugucuuuaaaauaguaauaauaauuaagcuucugaggauauguauaagagagugaaaaugcugcccagguguguaaucccagcacuuugggaggccugaggcagacagaucaccugaggucaggaguucaagaccagccuggccaagauggugaaaccccaucucuacuaaaaauacaaaaaguagccgggccugguggcucaugccuguaaucccaacuacuugggaagcugaacccaggagguggagguggcaaugagcugagaucacgacucugagcuccagccugggugacagagugagacuaaaaaaaaauaaaugcaaauguaagcauggagucgaggccucagacguccagcagggccuaucgcuaaucagaaaccacaagacauucugagugacaggauugagaacaggagugagugugagcaacaaaacuuggggucacuggaaacuuugggaagaaaagagccacucuggagaagugggcccugggcagggugggcguuguggggauuuugccugacuuucaggacccuuugcacccuccagaacaguuuaccccugaggucuucgagcaaccccuuccuguggcuccaaaugguagggagacugguguuuccaacaggaaacgggcuuuccacccagggcaggggggcucccagcaccucuaguuuuuaaugaucacacuccuauuuauuuagcuucugaacagcuccagauuucugccugagggaguuacaggcuguugggcuauuuguggcgaaguuaaugaggcgacucaguggaagcugccuugucucccguccccuucugugggaagacacaggaagccccuugauccccaauuaccugccugacaggagccucuccccaccuuccucaucuuccccagcuccagguaccacaccucuucccccaggcucaccuggcucaucaccaaugagggaaauggacuggcugagguuuuaccauuuccacuugccuuaaggugagcaucaaauauuucuugagacagaauaaaggacuuacaaaguccuaguaaagaccacuucugcucccaguaaaacuaccuccuucccgauccuauagaggccacaggcuggagauggaggcaggaggcuuccaauacggacuucaccgcaccuccuucacacuaggugcugcaggaacaccuugcauaauaauaguuaaugcacucaggauugccagcuuugugcugaggacuucccguguauuuacuuauugacgucucacugcucuuacccccacuuuacagaugagagaacugaggucuuaagaggugaccccaagggcacauggucaguaagaggcagagccgaguuucagacccaggcuaaccaacuccaaaaaugcccaagcacugagugagacggcucucucucuaaaaucucauuuaaaccucauggagacguuaugggguagauugcuauuaauuccacuuugugguugaagacgaggcucacaugggcuaaacuguccaggaacacgugguuuggaagcagggaggguaguauuugaacccaugcuguugccagagcuuuuccacauaaacacgagucuuggugaccaggcaaacaggggucauuagggaacgugcacuugguccccagagugggccucugcucacaggcucuguggccuuugcuauuccacacccagccugggauccuagcuacccuccgcccaggcaggccuguuugcccaccaccugugcuuccugccucuucuccaaaccucugaauacccuggagcccccaucuacaccuccaccuccuccaggaagccuuccacaucccagccguggagcucacuccucugagcuggagaaaaugugggcguucucuucaggggcaugcaucuucucucauuccuaaguggaauuuugugagcuccuuggggguagguucuggguccccuuggagcgaggcacagagaagggaaugauaaauauggggguucacugcucucaggaccagggucccucuggccucuugagggcuucacuggaccuccccauccauucucccagaggagaagcagagcagacuuccuuugcacagagaggaaaccaaggcacagcuaauggcaagagccagggagucuccagugggggcucgggcagggaagcccagcacccaugaaugaggaggccacugccggucaguguggggcgggagggcccugggucccagcucugaggagcucugagaaacgcuuuacgacuuucuaaaugggccucugcugacagcuuaacagccagcuccucccugccccggcuucauauuuacgagcuggcucugaaggggggcucaggaauccggcccacaccacccgauccucagcccucuggcuccagggccaggaagccauaaaaaaugaucuugcauugcuucccuucccccacauguuuuaggugaggcagggcgggcauggcaagggaugcugggggcagggaagguguagggucuuucucuaaggcuacacaagcacauucucacagaggggaacucaacugcccaggcuuugcccaguccugaggucccuagucugagcugucaagggcuggacauacucauacuuauggggcaccuacuguaagccaaggugucaccuucaauaucucauugaaucuuacaacaacccugaggaguuugacaaaguuuggaaaggucuuuggacucagaucuccacuguucccuccugccccgaccagaaggccccuucaguuuacaguugacgagugagacccagagauggaaaggaacuugccuaacgucacacagcguauuaguggcagaguguggaccugaacuagggcucccagcucccagggcaguaggacccaugcugcaggcuccugacaugccagugggcgagguggggaugaucccuuugccuuccacaugggucccucugucuauagaug

SEQ ID NO: 16262 - RNA, 3786 nt, Homo sapiens
gcgaugcuucagcuaccccaaaugcuaccaggcccaucacaagccugcuugccuuaggaaguuuuuuuuuuguaaugcagaugacauuugcuuuauagcaguggaguuuccuaaagugucccauuggcaccucaugaugaucuguggagguggagguucugccaagagagguacagccaccuggcugguaaauggugaaagcgggucucaaaacuccugccaaucaacacaugguguccagucugcaggcugccucauaaaagcuaaaucaaccucccucacauucccuccccaccccuaaggguaucuuuucaauucagcacucuauuucugcccugggguggugcuacucuagaagccuagguucugggaucuguuaagcuccuagaccuggauccuccuaggaugaaacugacccuugcuuccuugcuuucucugagguuccacucauggccugaauugugccaauuugggcugccuugagggcacuucgcacauuagguaaauaggauggggcacuagguuugccagcugccuuuggccaaguuccuuccacuuuggccugagcuucccaaccagccagaaaagcagacggaaaaccagagaaaccuagcccuggcggcucaggaccagaggcugccugggagcaugacugaggaccuacuagagguagugccaacggcggucagcugcaguguggcuaagaaugggauggacacuuauuuuaaauguagcuccuucguccagccccagcaaugcugacacacagacaacacugcgccaucacuggcuaggggugggcgggaaagaacagcagacaagucguuuccccucucuaggccuguuuccucuucaauacacgugaaaguuacgguagggacguggggugcauaugaugaaguacauaauaggaaaaggaaggggggagagucauggguacucuuccugagagguuguggaguaacauauuugcaucugggauuuauuuugcuuuuacgcccucacugauguaauaaucucauggagggaagguccguaaggcuuugagggcagggugggggaagagugcuucucuguccccgucauaugaauuacauugcuuuugugauuucccuuguguguguguggaguguuaaaacccaagaccugagggccuaucggcagacgagccuggaccccaccuccugggcagggugccacccuugaggccucccagccuauugcucaaagaccugcugcccuuuggucacccacguccaaagcagccaguggaagcuaaguuccccuaaagguuggagccccucuguuuugaccuauaaagagaaaugcccuugggccucuguuuuuuucccucuucuaggcuggcaaagcacacaggcugagcgcugaggagagggaccagcugcugccaaaccugagggcugugggguggaaugagcuggaaggccgugaugccaucuucaagcaguuucauuucaaagacuucaacaggguauggcaccagggugggacagaguuuucugagacgggcugauggggucaccuuacaaagcauguucucucccuucacgucuuguuagccaagacucucagacaccacacucauccaguuauuugggcacugugccaguggggaaauuaauuuuccugucuaacucagaaaguaucaucuuuggggauuggagagccauaggaggaugugucuugggcucucccuuccuggaacuuuuagcagcagucuucugaggagauaguucaaguggaaaccaugcacaucugaagacauuugaacagacggccaagacuggccaggccaaaagccuguugugguguuuccaccuuguugacauccuaaauagcaagacuuucuuccuacugcaaggacaaucucuaacucaagccugagaaccagugacaggaugucaagggggaaaugauuauagaggagucuccuggggggaagcuaauucauccuccugcgucuaggccuugaauuggugauguccagaaguccuuucucuuagaacacuaaccuggcucucacuccacuuaaauaggccuuuggguucaugacaagaguggcccugcaggcugagaaacuggaccaccauccugaaugguuuaacguguacaacaaggugagugaugcugugugccucuguugugcucugcccccauccaaauacugcgaacucugacacauucugaaggcuuuuggacuuaacaaugagccuuccugacccauaggucauccacucaucucauuuccaaucucacugagauugcacaugccuagaaucaacauaaauaccccugggaaaaaaaaaucagucuuacuauaaagaaaugcaaauuaaaagaugcaugagauaguugugguuaaaguagacauuuaaguagacauuaagaaggcaaaacccaagaaaggaaaggcugugggaaucaggcauacuuauucaguguucauagcucuaaauggcuuuaaucuugcuggagguauggaagaaugaaaaaguaauaaacuugaacuaagaauacacacauauuugggaggccgaggugggcagaucacgaggucaggagaucaagacccuccuggcuaacauggugaaacccugucucuacuaaaaacacaaaaaaauuaggcgggcgcggugguggacgccuguagucccagcuacuggggaggcugaggcaggagaauggugggaacccgggaggcggagcuugcagugagcagagauugagccacugcacuccagccugggagacagagcaagacuccgucucaaaaaaaaaaaaaaaaaaaaauacagacacauagccaaccuaucaaauuauuugcuuaaugaauagaaacagucauuaaaugucuaccaugugccaaaagcucugcuggucucuguuuauaaaaacaguaaggguggaagaggucgucuaugaauggauaguguuuaggaguuggcauugguuuuugguuuugucuuuagcuuuuagguugcucuugacauucagauauuaagcuuuuauucuauagcugaagucaugauuauuuuugagagacagcaaaggggagauguagaagauguuguuacagacaugucaggaaggaguccccaggagagaucguacuggccagcugcuauucuggagcuccuagcagggcugagcccagcagcuagugacucccuccuguucuuaagugaagucaguggaagcagaauuucugguuucauuucagguccacaucacgcugagcacccaugagugugccggccuuucagaacgggacauaaaccuggccagcuucaucgaacaaguagcaguguccaugacauagacccugcccuuccucuuugaauucuuccgggggaaggggugacugaacugggaguccagggagggagcugaggagcccuuacccucccaccacuccccucccaagacccagccgccgccguugagggcugaguccuugcugugggaugugccaguguccccaccaacaccaggaauuuagaccuuuucccugcaccacucucuucauccugggggcucuguuacacuaauuugaauaaacucuccccuuucuuugcaacuucccagcaacaauaaugauuuucuugccaggccgucucuugcucccuaauucauuucccaggaagcugugauacagggugaaauaaagucuugucuuagaaaccaggacccuaaaccccacacuauguaauagaaacacauguguuuuuaugucucaaauaaaacuauuauaucacuuggucucag

SEQ ID NO: 16263 - RNA, 64167 nt, Homo sapiens
cauuuccgggaggggcgaggccggcggcugccgggccuccaaucucggcggcggcggcggcaacaggggagccugggucucgcggccugcgaguccgucgcgugcugagggagacgcaggagguggagccggccgggugcucgagggaaggagacuggaagcugguuccggcgugaggagguggaggggccgccgcgggcuccggggggcggugagggucgggacggaggcgccgcggggugaggagaggacaggggccgggugggccgagggcgggcagaggcggcggggcggcugcggccggggcgggggcgggggcgggcugaaggcgugggcaccagccgcugagguccaagcaaguggacggcgggcgggcgcggggccgcgguggggcgggucuggagcccacgccugccgcgggguaggcaugggcggccaggauuugcugguccuccgacgggaggggugacaacgagagcgaggccgugcugauucugaagggagugcggaggaggcaggacccugguagccucggcaccuucagcccggguuagguggccugggcugggcuccccaccccgaucgcgcgcagacggggcguuuccccuaguuuccaccuggguggaaugcuuugugggagucugggucuggauuaguuucaucagcugugggagggaaaccuaguugcagcaggauuuugauucgcuggucuggggugcuagggguggacugugauaucugggaaugaaaucugagccuucaaaggagggagagaaccauaacuuggcugcucuggcgaaucuaggcgggcuggcgagacaguuuaaagcucuagaaguaaacaaaccugguucccuuuuacagagucugaaaaaggggagcgcggagaggaggcuggaagaggaagaugccuagcacagaccuucugauguuggugagccuuuugcagacauccuccugguuccaaggcauuugucuccguuuuuuuaguccaaaggaucccaguguguagauuucaccucugaugcuugcuuuugguagcugagcguuuugccaccuuuuauuuuguuuuguuuuguuuuguuuuuuuggagacggagucucacucuguugcccagacuggggugcaguggcaugaucucggcucaccgccaccucugccuccuggguucaagcgauucuccugccucagccuccugaguagcugggauuacaggcgcacgccaccacgcccggcuaauuuuuguauuuuuaguagagacgggguucuccauguuggccaggcuggccuugaacuccugaccuguggugauccacccgccuuggccucccgaagugcugggauuccaggcgugagccaccgcgccuggccaaccaccuuuuauuuuggaugaaugaucaggaugaauaaauagcugaauuaaauacaucaauacaguauauguagaacuuaaauuauugaagaaucuuuuucaaaauuauuauuauuuuuuuuaaaugagacaaggucuugcuauguuccucagaccggagugcaguggcuauuuacaggcauaaucauagcucacuguagccuggaacucccacuucaagugauccucuugcuucagccucuggaguagcuaggacuaggagcacaggucaccucuccuggcuuucuuuuucauaauucuugcaguuuuaaucccucccuucccguacuaccagagcaguuuugaaaccucuauuauuacguuuuaucagggucugccauauacuaguuuaucugaguguuugucuuccagauuagaguuaugguuccucgacaggcagauaaucaugucuucuuuguuuagagaugaauaaacaccuagcauggugcucugaauauaguaugugcuuaacaaaugcuuguuggauugaaccaguaugaauuuaaguucuuuuguuggacagagagguaugccugcuuuagagcuguuuccucuccuccugagaucuuucugugcuguuuuacugagcagggaagaauagcguugcuaaaugcauguuuaccaaaaugacauuuuauuuuugggacuuuuaugauuccuuauggacuucuuagugugagaauuauggagaguuuauagcuuugaaauggugguauagaaaaaguguccggguuuaguuuuuuuuguuucguuuuguuuuguuuuguuuguuuguuuuugagauggaguuuagcucuugucucccaggcuggagugcaauggcacaaucucagcucauugcaaccuuugccucccggguucaagcgauucuccugccucagccucccggguagcugggauuauaggugcacaccaccaugccuggguaauuuuuguuuuuuaauagagaugggguuucgccguguuagccaggcuggucucaaacuccuaaccucaggugauccaccugccuuggucucccaaagugcugggauuacuuacaggcgugagccgccguguccagccaaguuuguuuguuuguuuguuuuugucacuucucugagugcaaaaucagugcuuuaaaaacaauucauuucucucucuuuaucucacuaucccagaggguggguuggcgucacugggaaacuggcaaaaacugguagugagauuuccuuauacugggugcugacaucguaguggcauaaccuguaaggucugcaggggggcuaaagaagagagaaacuaaguuuugauccauugugauuugaggcagggaucuaggauaauuuuagguuguaugugagagacauagaugaauacuuagguuauccgcagaucccaaugaaaaguucaucuaaaauaguaucuugccccaaauuucauggauuuuucaguuuuaauuaauacccuuauauaacuuaaaauucuuauucaaagaccauuauguuagaaauacuggaaacuauaaguaagcaaaaggaaaggggauuuguuaaucuccccuaucuccuacauccccuucauucgccucuaccccgugcaguaauuuaucacccagaaauaaccgcugugagcaucuuggaugguuaaugcagagugacuuguagcaauugacaguuucuguuuauccucuuacagaaggauauguuuauguaaauuauagguucuuauauguaagauauuuccccaugcacagagauaugguuauuacuuauagggccuaugcauuuacuuuaacagaacaaugacugcuuuuacucggaauauuaacuuuggaaucaguuuucuuuugagguauuucucuagcuguugccaccaccuuucaccuccucaccuguuaauuuagaauguuuaggaguguugcuuugcuuguugcuguaaggaauuaauccacauagaugcgaguggcccuaggcagucaucacuuucugaagacaacauacauguugcaugaagugcuuucacuggaaaaguugucauucauuccuugacuguaauguauaaugcuauuuggaacuaacugguaaagaaccaauaaccauggcuggguuuucaguggcacacuaacccaucauucuaugagguguuucucaagcuacuuuauaugauauguaaaacauguucuuggcccuccaccugggaagaaaggaccuaagugaauaaaaaaauaaccucagugcagugcagcaucucagaauuagaaauagucuuagaagucaugggaugcagcuuuuuuuuuuuuuuuuuuuuugagacaaggucucacucugaugcccaggcuggagugcaguggcaugaucucagcuuacugcauccucaaucucugaggcucagaugauccuuccaccucagccuccugaguagcugggacgacaggcacaugccaccaugcccggcugauuuuuguauuuauuuuuuguagagaugguaguuugccauguuacccaggcugguaucuaacuccugggcucaagggauccaaccgccugccuuggccucccaaagugcuggauuacaggcaugagccacuguaccuggccugugaugcagcuuauauuauacaugaaucuguugaagaguaucucugguaaauggauauccagucucccgucuuuucugcuaauggaauaagugagcaaaagcuaggaaacaauacaagguggauucaggaauaguaauguuaacucugauagcuaacauuuauugagcauguauuacauguuaaguguaggaauacuguacuuauuuaauuuucacaaaaaccuuuugguauccuucuuuuacagaugaaaaacgaggcuuauagagaguaacuacagcaguugagugguggagccaaguuugaccucaguuggucugacuucagaucccucccucuugccuacuuuguguccuuaccccugguaaggguagagguugcugaccauugugacugaugggagagggucuguguggagcagaugggauaggauagcuccacccucuagggggcacuuuggcaaugggggacugggggaggagggagucuuuuuucuucuaguguagucugaaaauacauguuuuauuauuaaauuauuauuaaaucuuguuuauugggucaggcgugguggcucaugccuguaauuccagcacuuugggaggcucaggcgggcagaguacuugaggccagguguucuagaccagccuggucaacauggcgaaacucugucucuacuaaaaauacaaaaauuagcugggcaugguggcguacacuuguauucccggcuauuuaggaggcugaggcaagagaguugcuugaacccgggagguggagguugcagugagcugaagcugcaccauuacacuccagccugggcgacagagcgagacugucucaaaaaaaaaaaaauuuguguuuuauuuucuuuuacgucgcauuuaaugaauuauauugaaauuuuaaaacuuguaucugcaggcauaguguuauaaucuuuaaaugccaugucagaguagcaaaagggauuacagaauauuuguuauaaaaagagggcauugggucauagaguugaagacuacuuguguggacaguaugcugugagagaaaaccuggagaugaccuggaguccacauauaacaagccuugaauccagacugacaggcucgggcuaucagcccucaguguguuccugcccucaauuuuguuaucauuugauuaggauaguuugcuugccuuuuuccauuugcucguaugugaugugucauagacugcaguacuuuccaccugugucucauagagaauaaaaugaguauguucaucugcugagaguugugaugaugucagagggaauucaagucagacagcuuuguagcagccuuucucccccuuggcaaccauucuuuuuauucauacucuccuccuuggugcuagagggugguaucacuuugcaaguugccaaauauuuguaguuuuuaagaaaaagguauuuuauaaagccagucuaccccuuagguggcuuuuuucuuuucucaucagaaaaugaugacuaaauuagcugauauucauagaugaaucaagguuagcgugugcacccugguagugcuaggugggguuugagugauaauugcuuaucuagggcagugguucuugaccaggggcaauuuugcccucugggugacauuugacaaugccuagagacauuuuggguuguuacaccugaaggguucugcuggcaucuaguggguagaggcuagggaugcaaccaaacaccuuacaacgcacaguuuccugcaaacaagaauuaucuggccuagaaugucaauaguggugagguugagaaacugguaugaaguuucuuaccauagauaccuggauaucuguguagucuaugcuuucauaugggugggggagugauucccuucuuggagguuaacgugucuguuauugucucacuugggguuauuuugcccaugggucaagccuugcugcucaggaauauauauuggagauggugcagcugaucuuuuauagcaaugcagaauucuuaagaaaugcuguccuuugcaacauuucugcaccacucuuuucuugauuugcaaacagcaagcuucccucaguuuuguuuuuuggguucaaaaauugaaucuuuccagguccuugagcgucuuuaucugugacccuugacucuuuuucagggaugcuuucuuucugaaucucaagugggauuuaagcaauaaacugaaagauugaccuuaggagcucuguucuauuauuugagccuugugucuuguuuguaggauuugcuagaagaaagggaaaauucauugggauuguugauaggacauuaaaaaauuuguugacauuugaguggccauugcaggaugaacacuguauuuggcaaucucccaguguuauagaugaaacagagcuguaauaauuuccacagccuuugguuuaaaggaaaagaggguuauaaacagauagaauccaaaucccaguauuugacuuagcuuuucagucuaugugucaggaauuuuuaguaauauuuaccuucuuaauuagguuuuacccaaucuaauauuauauacaguuugugcacauugguggcagaauugagaaucagccuggguuuaagaauuuccauagggaauugaugugaaucagucuguauguguaaauguacagaacccaauuacugagauaaaaaccaugcugugggggaaggggagauaggggcccucugagaagauggaauggugaaggcugcgaguaguuuguggauauaucagucauaucuuggcauaauccaacagcguacuaagggaucaagggacuauuuucaaggcugagcagguuuaaggaaaacaucuaggugaaacaucuaagggcuagcuagcaauaggagagccauuaucacucuuuuuuuuuuuuuuuugucauggcaauuucacugaagcuuuuauugccucuauugguaauaugacagggacuguaagaaacacaauugaacuuacagagauaugcagaugauauucacuaaagauaaucuucaucucaaguauuuuuuauaugugggcacuucuaauuuuauacauuuuucuauuuaaaaagcauuacauuuuaaaauuuguaccuguuuugacauuuggcaaaaaggaaacuguaccuaugguucaguuuaaaacaaagaaucagcauggggaguuuaccggaaugaggacugaaacacuuaggaguuaaagcaauucaaggggcgugugugugucucucccuuucuccgucaaucucucucacucucucuggcucucucacagacacagacucaaacacacacagccauauguguaaucauuuuuuaguacaaaauauucccuguagccagacauuuaucuucagaauaaucacaccacauuaaaucagucuucucuuuucagcccuaguaaaaguuuuguuuaauucuaagaugccaucauagugaacaaccuuaacuuuuauccuacauaauuauauucaaagcuuuauguauuuuuguuuauaauuacacaguaauuauaaauguuuaguaccaaccugaugacaaacacuauuuuguugaaaagguuuugcauuuaaaaagaaaaauauguaaaauccaaggcacuaggccacgaaccaauaucagacuuuuaaagaaaacacuuuauauugaaaaaaaaaaaaaaaaaaagcuaaugggaucucauuucaaaacacagcauaugugaauuaaucaaucugaaaccaauaaccauaacucaaaaucuucaagacaggaaacaaaacaguacauauauauagauauauagauauauauaucuuuuaaaaauuuuucauaauugaaguuccucuuuauauuuacaaaaaaaucaggaaauacugaaagcagcaagauucuucuuuuuccuuuuucuuuuaauaaccaauuccaguagccugaauagaaauuuucagauuuuucuuuugguaaaacugcauucuugaauuaaaguuaugauuggaauauugauaugucuauagggaaagcuuucuagucuauuucaaaaucauguaaauaaaaagcaguuuugauaugucauuguuucuuaaaauaauuuccauauuugcauaaaauguacugcuauucuaaguacauuccuuuguuaauaucaacccuagaccuuagagagugccuggauauauaucccaagcagaaucuguuccuaucaaaagaccauaaucaucgaacauuugaagcauuacauuucuagccugccuuacggaaauguuuaagaaagcaagaaacccuucuucacaugucaguaagugaacagggaaaugaccauuuucagcauaaaagcagcucaugggucuuguaaugaaaaaaauacauacaagauagcauucugcuuugaugagaaaacugagcuaaucugagugaaacaaaaacaguaaagagacuagaagccagauugguauuuugcaucauguaugcuuguuugaaaaucuuugcuccugaaguaaauauuuggcaaccaagugauuagcgaccacaauuucaacaaaauaauaagucauugaaaauggacuauuugucugaaagagcaauaccuauauuacaaagauugaacuucauggcucauuacaaccauuuucaaaauuuaacugcaacuaucuucuuauaaauuaagagaguuuaauuuguguuccauagugcgaugacaaaaaaaaaguaaaaacaaaacaaaaaaacccucaugccuaaauuuagaauauuguauuauguagcaauccaaaacauucaaaacaaauuaaauaguuuaacuuaugugacaggcagauaagcauuucaaaagcauaaugaaguccaauuauguagugcuuaauguagacaggagaagaaucuaacauuaugcagacauuuucuaaauaaaagcucccuguaggacagcuauauauaaacauggguaagguaagcgcagacuaguucuguggaaccuuuugaaaucaagagucuaaaacacaauacauuuuucagguaggcaccaaguuauccuaaaaaauuuucauguugguuauucugacguuguuuuuucucuuuuuuuuuuuuuuugagacaagucuugcucugucgcccaggcuagagugcaguggcucgaucucggcucacugcaaccuccgccuccuggguucaagugauucuccugccucagccucccaaguagcugggauuacacucuuaagccugugagagggcaaggaagggaguaguuucuggaacuuugagagaguugagaugaaggagaagguaaccuguaggaaugccagccagugacccaguaggaaaggcaucaaggggaauaaauacuucaaacucuuuugcuacccucugaucuccugcuguagccucccauuggucuaauacaacuggaaaccagagguuaaggagucugguugauuuaauucagaggguggaauccggaggcacauagccgagcuggaaaaugcuggauggaggaucuggaggaggagaucaucuggaggggagaacauccagcaugcuggaguugagaggucuaguuugucuuaaaaggcacaaaugaggagauaauucuugaacagaaucuugaagguggauagcauauggauuauagaaagggaauguucccacugauuuuaacaggauagauucagaggcacacaguugccacagcuuuggcaagcccaaagcugcuuuguuccaguaguagccuuagaaucuuaauugccuggagggccuuuaaaaguacugcaguccagcuuucuugcugccuaggaaucccucuacaaugcccugucaggagugagugcuacauacuuucucaggggguucuuuccacuguuggacagcuuuaauuuuuagaaaauuuuucauguguccagaucacugaaugcaucagcuagaauuagguuugaguguauauaacagaaaaaccuaaaguaauagagauuuuuuaaaagacauaaauauauuucuuuaagagaaaacuggccuggcgcgguggcucacgccuguaaucccaacacuuugggaggccgaaaugggcggaucacuugaagccagaagucaagaucagccugggcaauguggugaaaccccgucuuuacuaaaaauacaaaaauuagccgggugugguggugggugccuguaaucaaucccagcuacucaggaggcugaggcaugagaaucgcuugaacgcgggagguggagguugcagugagccaaggucacacuaccgcacuccagccuggacgacagagugagacucucucaaaaaaauuacaacacaguacaauacaauacaacacaacacaacaauacaauacaauacaguacuacaguacaauacaauacaaugcaaugccaguacaauuccauuccauuccauucauucccauuccauuccaugccgauaaggccauuccugagucuuugaggugccaggcugcuucugucugucauuccgcuaucaguagugcauccccuccugggccaggguagcugccugggguucuaccugucagguucauguuucauucaugaagaggaagaggaaacggaaaaagaagggcuugcccuccauuuuaauuaaaaauuauuuuggaauuuauuauacgugcagaagaguauagaaagcacauaucuacauuuuaaugaacaauaauaaaacaacgauaccagauuaggauauaaaccauuuaucucuaacucuacgcuucacccuguuacaaauauuuccuuucuuccccucuauggauaaccccauccugacuuuuauaauuauucccuugccuuuuuaaaaauaguuuuaaccaccuguguaugcauccuaaguuuaguuuguuuuuuuuuaaacuugauguaaauggaugcauauguauuuuuauuuuugugauuuuccuguguugcucaguauucaugcgauccauguuauugcauguaguuuaaguucauucauuuuuauugcuguauauauaguauuuuauugugugacuaaacugcaguuauuuauccauuugacuuauaauucacauuuggguuguuuccaauuugaggcuuuuucaaacauugcuguuaugagcguucuuauauaacaagugaucacaagugcaagaguuuuucugggauuugugccuaggaguggaauugcugauuguaaaggcauacaugccuaacuucacuagauauugcuaaacuuuucugaagaggccaauacaauuuauaccacuaucaacaauauaugagaguuauuuccacccaacuuggcaaaccugauauuuauaaagcuuauuuuuugacaaucugguaagcagauaaauguaauuguaauuuccguaugcauuuccugauaacugaugugguuaaguacccuuuucaauguuuaccaaccacuuggauuuucuguuuuguggcugccucuucaagucauaugccuuaucaguuauuucuccuuuuuaguucuauuauuaauagauuuugcuguauauuugcugagauuuuguuacuaggugcauucagauuuaaaauuguuacaucuuguaaguugagcuuuucauauaauuugcuuuuugacauaauauagcuacaucagcuuuuugucaugaaauaggaaacuucaaauguaugauaaaugaaugaguugccuguuaguauaggcagaaacugcagaacaauccuagcccauuauucaggcuuuauguaucagcgauuuguucuguuaucccauaaagugaaugagucauuuuugaguuuaaaaaaaucauagggcuuuuuuuuugagguccaauuugcauacaguaaagggcacaaaucuuaauuauccaggucaguaaauauuuauguaugaauauacuuccagaucaagauauuaaacauuuccagcacuccagccagcuucuuaaugucccucccaguugauaccuaccaaagguuuugcuuaguuuugcugauuuugaacuuuacauaaaguggaaacauacaguauauucucuuuugugaguggccuuuuugcucaacauuguguuugugagauucagucauguucuuagguagcauuaguuuuucuuucuuauugcuguguaguguuacaauguauaacuauauuauaacuaauuuguucuguaguuguagaacauuuauguuucuaguuuuuuggcuauugugaaugacacugcugccuucuugaacaugucuugguaaacauaaaauguagaguugcugugugguaacguguacugccaaacagauuuccaaagugguuguacuaauuuacgcuaccagaguuuuaauauauaacuucuugauuuagcuuugggcagcaaauguuaaauuucugucaucugcauaccacacauggagaagagcacugagaacucuuuccugaaguuguauaggcacuuuuauuuuauuuuuuauuuuuauuuuuuucggagacaggguuucacccuguugcccaggcaggagugcgguggugcgaucauggcuuccugcagccuugaacucugggucucuaaccauccucauugagaagccucggcuuccuaaagugcugcgauuaugggugugagccacuguacccagccuguacaagcaauucuaaaaugugaaaugcccuuccuuuucuguaauuuccccagagaguaaagccuacugcauucuuguuuaucuagucuguaaauguuaauacacaauugaugggaacaaagcaaccuuaguucuuuuugaguaugaaaaggacccuguuaagggcagaauuuaaaauauuuguaguaguuaauucucagguuaaaaucauaaucuucuagaaugcuuuagauucuaaguggcuauuguaguaacacuuuauacucaauauugggggaccauguuuuuuggaggcuuucacugaagcauuuaauuccauucuuuugaauucguuuugacagaugggucuaaaaaggaauagaucaauucuguauugaauuccagucuuaauggcaccgagucuuugagacaauugaggcaaauuggaaauucuguuuucacauucuucugaaaggggaugccuuucagaaguguccugaagggcgcuggggagggcaaauaugaggaugccaggguaagucugcucccugucuggcuguguugggccagaguggaagaaagccuaagacucuguuacccagcccuuucugaaaauguuuucaaaugcuuucccaacaaucacgaccacaagagucaacagucuguuuggaugacugaaaacacacagguuuacgaucuguaaagauaguagguaagugauuuaaucuuguuguauagguaggccagagggcacucgcagccuucugauugauuuaauagauuguugaagauuaagaguugacuuaacaucucucuuagaaaacugagaaauagcucauuacuaagguguguuuuauuaccaccgucuguaagaaaauacaacauaggcaugggaaucaaacuacuuaaagccucuuccagcuccuuugugacugggaagguuacuuuuccuuguugcuuauugaagagaaaaggaaaauguuuaucauuggauaauucagguucacugaauauuuaaugaguguuuauuaucugcagucauuuucuuauuaccuuaucucauuuaauauucacaacaacccugugaguggacgaugguaucuuuuuuuuuucuccugaacguuuuguugaauuaucccaauggcuucuauuuuugcagaugagcagaguccaguugcauagagguuuaguguugugccacacaucacacagcuucuaagugagagcuaaaauuagagccgaagguuuugauuaccaguccagacuuucuaggacaccacagcugccuuucuguagaacagauuaacaugacucucagaguccgcaagaguaguggugaggugucaguucaggggaauacucaaaggucacuguccuuuucagauaucuggguaguugcuacaguaugugcuuaggaauugcuggauaaaaaaauauucuuuaaaaucucaucauuuuagucguuaauaauuuauuauuauaacucguaaaaauauaccuuuaggcaaguuauucuuagguaguuaugguugcuuucauuuggaguccagagcuuuacucucuauuucuggaguugcaauuucugcuguccuuggcccauuuaaaaacuuuuucagaaggccuuuuaaauuuuauuuuuuuauuaaaagaaagccugugaauccaaagaaucuuaggugguuucuuagcugaagggacauuuggugaacacaaauggaacuguuaggucaugaugcuuuuuuaaguguacaacucugguguuuuguauauucacaguugugcagccauccccacgaucaauuuuaggacauuuuccaaagaaacccaguacucagcagucacuuccuuauuuccuucucaccgguccucagcaacuaccagucuacuuuguguagauuugcuuagucaggacacuucauauaaauacaaucauacaguaaauauguggucuuuccugauugacuuccugauuaaccauucguuuaaugguuucaagguucauccauguuguagcauggaucagaacugcacuccuuuuuauugcaguuacagggcuuuuccuacagaauuuuaaguaauggauauaucuaacaaugucucuuguucucaccuacaggagacacaggaucuugggcuuacuuuacuuauauaggaccuuuuguaauaucgaggcuauuucuaugcuuuauuguagaacagaaguuauuaacuggggaauauggaccuuuaugacuggccuuuaggauguccugaauucuuuguaauuauauaagauuuuauguucacaagcauuuucugggcgucggaggagucuggaacagcaaagaucucuagcuuuuguuaaaagauaauuuucgaaaguaauauccugacucuuauacagauauaaaaugaacauauguugaagauuuuauuuuacuccaaaagaggaaaccaggcagauguuauaacugguucaaaggagagguccaaaaagcugcucauuuauggaucaggaauaucaaaugaaugugcaaauggaggcaaaacaacucucugucauagggguaggaaagucaggugaaacuucaccugacggcagaauuugcauauuuagggaucuagauuacuuugcacugcuaucaguuaucuacaacuuucagagccguaaacagccuccucauaaucagaaucugguaacccggaggggcgucccagauaaugcauaauuuuucauuggaagccguagggaaaaacucucuccucuacucucacaccacaacaaucaacaccgaagacuuccgugaccaaacgugugggauuuuuuuccccacacuccaagaagcagacaucacugggugucgccuaauucaauucugacacugucuaccuggagauagcaucagaucuauggguugagggcucagucccaacccauaccugucucccccaaccccaaccugucacaagucugguccuucaaaaugucugacugacugucuucaaggugagguucccaugaccuccucuuggauuggauuaauuugcuggaacagcucacagaacucagggaaacauuuacuuagguuuacagguuuauuuuaagggauacugcaaagguuacaaaugaagagaugcauggggcaagguauaggggaagggguguggagccuccaugccucccugggugcaccacccuccaggaaccuccauguguucagcuauccagaggcucucugaacccuguccuuuuggguuuuuauggaggcuuaguuacauaggcaugauugacaaccauguagaaaugugacuggacacaggaggcaugaucucauacuaauagacugaccggaaacccagcaaggccugucuguucagguugucgcuggccuuucugugcagccuuccuuccuccagaauauggggcacaacccucccaggaaugaggguuuuuuggcccacaguuggacuagagucuugcuuugaggcagguaaaagaggacaggagaagguugagagagauucuguuuccugaggcccaaagugccccagcauuauaauagaagacuauaacaagggcuauggggguuaugaaccaggaaccauggaugcaaaccaauauauacguauaacaucacagaagcacacuuuccugcucacuuucaauagauaccacaaaguuugaaacucuuccaaguauuaauuuuaaauuaaauuuacucagcugcuuacuucagcuuuuaaaaguagguucuugguaauuucgaagaugcacuuuccaaaggguguuuauauaguugaaggucagucagagaccuagggauaggucccugcuuauucuuuugagcaggcuuacguguuggaaaucucuagagaaauagcuuuaguuagguuacacuucucagcaaauauucaguauuccucaucucuaauagcagcaugacuguuguagggaaggaauuuccacaaaugguuaugaaaagucuaagugucuuaacucccagacaaagauagagaauucuguuaguaagauaaguaugggacuggagaagucagcuaaccucugcccuuccccaaucgugauaugcucagagaaguuaagacuucuuucugugugagaaauacgggaucuuuuccacuagaucuugcuuauuauccaagaaauuaucauuucuaguuuuagagaaugaugaaacucauuugugcuuugaaauauaaccuguauacaugugcacaguaagucauuuagcuauuuauugucagacucugagaguucauagcaaacuuagcaacauuccaugugcaaauuugcauauuuuuccccccauaucuuaccuacuugccuuaggcugggagucuauuuuccuacaaaacugguaauugcucuuaucucuguguccuucaguguguuccucugcuuauugaauucaguuuuaugcauuuagucuucucuccuaguauaagcugcuccugauacuuuuaaauauguauuucagaagagaggugcucagaauuguuacuuaacagaaucagcaucucccuuuacuugaugccuuguccugaccacaaguacauuaauaaagugaccauuuagcaguguuucggguucagcuuuuaggaacuuagaagcugugguuuuccaugagugcacuucugaugacuugggaacauuucauauguguguucuuucuguggccaagaugguuuuguuauuucagggauggaaagaugcuuugccugaauacucccaugcuaaguguauagcaguuggugcuuggggaaugguaccaaguguacauaucuggcaaggccaggcuagaagggaaaauguagacucuuaagcuuuuugagacgaacuucucagauacuggaucucuugacucacauaguggaauuuugggggaaguaugugguuugcuuuuugucuccuaagaaaugaugauucaguuuccucaaacguuucucacagucacuacugguugcuuggaauggcugucugguuuuguugcucaguucuuacuucuuuaaugacccaagaggauuuucccuuugggguugugauguguuuuugaugauaaacuuuaaugcuuuuggaggcuauaaagacaauaguauuuucuuaccuguuuaccuugcacuuugaaguucuguagacuguaauaugaaagaaaaucagauuaaauuagcuuugcuuucuggcuuuucuuuuuuuggugggggggcagaagcugauaagaauaaauauacuaacugagucucuucuguauuuuaacuucacucccuaggcugaggcuuaguccuuagaguaacauuugaacuggguagaacagauuuuucuuuuccucaacagcccauuccugcuguaaagcucagauuuaugguccuucuggaaaaaguauugagcguugaauaguucaggaaaacaaauaacaaauucugucuucuuugcaggauugugggguagaagauuuugauuuuuauuaguaucuggccaaagaauaaauauuaggcaggaacaaugaauugauaucuaguagagugacgugacugggcccugacuuuuaacacuucccaggaaagcuucguggaugucuuuucccugcugcgugaauaccggguagccauuaaguuuggugauugggugucaguaauauguuaagucagcuacugggucaucuuuuaauaaaagaaaaggauggggaagagaauggauucuuaagcaguguugccugucagaaucaccggagggagguuuacaaaauacacauucuguacucugacccugugggugggguauucugacccaagaagaugauucguuccaggaaucaugcuucuuggaugauauugauguacccccacuggcuuuauggaaagaauauugaagaagaagauagauucucuugggggcugugccucuaguuugaaaccagggaaggcacauuuugguauuagucuguggccucaguuucuucaucacugcaaugagauuggacuauagguggucucuaagguuccuucagacaguagcauuuuaugauuuugaagacaacuuuucugaaguacuuuucaaacuaauuucuuuccgucuuucuuuuguaagcaaauaaguaguaugaguguaagucucuagcucagagaagaaugaaguuugcaguucgaaaaggccaugcaauagcaguucacuuccccaaaaugcucagcccuuguaggaugccguuaggucaucuggaaguucuguaugccuucacugggagcguagugaagaugagagccuuuccuuuggcucuuggaguaaacuagcugacaggacuuugagaacuguuggucuccugauuugugccacugauaguuuggcucuggaaaacuaggcaguggaaaaaacaaugcauuuuaaaccagaagauuugaguccuggcuccgcuauuuccgagcuuugugaccuguaggccucaaugucuucaucugugaaggacagguucagcucugauggccuaugaugugaugaaccuugugaacuuguaggcagagugccacggugugcagaguccaguuacagauaaccagccauucuccucugcagauucaacccacugccacugugucuuguuaagcuuaaauaggagagaugugggagagaggaggcagaaacauccuaggaucuugcaaaacaaaacugucaaaaguauaggcaauaucauaauuacuuuauuugaauaaacguugaguuccugcuguguugaagaugcuguuuuaggcaguguaggagauagaagacuuauauccuccuccuaauuuguauucuuaucagcaccugguaccauagagaguucauauauuaaaauuauuugguuguucucccuaaccagaguugaauucuuuccuucuaggacaaauuaacucauaaugcaauaggcuaaugcaguuuggcccugagugacucuugagaaauacccugaguugaggcacacuggaaacguggcacauuagaaaugccaagaagaggccgggugcgguggcucaugccuguaaucccagcucuuugggaggccgaggcggguggaucacgaggcaggagaucgagaccauccuggcuaacacggugaaacccugucucuacuaaaaauacaaaaaauuagcugggagugguggcgggugccuguagucccagcuacuugggaggcugaggcaggagaauggcuugaacccgggagguggaguuugcagugaaccaagauugcaccacugcacuccagccugggugacagagcaagacuccgucucaaaaaaaaaaaaaaaaaagaaaugccaagaagacauuguacaggagaaugaagggaaacuuucuguagggaaguagcuuucccagaaacuugacucuauaaugaagcuauagagaucaguaaaaucauuagggcauuacuguuuugaacauuuccuugagugaauaacagacuuacacucaggggcccuaggucucuguuguggcccagcaagcugcauucagacaaggaggcaguuugagagguacgaguuguuauggaagccugagaaaacugguuugugugcacuucaguuuugaccauacaaccuucacucacuuagcacugugcaguaauccacugagcaaaauugccacauuuuccuuggcagggaaucugugugccuguggcaguucagaaauuauuuguagagugggucagccugucagcaggaauguuuuucuuugaucuucagccuguuuuucuuuaaugugagcagaacaguaaagagagaauacauuggaauaucuuguugguuccccuguuuggcuuuaccuacagcucuuugguuuucuucuuuuaggucauacuuucccaauuaguauguagguauuuaugauguuuugaagcccagagcgaugguuccaauaucuuguggaauucagcucugagugugaaguccugacuuugccucuuucuaucaguuugacugagcaagucacuuaaccuuucuugacuucaguuuuccccaucuauagagugauacugcacacugguuucuuuucuuuucuuuuuccccuuccuuuccuuuuccuuuuucuuuuccuucccucucccucuccucccuuugccuuugccuuucccuuucccuuuccugagauagagucucacucugccgcccaaguuguauuggagugcaguagcaugcucauagcucaaugcagcaucaaaugccugggcucaagugauccuccuaccuuagccugccaaguagcugggacuacaggagugugccaccaugccuacugcuuuuuuguuuguuuguuuuuuaaauuuuuuuguagggaugggaacuuguuauguugcucaggcuggucuugaacuccuggccucaggggauccuccugccuuagccucccaaagugcugggauuacaaguacuuuauaauguguaaauggccuguacauucuuaaucuaauagccucaugagguuauaaaauacaaauaaaauaacaugaaagccauuuagaguuuuaagguguauaauaccauguauucucauuaauuaaauuuuaauaaauuuaaaagauaaaauuauuuuuauaaaauaaauuuauuuuuaaaauuuuaauuacguuaaaaaguuaaugcuuuuuuuuuuugagacagagucuugcucugucacccaggcuggaguacagugguacgaucuuggcucacugcaacccccgccucccagguucaagcgauucucaugcuucagccuccuggguagcugggacuacagguguacgccaccaugccuggcuaauuuuucuauuuuuaguagagacaggguuuccccauguuagccaggcuggucucaaacuccugaccucaggugaucuacccaccucggccucccagagugcugggauuacaggugugagccaccaugccuggccaaauuaaaaaguuaauacuuuuuaagugcuucacucuuuccugugcauguugucuuggccucuuuuucuaaauuaguuuuauucccucuguaaucagagggucaccaaaucuuugaguuuuagagggaagagaaaguuuuuagugaaacaagugggugaacucugaucccuguaaaauagugccuucauacaguaggcacuccaaaaauaauuguugaaugacugaaacucuuaaacagcaguaagcauacguauagcagagacaacauuacagaguagagcucuuucuagguuggcaugguagauagcucugagggacuaccugaauggagaugccauugcuuuugaauaaaacaaauauacauggugucuuaguccauuuucugcugugauagcagaauaccacagauuggguaauuauaaacaauagaaguuuauuuggcucgugguucuagaggcugggaaguccaagagcauggcacugauaucuggugagggccuucuucuugcugaauaauaacaugucagaagggcaagugagcacgcgagcuagaggggaugggccaagaugucauccuuuaucaggagcccacucccaagauaauggcauuaauauacucaugagggcagaacccuccugaucuaaaucaccucuuaaagaucccaccucucaacacuguuacaauggcaauuaaauuucaacgugaguuuuaggggggacauucaaaucauaacagguaguuagcccuguugaguaauggagaaaggauuguauuaguuccaaggaaagaugcaucauccagugugggucuggaaauauuugccagauggcuuuucucuuuuaguaauauucauuuguggaauguuucuuuagguauaaauuggugcugaaguaauuugauaaggaaaaaauaucacugccuaauugguauuuggucacgagcaguaccaguucguaagauuuuuuuggagguagcaagggguggauagugcuacuauuggaaguuugcuuauggaaucuuuugcucucuugaagugauuuggagauuaaaagaguuuaguaucauuggggauagcuguggucuacugucaguuaggaaguaacucaugacuagauauccugggcuuauuacuucagcucauauuccugaccucacaaaaauguuaagagaauaaaucguaaguauaaaaagcacugagauuguguagaguggaaaauaacauuaguguuagcucccucacuguauuacacaaccacauucuaaauuuaaggaagccagaaguaaaaucacucugaagcacugcuuuugaaacugcagauuaugauccauuuagagggacacaaaaucaguuuaguauaucaagcguuaaagaaggaagaaauagaaaugugaguacauuacaaguaauaaggugcuaaguauuauuuuggaaacuuuugguuuuauauguuucuguuucuacauguauuagauuguguuguaaaagacauuucuuugggacuguauuuuacaacacagucucauacacguagacucuaauacacauauugaaacaguuugaaacucaguggucuaacaaguagcauaccccaaauuuacaauauuuguagccuucugcuguuggguacauucaugaaaaggucuugcauccuuaaagugaaggcugaaagaguuuuaugucauuggggcgagugggcuaccaagcucccauaaauucuaggagcugccuuuugucuaacgauuaggauuauugaguacuauuuugaugccuuuuggguaucaucugaaauguaaucauugaauuggaaauggaauaaacaagagaaaggcuaguuuacucauuauuugacaauagcucuuuaaaguaguuaauauuaugaauauuccuacuacuaagguuuauaagaguuuguuuuuuucuuuaauguuauacuuuaaaaaguauuauucauucacugggcaaauaauuuuuuuuucuagaggaauaccuuuccaauuuuauaacagugaaggaaggaauguuuuacuuauagaaacuguacugaaacuacuguucuauuaagcaaggguuggagauaagcaccccugucccccuucccugcccaggcacacacauauacagauacagcuuauuuuaugacuguauuguucuuguguuucuucuucuagauaaagacauaaagauugaugaaauaauuuaccuggaguugcacaguaagcuaguggccuuuguggaugaccauucauaguucauauauuuccagagacacaauacauugauaaaauugaaauaaacagaagccuaagaauuauaaguauauauucagagauauauagacaaaaaaguacuguuauaaguaaaaagacauagugggaauaguaauuauaaucacaugaacuucugugccaucucuaucuagaucagggguguccagucuuuuggcuguccugggccacauuggaagaagaauaauugucuugggccacacauaaaauauacuaaugauagcugaugagcuuaaaaaaaaauaaaaauugcaaaaaaaaaaagucucaugauguuuuaagaaaguuuacaaauuuguuuugggcuacauucagagcuguccuggacugcauguuggacaagguugaucuagauguuuaucuguagucaugaccuaacuauauaauuuuaguauguuauacaugguaccauguauccaggguagauccugccaagaacauaaauugugaaaagaaaacucuugggaugcugcuggauuguaauguguuacuccucugcccaugaauacugaaaaucaagauuugaaaggguacugaauacugagucaaaaggcaugcguuccuagacuucacuuaaucacaagcaugucuguaugagcguagucaugucauuucacuuuggggucucugcuuguaaaaugaaaauguuagacuugaucuuccagguucccuucagcucuuacauucugugcuucccaagggcuagaguauugcaucaggacccagccugggguuugugcuguuuucaagguccuaaggaacugcaucauccuuuaguccaaggagauaggauaccuuaugccacagagcccaauaauucagugagcugugaguguugugaguugcaucuacauuggggacugagccuagguuguuuguaguaacacuaggaggaccuuagaaugaugccaggagauguaauuucugugaucaacuaguugacuacucaaaaagcuugucaggacccauccaacuacagugucauucugucuuugguguuaaagaauuuagauuuaucuccuuuuaaaggaccuccuuugaauuuaagaauugccauuaucuucauaagaaucaaaacaaauacaaagaaaauauauucuugcugaauguaauuuuuaaauguuagugaggaaugucuuuauaucuuaauuuuaaggcuuuuaaaaauuaguuugcauuugcugguucuuugcugucacccuaauacugguuauguuacuuuuuugcucagugcugugaauuguucauaauaucuauagucaucuuuugacauugguaacuucuguuuucugggugaauuaggaauuaguaucaccagaagaaaagcuaaucugaauaauuguucuuucaucaucucguucaugcacaguauuuaaccaucugguuugaccacaacuuucacacuagacgagucuuuauaaugauagaaaucaugacauacuuuugaugauagacuccucuggucuuucccagguuuuggcugguauugccauugcuuuggauugagguuguugaugcaacagugggcucuggggaauggccaccaagaacuguuggggaauugcagauaaacugucuccauggguagcccuccagggaacuuaguaguugucuaauguuaauuaccuuauaccacagucuaauuacuaagaguauugucugaguccauucaggcugcuauaacaaaaugccauaaacgugguggcauauaaacaaaaguccauuucucucaguucuggaggccaggaagcccaagagcaaggcaacagcagauauggugccugaugaggcccacuuccuggaagguggccuucauaaaagugguucauagaaaaugucuucucacuguaucuucacaugguagaaggggcaaauuugcucucugggggucucuuuuauaaagucacuaaucuuauucacgaggccucugccuucaugaucuaaugaccccccaaaggcucccucuuccuccuaccaucagcuugaggguuagauuucaacauaugaauuuuugggggauguaaacauucaguccauugcagguauaaauguuuucaacaagcauuuguugaguaucuguccuuuuucuaagcuuucauguuccuacuagaacacuggauguggauauccaauaggaauauauuuaagucaguaucauuaucuuuuucucaaaacaucuucuaccuuuuuuaccuucccuuccucuucuagucuuaccauaguuaauacugauauuaacuguuaacaucauaguuaaccagucugucgaacuugaacuugaaaauuuugaaugaucuauacccacacccgaaaaaauuacucacauacuuaaaaauccaugccuuuuguuuuguuuuauugcuguuguuuguaauuuacuuauuuuuaccugauacuauguucuggaaauuuuucuacguaguucauguagaucugucuucuucuuaauguuucaugguauggguacauaaaaugcacguauuauaguuuauuuaaccauucuucuguggguggacauuuacauuauuuuuucccuuuuguuagagaauacugaaaugaauauccuugaacauguuuauuuguauacaugugcaaaguaugcagaugccaaaaagugagauugcuaggucaaaacgaacaugcguuuaaaauguugauagauaccaacaaauugcuuuacaaaaguuccuaucaguuuguauaucaguuuuucuaaguccuuuuuaaacauggacuggauuagcccguucuugcauuguuguuaagaaauaccugagucuggguaauuuauaaagaaaagaggguuaauuggcucaugguucugcauauuuguacaaacauggcuucaacaucugcuuccggugagaccucaggaagcuuacaaucauggcggaaggcaaaacuugagcaggcacgucacauggcaagagugagagcaagaaagagaguggggggagguccuaggcuuauaaacaaccggaucucaccugaacuaacugagcaagaacucauucaugaaagaugcacccccgugauccagucaucucccaccagaccucaucuccaaugucgggaaucacauuucaacaugagauuuggaggauaggcauccaaaccauaucauggaccuagcauacuucucccagccucacgucucugauuuaaguguucacucauuuacuugggcacuguuacuugggcacugucagccccuguccauguuuguauucaguauaaauugugugccgggcacucugccacauguuggggauuuaguacuggaugagacagaaauggucccugccaucauguagcuuacacuuugccacauagaacuuuugccauaugcagacucuuuuuaugcauuugcagcuacuauccucucuuucugguaugacuuuuuuccuuuuaacuuuucuaccuagagaauuuucuuucauccuuuuaaccagcuuaaauuuugcccucugucauuaucuuuaucccuucagaguuagauaguccuuccucagugcuccaucuuggcacucauaugcuuuuuguggcuauuccccugagaaguuuucgugauuuguuuguauauguaugugccuguguguguguguguguguggacacacaucuacaucuugcauauuagauuguaaacucaguauagacuuggaacuaugauauguaccugaacacuuccccagcuuacugccuucaacccuggagaugcuuaaucaauguugauuaagugaaugaauaguaaacuauaaaaugaccuuaguuuguacagggcauuguaggggauuguagauaugaauagaacuggucugucuucaagaacuuaaccauauagucagggagauaagaaacagaugaguagacugcaaggcagguugugauaagcucuguauaggacuuaucaaaaaugaguacuggaggagaauuuaaagggagagaggaauucucgugaaugagauacucugguaaguuuacagaggacagguuuuuucuugcucguaccagguguugugaggaauacacaugaugguaagauaugguugcugacugagagauuauagucaaguaaggccuuagagcaggcauugguaaauuguggccugcaagccaaaucuggcucuugccugcuuuuauaugguccuugugcuaagaaugauuuuuacauuuuaaaaauuguuaaagaauauuuuaugaacaugaaaauuauaugaaauucaaguuuuggugucuguaauuacauuguguuggaacacagccauguuccuuuguuuacacaauaacugacuauauuuguacuccagcagcagagaggaguaguuguaaaggagaauguuugcuuugcaacacuuaaaauauaaaauaauuuaguaucaagcucauuacagaaccaguuugcugacuacugggguagagaauaggaaagauucaaauagagaagagaaaugacauugauauuggggguauuagugugaguuaagagagugggacagugauucuagcagucauauagaaauuuuagggcugaagugacgaucuagcuuaacccucuuacuguauaaaauaggcacaagauugaaaauagucucaaaguccacuagcuguuaaguggcaguggagugcugcuggagugacugguacagaagccuugagggcuguagaugauaauaagauuauugcugaagaagggcaagauccggaaugaccuugcccuugaaaaaugagaguugaaguacaaacuaagaacagacuucuuuucucucucuaaauguaauguuuuuauuuuucacuuguauuucuagaaggccuuugagcccuacuuagagauuuuggaaguauacuccacaaaagccaagaauuauguaaauggacauugcaccaaguaugagcccuggcagcuaauugcauggagugucguguggacccugcugauagucuggggauaugaguuugucuuccagccagagaguaaguaugcugucuccucuguaaagguauaguggugugucacuagccucaaacuaauugcugagagauaggacuaauuuauugccuuuugguuguuuuuuuguuuguuuguuuguuuuugagacggagucuccaucuguugcuaggcuggagugcacuggccugaucuuggcucacugcaaccucugccucccagguucaagugauucuccuaccucggccucccgaguagcugggacuacaggcacacgccaccacgcccagcuaauuuuuguauuuuuaguggagaugggguuucaccauguuggucaggauggucuugaucucuugaccucgugauccacccaccucggccucccaaagugcugggauuacaagcgugagccaccgugcccggcccugguuugguucuuauuuuuaaaaucuguuuaaauguaaagcaguacuuugucuucugauuggucaaguuauaacaggacucuuguauaacuaauacuccuuacauugauuuuuuuuggauuuguaguucacguaaaaacgccucagaauuagucauuguaaggauccacagaaaucucaguaugguuuaaaccuuugguaccaguuucuucccuagaacauaauuaugucaccuggaguucccagagcaggaauuuauugcuuucauuuugugcuauccuuuucaguaaagauuaggugaaauuggaacagcacuuacauggugaccauuugagugcuugcuaugugccaggcacugccaucaggcuguggggauaucugcacaaguaguacaggaucucucuccucuuggaguugaacugguaucaggggaucguauacuuugagcuuccuagaagugacucagugccagaucaacauggggaagaagaggccacuucucagggugcagaagaugagcagucucagugaucugcuucugaaucuuccaccuuugcuuaggauuaagccccucuccugcccacccaccuuuuucccgccuagaaaccugguuguguguuaccuucuuaugaguuauuuuccucugcagucugugcuuggugaguguuguuaguaccuaaacacaaguaguggauuuggugcuggauguucuauaacacuccccugcaccuuuuccccacucuuaguaggguaugggaguuaacuuccuugggauaagaaaacaguaacauugaagauaaucauuagcuguuucucauuugcuugaaauuuccccaccacuuugcuucccugauaacaccuguuuaaaagggcucuuuaauguguuuuuucugcuuuucuucucuuguucaaggaaagucaauuuagaagccagauuccauuuuuaucucuuuacccugcaaauagcuucuuagccauuuauggcgcaguaaacauugcaaaaccugacaaccaagaagcaaguuccaacugcuuagaguuuuuaaauuaaaguggaaaugagaccugacucuccuguguaaaucuguagcucacuccagcuuuaaaaaccuuguccucaguugcugcuccuaguccuugcaagauuuucugauaaacucuaagaaauuagacuggccggcccuuccgcugcaucugcucaaugguuuggauauggauguagcuuguguccuucugcucuugcuuauuccuuuccuaggaaguauucaauucagugaguaaggggcccauuucagaggauucugagggguagcaagaaauauacuuucuuuuuauuuuuuaacuuuucauuaaaaaaaaaaucagucucugcuuauccuucuauuauaauaaaauauauacaacauaaaauuuaccacuuuaaccauuuuuaaguguacaguuaguccuguggcaguaaguacguucacauuauuguacaggcaucacuauuaccagaacuuuuucaucaccccacuggaacuccauuuuaauaaacaucaaauaauaacugcccauuacucucucccgcauccccuggaaaccaccauuuauuguaucgccuuguuuuacaaauguacuacaauucaaaggugguacauuuaugaaauaaggcuaagcuuagagaucugagauuuauauuuuacuugcuaugauuaauauuaauuuuagguauucuuuuuaaaacaaauuuuaaaauuaauuggcaaauaaacauuguuuauauuuaucauguacaacauauguuuugaaauauguauacauugugaaauggguaaauugagcuaauuaacaugcauuaccucccauauuuuucuuuuuuugugguuagguauuuacuucuguuuucaguucugcagcucacuaugccauacauuuugcuuagcuaauaguagagacacagccaucuuagguucugauacuuaucugcuuuuaguggucaaaaaggaauaugcuggccucugagaggccaauuuuccaugagaaaauuguuagucguaguauacugaugagauaugccaucuaaauccuugugggcugaacuccaagccauuugagguuuuuuuuuuguuuuuuguuuuuuguuuuugagacggagucucacucugucacccaggcuggaguucaguggcaugaucuuggcucacugcaaccucugccucccggguucaagcaauucucccugccucagccucaugaguagcugggauuauaggugcccacuaucacgccugccuaauuuuuguauuuuuaguagagaugggguuucgccauguuggccaggcugguuuugaacuccugaccucaggugauccgcccaccucaaccucccaaagugcugagauuacaggccugagccaccaugcccagcugaguuauuuuguuucuaaagauacaaaacaaaagcaguacauauucacuauggaaaaguuggacaauauggguauauaauaagaacaaaauuaaaaucuuacuacugaaggauaccacuauuguauuucucuguuucuauaucugaauccaguuugaaccauacaaaauguaauuuuguaaaaaaaaaaucgucaaauguugacaauuuuauacaauuuagcacauacacacacagcacacuuucauuugguaauuuccaacuugaauuuuagacacagauaagaaugucuucccuccagagaucagggauaauuuugauagaauauucauuuuuuuuagcacuugcucacuugccauguguugcugaacaaucaaguuauuuuuaguuacacugcacuaaaggagucugaagucuggacuagugaugaauuuugcugaucuuccaacacugaaucccucuugagggaagagaguauuucuggaacaaaggauggagccugggguagaggagaagugggcagcggcaugaacugugcugggguuagcagccucuuccuuaauucugccucugugauuaucagcucacaguuuauuacuuuuacuuuaaugcugauuuuaacuguggguuguccauaauucaucaacagaaaucagcuuuaugucauggaggaaaugauaaacucucaguuucuuguugugucaccuugggugacacccuuaagcucucuuagcccauuuccuugcaauaaaauggacaucauaauagcugcuuuaccuagucauggguaauaugaggacugaauggcaucuuuugcaugaguggaauuuguaaacuguuaagaaccaugcauuguucuuacacuggcauuuucuauuuuguuaaacuuaaaauucuuuuuuuaaaguaacaaauaaaaauuguauguuuaugauguacaacaugaaguuuucaaauguguaaguuguggaauggcucaaucaaacuaacgugauuaccucacguacuuuuuuuuuuuuuuuuuuuuuuuuuuuugagauggaguuuugcucugucacccaggcuggagugcaguggcacgaucucggcucacugcaaccuccgccuccuggguucaagcgauucacuugcuucagccucccgaguagcugggauuacaggcgcgugccaucacgcccagcuaauuuuuguauuuuuaguagagacaggguuucaccauguuggucaggcuggucuugaacucugaucuccugauccgccugccuuggccucccaaagugcugggauaacaggcgugaaccaccacaccuggccucauguaccuuuuuuaauggugagaacacuuaaaaucuacuuucuuagcaaucuugacguaugcaacacauuuuuauuuacuaugucaccaugaucucuugaacuuauugcuuccgucuaacuggaauuuucuauccuuuugaccaucucccagucuuccuucuuccccuuacucucaaucccacuaaaaaauucuaauuacuuuucauucuguaccuucuggggacuuuugagauaaucuuuuuaggucagggccaugggaucuuuuuauuuuuaguuucuucaucucugaugcuguauuccguucuuuuuacccuguaccauuuuuucucacaacuuccacaaaauuaguuuauucuuuuauccuccaccuagucacauuacuauacuucuggacagcugguccaguuugcugauuuuuagacuucuuuuuaccucauuaauuacuucaucaaauaaggaagcauuucugaaucuguacagcuuuaacaguuagaaauaguugaauaacaagaagcuaaaauauccaauauuagauuauagucauuugaugaacuauuauaacauuaaaaauauguuuagaaagaauuguuaauaauguagaaagugcuaucagugaggaggauacaguuauuuuacauuauacagaaucucagguauguauuacaguguguagaacauagggcuagaaggaaauacuccaaaauuuaaacaaaaaguaaccacaaacaagugguuucagucucuuugucuucuuauucagucugugucuuaguuaccugguuuugucccagguguuuacagaauguggacucuagggagaguuagaaagagagggaugcagcugaagcaaaaacagcuagcagagaugcaaggcaugaugugauagauacaaaaagggggugcagacacaucccgugguuguugagugaagagggagcuccuucuggccaggaaagugggaauuuccagaucuccuaggaaugcaguagaaguucauauucaguucacaccuuggauaaaagccaggcuuagauucuuauagacucaaacagaaaauuccuguggugcauuugaagcaguauagaauccugggaauccuggacugaaaauacaaagacuucaguuaaaucuuugcucuaucacugauuuuaucuguggccuugagcaaguuuugaugcuuugaucuugcauugccuuuuaugucacucguagaugguauauaaugccuucugugccagccucagaaugcuguugucagagucagucgagauacauugauugugaaugcaucagaaggucuauuagucuauuuagaugccauguauuuaugauuauuaugaucgacaggauuuguauucccuauuuguucuauguacugccugacagaguggacucuggcaucugugauuuuucaaacuuuuuuuucuuuuuguugagacagggucucacuguguugcccaggcuggucucacccuccugugcucaagcaguccucccaccucggccucccacagugcugggauuagaggugugagccacugugccuggccagcauccacaauuuugagggcauuuguagguccagaaaauguuagaaucuguguuggaugagaggcuggacauagauccaagaaaaacaaaacuaaaaacaggcugcccauuagucuugggggaaggaagagaaauguugaacaucuagaaaccuuaggaaggucaagaauucuggaacacguauaucauuugaccuaguaguucugcuucugggaguuuauccuguagguguacuuguaguuuauccuguaggugugcaguaugguguguguuacaagguuauuucagcaugauuuguaauagcaaauauuagaagcaaccuauauauccaucauuaaggggcagguuaaauaaauuuuggcacauccauaaaauggaauacucugcagcuauaaaaaugaaugaggaugcacugaucuuuaagauaauacuccuaaguggaaaaacaaggucuacuacagugcuagagugugcuacuuuuugugcaaaaaaagggagacaaauaagaauauagcuuuacuguugcacguguaugcauaaggaaacucagggggguagcaugaggguuggggggauacguuugagagagggaagcuucacugcuuuacuguguguguuauguguuuguauuuuuaaaauuuugaaccauguaaauauaguacuuauucacaaacuuaaauuuaaaaguuuuuuuaaaauuuuuuaaacgaaagaaacucuuugcaauuggaaggcaagugagguggaagacacauugaaugguugcuauaugccaggucauauccauggaaauuuauuugaauaagagaaccauuuguuucuuuuagguuuauggucaagguuuaaaaagaaauguuuuaagcucaccaggaagaugcccauuauuggucguaagguaaguagaaucuguguaugucauuuuuuccccucuugauaaucauaccucuuucuuucuauuuacuaaaccuaauauucucaaaguggaggggugauuuugucucuuaccuccaggggacacuuggcagcauuuggagacauuuuugguggucacagcuuggauggaggggugcucuuggcauguaauggaucguguccagaaaugcugcuaaacacuaaacauccuacaguguacagggcagcccccccccacccaccaaacacagaauuaucuggcuggaaaugucaaaauggccaagguugagaacccugacuuaacccuuucuccaauguaacuggccaaaggagagaugagaagccuguuaaggaaguaagaauuugagaaaaccugacuguauuguuaggugcuuuggaacaacaugcagcuggcugacuuuagguauuuaucuaggaguugggugcuuacaugguuuaggucaggggucggcaaauguuuucuauaaagggcuagauaugaaacauuuugggcucuguaggccauaucauuucuguugcaacuccucaccucugcccuugcagagggacagcagcaagagguucaggaaugagccuggcuauauuccagugaaacuuucuuuacgaauucagguaggccuuuguugguuccuggcuguaguuugcugaucccaaguugcacagcgcugucucuugcuguuugcaauuuucuguauuguaguauguccccuuuguuauguccucuuggcccucauccauguugaggauaagguagucaccucugugcgucucccacagguuaucccagaugaagauaaacagggcaggccacuuggcaagcucuaaggaaggcauaugaguccuuggaaucuucaucuccuccagugcccuccccugaccccccuuuggucuuucccaacuuuaccugccuuuaaguuuucuucuacuuuuggcuuucaguucccuuuccuggcuauaccaggguuuguuugccaaccccugaccuaaaguuggccaguuaucuuuaaccuuuggcugaaauccauucagaucgcugugcuaacucucccagagauagguaucuucagguucauuuccuguaggagagugggagcaauaacagguggugaagggaaaugugagcauauaggcuucuguuugcucuccaaauuauauuaaucccuaaaaguaaaucuaguccuuacagaguauaagggguggggacagggaagguauuguagaagauggacuguagcacaaaggagauuaggauuuccccuuaucuccugaauuuuuuuuucuucuuuucguucaguuuucagacuuugagacaaauaaaugcuaggguuccagaacccacucuuaaacuuagaaaguaacagaauuggaagauccuuagcuugccaaggacuauccaaucacucuccauuuuucagaaacagauucugaggcuuagauacaaaaaauuacauguguguaugugugugugugugugugugugcgcgcgcacgcguguguguauaccucugucauuuauucacuuaacacaugcuuauugagccaccugcucagugucaaguacuuuucugggugcuggggauaugguggugaacaagaccaaauccuuccucucauggaacuuacauuuuaauaggaaagacagaaaauaaagaaguaaacaaauauguggaauuuuauuuugaaauaaaugcuuugaagaaauuaaaauuggguaacguaauacaggcuuugaggcaagaauuggggguaaggaaguacuugugcuuucuaauauaccucucugucacuuuuugucuguuuuauggcaauagcauacucuauguauggaagcucagcuuucauagccuguucuguugcaugagucgccauuuaugugaauuaauuuuuuaauuuacaacuuaaaaaaugucuucacauccauagcaugcccaggcauugcccaggaguguagccucugcucccugccagugugggccucuuagacuauugcagacaugcucgaaaggaguggcuuucccugugguuucacugagggccauaucuaagaagaucuucuuguauucuaauuauccuuggcuagagaugagaaaaucuuaguguggagugaguucuggcguucuuuaacaaauauauugcugaaacaauagcacugugacaaaucgugacauguagcuucucuccccaaaccuacuacccaagagccuuuugcuauaagcagcagccccugcccuucugccuccuuacucugcuauuuuuuuucccucagcacuuuuuguuaccugucuuacuauuuucugucucuccugcugaaaauaaacuucaugaggacaggagguuuuuuuuccugugugcuccauugccuaaguuuguuuuguucacuaugugucccuggccugcauauuugugaauaugcagugaauaugaaugugaauauguaagugaauaaaagaaaacagcucagaagcuguggcuuugaggauggaaaagaagggaaccauaguugauaaacuaccuagcagaaaggaccuuaguuccuuuuaauauuuuggggucagacagugcaagcugucgacagcagcuuaaggagauacauuagagucuuccuggcaguucuuagaaugccuugugcuaguguugaaugggaccuccaaauuccuagugugcugcguguaugucuguugaaggagcucaucacuugcacaaggaccagaaucacuuuuacugcagcauggccaguuuucuggccacuguuccuaguuauaccuuugauucuuuuacacacacacuguagcugcugccaaggcaggaucaaaguccaaauacugcccucaaggaugugcugacuuuagcaaugccaaccaagugaagcagcagugaugucaauguggcagagaaaaggguuauggggaaauugggugcaacuuuuuuuuuuuuuuuuuugagacagagucuugcucuguugcccaggcugaauggaguacaguggugugaucuuggcucacugcaaccuccaccuccuggguucaagugauucucaugccucagccucccaaguagcugggauuacaaaugccugcuaccaugccuggcuaauuuuuguauuuuuaguagagaugggguuucaccauguuggccaggcuggucucgaacuccugaccuguaaugaucugcccaccucggcuuccugaagagcugugauaauagguguaagccaccgcgaccggcugagugcaucuugaccuuuagagagaagcuucgcuuuucaaauuuuuaagaggcuauuguacaugccagaaaguagcugaucagucagaauaucaccauauaucuuuaggaaaaauguuaguuuaguuacuugugcggugccuagcauugagcaguugcuugacugucauaauaauucugcugucucuacuguacucuugcaucuggauaacuuugucuuucuuaccuuuggagauucaagacaaguugaacaagaccaaggaugauauuagcaagaacaugucauuccugaaaguggacaaagaguaugugaaagcuuuacccucccagggucugagcucaucugcuguuuuggagaaacuuaaggaguacagcucuauggguaugaugcuuggcauauacaugcucucuacuuccuuaaagagacagguuuugucauuguuuaauguucacauagguuaagaauaacucaucauugguuaauacauguuuaggagggccuacucucuguuucacagguugaauuuccuauuuuuaaaauuauguuuagauucauccuucauccauaaagcaagcaaaucucagagacaguggaacuuggcuuuuauuuccuuuuguaagcaugaauaaaacaaauauauuuguguuuaagaagagagaauauaagauauguaauacaaaugaaauacagauccauguaaaaaugugaaaucugcauaaaggcacaaaagaaaauaagucacuauaauuccacuaucaaagauaaacagauggugucuaucuuuaugcauguagcuauagguagagcugucuauauaguuuacaucuaucuauauauguauaucugucuguuucugagaaugcuaauaguguuugucuguguguauacacauguaugcaugagcacauaugggauggauaaauagaccaaauagcuuggugcuuaagagcguaacccuggaaccagccuggauucauaccuugguuugccacuuaaaguaugccuuuggcgaguuacuucuguaugucacaguuccuguaucucuacaauggggauaguaauaguaguacaguacuuaccugaaaagaugauuauggggauuaaaugagaucauacauguauaaauguuuuauagugccuggcauauaguaaggauucaguaaauguuaaacauuauugcuauuauuaacucaaacagauuuauguuuguuacugauuaagaucauauuacaaguacuuuuuaaaaagaagcuuuuuaguuugauauauuuacagaaaaguagcaaagaugauagagauuucccuauacccagcuucuccugauguuaacauccucuauaaccaugguacguuuaucaaaacuaaaaaauuaacauugguacagugcuauuaacuacacuacaaauucuauuucuaguucaucaggguuuuuuuuuguuuugcuauguuuuguuuuaaacuaauguucuuuuuucuauucuaggagccaaccaggagccauguugcauuuugacaaauacccuuauuuuuuauuuuuugagacagagucucacuguguugcccaggcuggaaugcaguggugugaucucagcucacugcaacuuccaccuuccaggcuuaagcaauucucgugccucagccucccaaguagcugagauuacaggcgugcggcaccauacccagcuaauuuuuuguguuuuuaguagagauaagauuucaccauguugcccagguuggucucgaacuccugaacucaggugaucugcccaccuuggccucccaaagugcuaggauuacaggugugagccacugugcucggccuugacaaauacccuuacaauuucuaagugacauguguugaggucuugacauugaauaguacaaaauuugauauagucuaggauguagaugaauaaagcagugguuagcacucuaaaaccugguguuaaagauuuccaugauuaugagaccugguugccgccaucauauugccuucucuuuaauguuuaagucacuguccauugcuguauucucuagcaucaguaaaagaacaggaaaugaaaccaguuaucuuauuuuugaaaggcuggugaccacuggucugaagcuguguauaguacagagcaguguccucuaaggaaagagugaaagucaaacgggcagcaagccagagcuuggcagauugcuguaagaaugaguuugucuguauauuuaccacuuaguuuucuguucucaagagcugaagaucuuugcuuuggagagcccuuggcuccaugcaguuuuuaguugguguguuuccguaauagcuuucucacuacccacuuucaauagggcacagcugcauuguagcacaaggaccugagacacccauaucaacaaauuuguggguaaaaugaagaaugucucggggagagaggaaaguggaaagucagaucuuauauucuacucaggaacuuuacuuuucuuuccacacugggauaaaggagguuuaucccaauguugacuguguuccugaucuugaauaugcuacagcgugugcugcuggaagcagguaacuaguuuuauguggguuuccaggcuuggcuuaagggagccggcgucugagaccggggugcucaugguuuauaccucauugugguuuguuugcugguuucaucucugaugauagugugcugaaauuucacacuuuucauuuugcuuucuucugccaacucugcucauaauaguucucaaaauuccuaggacuggauaggaaaggagagaagaaggaagcuauugcagaaaaaggccacuccaaagccauauagagaacaaaaaauaaguauagacaaaggcaaauguuccugcuguuagaaggcaguugaggaugaggacaacauuauuaucagauugccuuuauuguagcuaaaugcuauuaauaucuuuuucacauugcugauaauaaugauuuuucaucuuuauuuuauugugcuaacucuauugaacuuuuuucuugauuugcuauaagaaugcuguuggguuuccacucaacauuuuuuucuuuuguauccagaggaguuucuuccuguuucuucuuuaucagaaccugucuucccagagauucuugcuuacugaccagugaccuuaccuuucucugcagacgccuucuggcaagaggggagagccucuggaacaguguacaguggggaggagaagcucacugagcuccuugugaaggugaguguccaguucuugagggaagccugugaggucugugccaguuuacaugaccuccuuuuuuucccuuacuuuuguaauuagaaaaauuacuuaaggaaagcuuauugguacaauaaaaccauaaaaguuucucuucacccaaacauaggcgaauauguauaauauuaucaaagacaucuucagucuguaaaauaguaaaauguuauuuauguuuucagucuuugcagauguccugucuagaaggcagauuacuagggaagguaguccugucagaugagauuuuuguggugagacagauuuuguuugauaagaagagauaagauagggaaacucuuucauaauuuucucaaaucaugugacccaagaugagcaguggucucauguauacuucaaauaauucucauucuuagcuucuuccauuucuaaucaaauuuauuuuuauuuuauuuuauuauuuuuacagacaaagucucacucugucacacaggcuggaguggagugguguaaucauggcucacuucagccuugaccucuuuggcucaagugauccucccaccucagccuccugaguaguugggacuacaggcgugcaucaugacacccagcuaauuuuuguauuuuuuuguuggagauggggucucacucuguugcccagguuggucuucaacucccagccucaagugauccuccugccuuggccucugaaaguguugagauuacagcugugaaccacugcacucggcccucauauuuauuuuugaaacuccacuucaucauauaaaauugggguuguacugaugaucucuaaggucuuuguguuugauuauuauaaauaugaaacugucccuuacuaaauaaauauggcagguuuugcauaaguugguguaaugcucugaucuucugugcuuaaaaucuuucaguagcuucccauuaucuacaggaugaaacucagguucuuaugcagcagagaauacaaguuucuucaugagccagcucccacuuauuuuuucuuaacuacuucucuucauuucccacauaaacacuaauccugccuuuucucuuuacuaaaugugucaugcuuuuacguuguuuuccuucccuuccaucauuccucuuguuccaaaugaugauuccuacucaucucucaaaguuccacucagcagacaccucuagaucacucaggauguuaguuguucccucuucagggucccuuagcacucuguacacacaccugauauugcagucgauaacaacagcugcuuugugccagacacucuacuaagugcuucacaugcauuauguuauuuaauuauugcuagaacacuagaagauagcuaccauaacaacuucugcguaugaagaaacaaccuuagauuaugugaccuacacagcugaaaguaauaggcaaagcuuagacuuccuccugggucgguuugguguuauagucugcgcuuuuaaccauauuuauacuucuuuccucaucacauuguaaaauuauuuauuuacaugucugucuccucugcuauguuuugaucuuuugguugaggaauauaucuuaucuuuuuuuccaguuuauauuguugugccuaauacuuagaaacuguuguuuagugcaugauucuuuguccuguauaguguaauaguuuugauuucacaucugcuugcauuuuuuugcaggcuuauggagauuuugcauggaguaacccccugcauccagauaucuucccaggacuacgcaagauagaggcagaaaucgugaggauagcuuguucccuguucaaugggggaccagauucguguggauguguaaguauaugcaaggggcauccaauagccuuauuuuuuagguuaaaauagaagaguuuuuaauaaauauuaauuauauuuuaaaaaauaaaaaauauuaaaaauauuuuacuacacaagaaauauuugaucauuguagaaaggucauuuuacuacacaaggaauauuugaucauuguagaaagauccuaauuaacugcaguuuuaaauguuacuuguaauuuuguaaccuagacaaugucaacauuuugguauauauucuucuagauauuuuuauuuucaccuuuuuauuuugaaaaacuuugaaccuacauugaguugcuaggauggcuuaaagaacaccuuagauucacuaaauguaaauauguugccauaucugcucucuacacucuuucccucccuacccgcuucuucccucaucccccaccugcauaccuaccauuccccuauuuaucuguguauacuuuuguuguuccauccagcaguguuuuuaguguacuucugguuuuaccugagccaaaguuuaauuuauuauuuugcuguaaacugaaccucauuuaguugcuauuaggcauaaagaaagggggaggacaucauuauauuuaaagaaacacaugaggauucuuuguuuuaccuguucuuucaaguagaugguuguuaguuuucguaaacuaugauagauaaacuucuguuuagaucuguugucuuuagaaaaaacgaaaucucagguuauguaggauagauagauuuaacucaauaugcugcaaugguguccuagaggugcuaauccuaucagauacucaucauauuugcagucauuauaaagacugcagauuuaauuauugaagggcccauucgaagagcaccuaauuuaguuucuuuuuuuuuuuccaggaagcauuguuuuuguuuuguuuuucuaauauguuggcgccaugaaaaucaucauguucaaauauuaguaguaauaaaggugauaugccuggcauucauuuucaaagcaaaauacugaaacuguuaaaaacagaaccacccauaauacagcagcaguuucccuuagaguacugaggugaacagggugacuuucagagggaagaugauaauguacuuacaguauauucuccuaugccauuagacucuugaagaacuuguaagaggccagagugaauagccacagaacaguuuggccuuaucugguaaauuugaagauacauauaucuuaugacccagaaauucugcuacuaggacauacucuagaaaaauuaguacacauauauaucaggauauauggacauuaauauucauagcaauguuauucaugauagcuaaaaacuggaaguaauucaaaugccuauccacaggacacagaugaauaaauuguggaaugcugugugugccucaauccauuguagcucuuauucagauugauguacaaauugccucauccaucuuuggccaguggaaacaucauauuggcuccuagguccauuuacaugacccaaguaaucuuugaaagccuuuuuucucuuucuuuccuuuuuuuuuuuuuuuugacgaaauauuccagguucagguucacuuuguccauuuccugcuccaggccuucaaucagccauuuauccaaggagcccugguucauuuaaaacuagguaaaauaauuacauaguuccaaaaucacauuuauggaacaagacagauuaaaaaaaaaaaguuaaccagaaugcaguccagagagacaaagaaauagaagguaugaaagagaggcuaagagaugcaaaggauaggaugagaaggcuaacacacaucuaacugguguuugagagcagccagagaaaauagauuaccuacaaaggcauaacuguuaggacaacugauacucaauagcaacgauggcuggggcaguuggggguagaugaaagauuggcuguaaauugaaaauugcuggagccuggugauaaguagugagaggucacagcgugcuggcaguccucacagcccucgcucgcucucggcgccuccucugccugggcucccacuuuggcggcacuugaggagcucuucagcccaccgcugcacuguaggagccccuuucugggcuggccaaggucggagccggcucccucagcuugcagggagguguggagggagaggcgugagccggaaccagggcugcgcgcagcgcuugcgggccagcuagaguucccggugagcaugggcuuggcgggccccgcacucggagcagccggccggcccugccggccccgggcaaugaggggcuuagcacccagccagcagcugcggaggggguucuaggucccccaguagugccggccuaccggcacugcgcucgauuucucgcugggccuuagcugccuuccccuggggcagggcucgggaccugcagcccgccaugccugagccucccacccccuccgugggcuccuguguggccccagccuccuugacgagcgccacucccugcuccacggcgcccagucccaucgaccacccaagggcugaggagugcaggcgcacagcgcaggacuggcaggcagcuccaguccugcaggcagcuccacccgcagccccggugcgggauccacugggugaagccagcugggcuccugagucugguggagccuuggagaaccuuuauguguagcucagggauuguaaauacaccaaucggcacucuguaucuagcucaagguuuguaaacacaccaaucagcacccugugucuagcucaggguuucugagugcaccaaucgacacucuguaucucgcugcucuggugggggcuuggagaaccuuuguguggauacucuguaucuaacuaaucugauggggacguggagaaccuuugugucuagcucagggauuguaaacgcaccaaucagcgcccugacaaaacagaccacuuggcucuaccaaucagcaggauguggguggggccagauaagagaauaaaagcaggcugccagagcaagcaguggcaacacgcucggguccccuuccacacuguggaagcuuuguucuuucgcucuuugcaauaaaucuugcuacugcucacucuuuggguccacgcugcuuuuaugagcugugacacucaccacgaaggucugcagcuucacuccugaagccagugagaccacgagcccaccgggaggaacgaacaacuccggacgcgcugccuuaagagcuguaacacucacugugaaggucugcagcuucacuccugagccagcgagaccacgaacgcaccagaaggaagaaauuccggacacauccgaacaucagaaggaacaaacuccagacgugcuaccuuaagagcuguaacacucaccgcgaggguccgcggcuucauucuugaagucagugagaccaagaacccaccaauuccggacacaguagaagcccauugggcuuuucaauuuuauuuacucuaauuucauucuaaagaauucuguuuuguaguucuccuuuuauuuuauuauuauuuuuugagacagggugucacucuguugcucaggccagaguguaguggugccaucucagcucacugcagccuugaccucucugggcucaagcgacccucccaccucagcccccuugaguagcugggacuacaggcaugcaccaccaugccucgcuaauuuuuguauuuuuaguagagaugggguuucaccauguugcccaggcugguguugaacucccaagcugaagugaucugccugccuuggcuucucaaagugcugggauuacaggcguaagccaccacgcuuggccgucuuuuuuuuuuuuuuuuuuuuuuaaucugcuugguuguuuuuuauaguccuuuuccuuggcuuaacuuuuguuuacuuaaauauauuacacauaaauauguuguauucugugucugauaauuccaauauccaugagccuuaccugauucugcuggcuucagucaugguuccuuguuuccuuauauuugugauuuuauuuuauuuauuuauuuuuuuaugagccacucauuuuucugggaaccuagggauucuuugaggccuagauugaaguuaagucuggaaguucucuucuuccagagaagauuugucauaccuuuuugaguugcuggggauugccaccacacuggaaccaaauuaagucaaauccuuagcuugucauuuuguaccacagagguagugugaauucugaccacaaacucacauaaaggcuuccuuguuacacauucuugaaagauugcuauuuuucuuuacuugaacaucaggguugagaaaaacaguuuuucuuuucucuuuugcaguagugggauuuauuucuuguacacuguagaguguggucuuuuuccagccaucuccuguuggacuccuuaucuugggcagucucuaauguaucuucugguccauccuuugcucaucugucaguguaggaguuugaagucugaagggucuggugccaccucagggugaaagcuaguuuugccacucacuuaucuugcaggauucuugauuuugcuuuguuuggggguuuagcaaguuucuuuauguuagguuagugauagguuuaaauuuuuuuuuuuugauguuuuaucaaguuuuuuaguuauuucaguuaggaagguugcucaagguauauaauauugcuagaaauagaaguuccauaauuguuuuuuccauguuacagaccuucgucuauuugaaagccccuuucucccugaaucuucucugccccacauuuuucuggguuacuccgcuuuucauaugauuucacagacuuccaaccaucgcagucauucucuguaugacuuuugguugccucuggccagauugaacacaguucuccacauuuggaguggcauugaucuuucaaucucugucuuuuuuaaaucuggguucaauaaacuuauuucagaccuuuuccuugaagucagcauuuuuauucuuggcaauguuuauuuuauuccuugcuguuccuaaugucuuuguuaguucuguauggaugcuacuggcuuuguuuuuuuaggucuguagcucauucuuuuuguuucauggucuagguuuugaacucuuuguuuucuuaaauucauguucuuaugauauuuuccuauagugagaaaguuauaagggguuuccuucaucccuuagcuuguuuccuucuguguuggguuuuuauuuugcaugcuacauacuaccuuuuccccugccuuuuaguuuguuugcauaguuuccuugccauuuucucucaucuugggguggcauucuccagacauuguucuuaugcacugugggugcuuccugucugagaccauuuggcuggggacaaagcucagccaaagcuuuguucuaucuguauuagaauaaccaggucuauucugagauucucuucaaaguuaccuaucagaguucacucucuuauuuggaagagauaauauacccuuugagcucugauuauuuaauucacugaagucuucacucuaaagagccaauccugauguucucucuucauuuugcucauuucucccuagcagccauguuuaccacucacucaugagaagaagaagaaaauaaggaaacccccucagcuugccucugcagauuuggggguauaaaggaaaauucucaggauuuugcugacuuugcgguacaguuucaagggcugauuagaaacuaguguuuugcuuacuucugcucucugcuguuucacuguuucuuuuuuuuuuuugauugccaauauuugaaguuuauugccuagauuaucucucuuuccuuguuugguuguuguuauuguagauuuugacucuuuucucucccugcacucacccuuuuuuuuuuucuucccaucuuacuccugaaguccaggccuagggguuuuuugcauugcugcaauuaaaccauaucucuauuauuuugaucuucagcacgugugagggaucagaagaaggauagagucugauucccaggcucuucuaauauuuagacuuuuauaaaauaacuaaucagcacugguauugucuuuuucccucucccacucugucucccccacuccucccuuagcuucuuacuucucucucuggaugagcugcuucuagugaagaaagaguucacuguucagaggugggaagccagaagauaaaaccaaauggcugggcagucuuuagguuauuccuagcuaagaguuaagaguuguaagcucucucauucuuuguucuucagccuuaaacuaucuuuccuucuauuaacuuuauuugucucaguuacaaugauagagguaacuucacauacuaaaagaaauuagguuaccaugugaaacauucuucuuggcuugugcuaauguuaucagauccaaacagcaucugaaagaaaauuuuccaaguagauguuguucucuuguuuucugaaauacauaucauauguuaaagugagaguuuuuauacauguugaaagaaguugaaugacauaacaaauaguuacugaggccuccauuuucuuacuucacaguuaaaauuccuguuucucuuuggguauaggagguagaaagaagugggagaguaauagcauuuuaaaacacagaaucaaaaauacauauuaaaaguagaacuuaggcccaggcacagugacucacgccuguagucccagcaccaugggaggcugaggcaaguggaucgcucgagcccaggaauucgagaccagccugggcaacuaggugaaacccugucucuacaaaaaauacaaaaguuagccaggcaugguggggugugccuguagucccagcuacuuugggggaugaggugggaggaucucuuaggccugggagguggagauugcagugagccgagaucacgccauggcacuccagucuaggugaaagauugagaccccaucucaaaaaaaaacaaaaaagaaaaaaguagaauuuagguauuccuacuuuuacagucaaaaguccacugguguuugcauaacaaugauguuuugacuaguuauuggacuaaaaguaggacacaugaagcaggugacuaggaauuuggaaauauuauugcuuaggucauuacuggaccuuacgaagagauuguugcacuggugacuuggacuuugcuggucccuccccgacucuucacagcuggcuugacgacucuugugacauucugagguuuuaugcuaaaccacaggacaugcugcugauuugcagagcugaccucagcuguaagcacuuugucuucugcagcguagaaauguagugaccuacaagugucccaugcccaaguugggugcauuauuuuuuggugauggucacauguuucauaaagacuuccugagucaaaaaaugacuuuucucaguucaucuuccauauaacuccuggccacagggauuuuguauccaaugguauuuuuguucuauguguggauauuauuuuagcaaaguucaguggucacuuucucugauuccaucuuguauuaagcuacacuaaauaugaaaacguagaaaguuuuacuucuuaucaacagaugcuaauguaugacauugagugaaacacuuuaauuccucaagggcucaguuuucucaccuguaaauugaaaaaaccuuucaaagauuguaugaaucuucagagaugguaagucuaagaaguuguccaacuaguuuaguauuguggcuuuuuguuuguuuuggaaugauucauucucauauauuauuuuuuaaaaaaauagccagguggcuaugacaugccuguguuggucaagguuuacugagagucaagucaggcauuaagaaaugugaaggccaggugcaguggcucacaccuguaaucccagcucuuugggaggcugaggugggcagaucacuugaggccaggagcuugagaccagccuggccaacauggugaaaccccgucucugcuaaaaauacaaaaauuaggugggcaugguggugggcgccuguaauccgagcuacucggguaacuauggcaggagaaucgcuugaaccaggaggcaaaggcugcagugagccgagaucaugccauggcacuccagccugggcaacagagugagacucugucucaaaaaaaaaaaaaaaauggauugaggguuuguuaggugucagccacuaugucaggugcuaggaauuugucaugaacagacuggucccuacuuucaugaauuuauaguccagugagggaaauaagaugaauaaaaagaccccuacgucuuuuuguuugaacucugguaaagaaauguguuuaucagaggggcuaggccaaacuuuaggaaaacauuucacuucacuuaaaaaaaauuaggauuuuuguuuuauuucagauaaggcaacaaacuuccaucaaguagaaacuucugcuuuucucugucuuucaaacuugucaaaaucagcaguuuacuuuguuaaaucugaaugucucuuuuuaguguauugcacaguuuacuagaauuguaaucacaauuucacauucuuuaacagguauugaaaauuuaaauuaaaauucugauauuuuugaauggcauaaaaugcccuaucuuaucugaaaauugaaaaauuaauacagaaauguaaauggauugugaauaggugggaucuggccaagugugcauuugucuaggcagugcugaguuucugcucauuauuuaguagcuuucauucuucaccugagccaaaauuaggcuuagccaauaaagccaaauuuuccuucuggaagacauggcagugucugccuugcagcaugcauccaagaccuuaucuguuucuguaucaaacauugucaagaucagggcaugaagagccggggcauuccugacucccccaacagauggcaucucuucuuuauuauaggugacuucugggggaacagaaagcauacugauggccugcaaagcauaucgggaucuggccuuugagaaggggaucaaaacuccagaaauguauguauguguggcuguuuuguccccuuuuggauuugucugucuggaguacagcuuuaugaaacuaaagcagauaauccauuuuccugcugcuucucuuccucugguaauucugguccccuuucccccuguccuagccccucugcccuuauccuuuuacauucaguaaaauucuaaauggaucagccaguuauuuuuaaagaucauucccaucccgccccacccccagaucaugcauaguauauacuacaagcaaaaauaagauccuuuuuccaaaagugagaguuugaggacuacaucuuugaauccugugauauuugcaaauuauuuggagccuaaagaaaccucucuagguacuuuaguucugcuuaccuuagaaaguuacuuaauauuauaggcugccucaggguacucucugggaaaacuuuagugugagggcuguuuucugggaggaagaauaaaaauaucuuuuugagauuuacccacauugccuuccuuggacauaaauuugauguuuaguuacauuauuuuuuccuagacuguccccuuguacaguauguuuauccuacaucuuaauauuuuuacugcaaguauuacuugacaauggggauuuauugcauauggucucaugcugugguucauauguagcauaagagaauaaaccaggcugccauucuuucuucauaugucgaucuuuggugcuugguacuuccucaguaguagagauuuuucuccuuagagggaacagauucguuguaugaauggaguaguugaggaaagucuaaagcaaauacccgugaccucauuuucucuuucaacacuauuugaaauacuauuuccaaauguguaggagaaauggggauuuuaguuucuucagguuuguugucuuucagaguuggaaggggccacugagcugaugcuuggccgcugugugaacauuucugcuugaacauguguugugccgggaagccuucuucucauucucacugaggugccugucuuugguaggcaaccguuagccagcucugccuuguguugcucucauccaaagucucugucccccagcuuuccgccugccagccuagcuuuaugcuuuggaucccucacugugggaucacuucugaguccucuuccuauugccagaaugauuuccuaaauaggagggaaguuucugcagaaaaucaguuggccucuuuuugggugugcuuaaaaagaaaaguagagcagucuaaacacuuaaauuuuuaauuuggggaaaaauaaucagaacuuacucccgguaauuuagauuagcugcuaaugguguuuucuauuauuuuggccugaguuacauuauucuccucuucccugucauuuaguguggcuccccaaagugcccaugcugcauuuaacaaagcagccaguuacuuugggaugaagauugugcgggucccauugacgaagaugauggagguggaugugcgggugagucccucuggagggcccacugucugugcugggcccugacagcagaagggcccuccuguugacuagccguuuccagucagaugggucugacugccuuugauuguggcagccagaauaugaaaaacugcauugauaguggugauugacugcagcuucagucuuuucauagguucaugaauucugaaagggaggugaucuagucacuaacuugggacuugagagacacugguuuugcggucagcgccaucacuuuuucuuucuuuucucuauuuguaaaaugaacauggacucacuuccccuaagacucuuaccauggcccgggcaugguggcucacaucuguaaucccagcacuuugggaagccgaggagggaggauuacuugaacccuugagcccaggaguuugcgaccagucugagcaacauagugagaccccaucucuacacaaaauuuaaaaaaguagcuggacaugguggcaugcaccuguaguccuagcuacucgggaggcuggggugggaggaucacuugagccccaggagguugaugcugcagugagcuguguucacaccacuguacuccagcuugggugacagagcaagacccugucucaaaaaaaaaaaaaagacucucacugugguuuagauuggcuuaaauuaauaccauugucauuaugauagugauuauuuuuaugccucacauuuguguagaggaguuuucuaguuucaguguucugucagaaucccauuugagcuuuaugacauuccagagagguugaugaagcuguuauauuauuguaguucacagauaaggaacagacugaaguagcauacucaggguuucacugcugguacguuguggggcuggggcucacauuuggcucuuuggccucuuagcucaauauuauuuucgcccccacagcgauucuguucuuauuuugugcucucagacuauucuccaaauggacuuaccuggagucaccuguguccugucaccguggugggaugcagucuucucccaguuggaguggugaaggaggggguacugguggaacuggaacucuaagcuagcagcccaaauugcucuuggcagcagaagagaagaguaauugugacauagauucucauuuuccuuuaaacuuuaaaucccuaggcaaugagaagagcuaucuccaggaacacugccaugcucgucuguucuaccccacaguuuccucaugguguaauagauccugucccugaaguggccaagguauaugagagaaaugggcugcuaaggcaggcaaauggauauuuuaaaacaaagccuaauggggcaguacuuggcaaauagaagcgauuuuuuuuuuguuuuugaccacaguagugauaaguagcucucaucagcccuaggggaagcccugcagcucaguugcaagccuuuaaaaguugcuagucucugcugugggggaagauaguacaaggcugaggccuuuuaaacuggaaauucugaaauaggauugccuucuagauugagaucuggaaauaaucugcauguaggaaugugcccaccaaaagggugauauuccacaugcugccccucagcgccucccuuucccucacgccucauccugcagugacugaggcaggaccuuucccuugugcgagaggcagccuaaaucagagcucuacucauuuccugcuugauaccgcagagcguuugaggucaugcauauuuaaauauaaaauugauaccauauuucagaugaauuauuuugaagggaaaauacauuugaaagauaaauuuuguugggaauguuaaaaauagccauuuuuuaaaaacaugggaggcauaauacaaaauagccuuguguuuauagcccaucuuuccacccaugucuugcaguuuuuauuauagggcuauaaaggaaauucucuuauguucuuuguuuuuuggaacaagcuggcugucaaauacaaaauaccccuucaugucgacgcuugucugggaggcuuccucaucgucuuuauggagaaagcaggauacccacuggagcacccauuugauuuccgggugaaagguguaaccagcauuucagcugacacccauaaggugagcuaaggaggagaucaaguguuaccaguugauuauuuugacuauuauugauaaaauaaauugguagcuuccccgcaaaguauaaaauuaacuauagaauucucaucagaugcuuguuuuaaacucucucuuugccgucaccagaucagcugguucaggugaugggguauagugguagaggugacaagcaguagugaaaaugaaccuguuaccuuuaucucaaauuggcuaagagaauuucuguauccacugacuguguguaacuagaacaugcuaguguaguggcccuuguuaaaaaagcucccugaagccuugagcugauuugagguggaggguagaggagugugaggguugguaguggaguucccaugcugguagauaacauuagagcugcugugcaacugggcuccugagcguacaugacgggaaaauguugacggaagaguccuuuggaaaaugggaagaaccugugugcucaggaacauucagcauuugagauggccacgccugccacccuugguggacugagacaaagucuagaucaguugauaacgcuauugaauauacauccagauguggaagaaguauuagcagccucaggaauguguaccuuguuuugauugcauuuucagagcuuguuuuaaacucaaguauauuaaagacuuguuuuucaaaaucggugugaucugcagccgauuuucagucagcaucuguuuuuuccuuaccauccagauagcuccuguguccuuuucccauaaccauccauuucuggaugguucagguaaugaaauuaguuccacguuaguuuuaauaagaguuaauuagggggucagauguucuauaaggaaaccaguuacauaguuaauuuuaaagcuggauuaaguagcuuuuaguuucugagcaccauuauguucucauaagcauaauauucuuaguaauacuaagcaaaaaaagaugggaagggggucagauggugauuuuaacuugaagugacaaauuccauccuuuccuggcuuccauugcaaacuuacccuugcuuucauccugacauauggucuccagagaaauauuuuaaauaagguaaaccacaugcugggcaagagagggaguaaaccgauuaacugggcgcuguucuucccugggucucagauuccucauuccuaacagagagaauuuaaacuccaucccuuaaguuccuacuauccuuuagcauuuuaaguuugaauccuuaaugugagugggaaacauaacagagaaacugagaaauaaauaggauuuccuuugcaugaugagaguucugggacaaggucugccagacagaacuauacucucacuuuucuugucugcuacuucuuccacaguauggcuaugccccaaaaggcucaucauugguguuguauagugacaagaaguacaggaacuaucaguucuucgucgauacagauuggcaggguggcaucuaugcuuccccaaccaucgcaggcucacggccugguggcauuagcgcagccuguugggcugccuugaugcacuucggugagaacggcuauguugaagcuaccaaacagaucaucaaaacugcucgcuuccucaagucagaguauguguggaagacugggguucugccuugucuauugcuuuuuuguccuaguaggcucaaggcaccugccuggcuaaguauccauagcccuagcccaccuguugucuccugcgauauagagggcuuagggcagcagcuuagggcuuaggccagaccagcuggccugggagaagaagcucccuuucucugcccugacuuuuggagggucuuugagacgggggccucauuuguaguuuaucucaucucuauggaugucuuaauaacuggcagcucuuacccuaaggcuaauguacaauuuaaugguuaggacagugauucccaaacuugagcaugcauucuaaucaccugaaggacuuguuaaaacacagguagcugggcccaccccuagaguuucugauucaguggaacugggaugggcucuaaaaauuuccauuucuggagauacugaugcuacugcuccaggaaucauacuugaagaaucauuggaauaagaaaauaauuggaaaugggccagaaggaaugaggaaaggagggcaaugaaaucuuggguuaagccaaggccagaacaggcugcaugcuuugucuaauguaucuguuaacaucuuaucugcccaucucucuaugugucacuuggauuggggaggcucuuuaaguauauugagggggaaggaaagcugccugcaggcauuucucauuugagaaagauccuuggccaggcacgguggcuccggccuguaaucccagcacuuugggaggccaaggcaaaaggaucgcuucagcucaggaauuaaagaccaaccggagcaacauagugagacauuaucucuacaacaaauuuaaaaauuagccaugaggccgggcgcggugacucaucccuguaaucccagcacuuugggaggcugaggcggguggaucaccugagguccagaguucaagaccagccugaccaacagggagaaccccgucucuacuaaaaauacaaaauuagccgggcgugguggcgcaugccuguaaucccagcuacucaggaggcugaggcaggagaauugcuugaacccgggaggcagagguugcggugaguugagauggcaccauugcacucaagccugggcaacaagaacgaaacuccaucucaaaaauaaaaaauaaauaaaaauaaaaauuagccacaugugguggugugcaccuuuggucccagcuacacaggaggcuuaaggcaagaggacugcuugaacagcccaggaauuugagguuacagugagcuaugaucacaccacugcacucuagccugggugacagagcaagacccugucucaaauaaauaagcaaacaaauaaauaaaaauuagauauauauaaaagguccuccuauagcucugauagggccauuuauuaagaccugcuauaccauuucuugcuuuagggauuacauaugacuuuuuagaacuguggagaugggcagauuacuuuuccagaaauuuuuuuaguacaucuuucaugccucagaagcaucuaggggaauauaauugggaguuggguagacagguucgaagucagugauugagucauuagaucuagaugggguuugggccuuggaauuccauuuuuauuguuccaucuaugauucugaucucaguaagaaccacugauccaguguagcccucuucuuuuuugaagaugagaagacuaaagcccaaaggguuagauugcauucauuauaaggaagacuuugaaugauuaaagagauagugaccaggggauuguaugugacugaauuuacuuuuucuuccuucauuuauuuuuuuguuuuaagacuggaaaauaucaaaggcaucuuuguuuuugggaauccccaauugucagucauugcucugggaucccgugauuuugacaucuaccgacuaucaaaccugaugacugcuaagggguggaacuugaaccaguugcaguucccacccagguaagcuugaagaagccucuuucccuuauuuugcuccaugauuuuggaagaacuugggugguacaguaaccugaaguauagaguuugacugcuagaggcuagcacguuaguagcaacuguaguauauaaaggauuucucucuugccaccuggaauuauuagauacaaagaacaagaccauuagcuuuaaacucuggcagaauuaggugacagccuccuagaccagugguuggucaugagguuuuucucucagucucuagccuuucuacucuccaauccaucuuguacacagccaucaaauugcucuuauaaaauacuuguuaccuggcuaauauuuaguucaagaucuuccugggggucucuaaucauucaggccugcuacugccuucuuuauuagacuuuucuaaccuaaucuuccaugaugccuuugaguaaaugcaccacuccaacugaguacaggucuguucauguccucuguguacagcuuagccuuccacacguuggugcauugccagucccaucuggacuaucuuuuucccucuucacaauuccaguaaaccccacuaaauuccuccagggcgagguagaauuucuucugugcccugaaguccuuuaagaccccagccauguggcccuguccccaugagagcacaugggggcugauuaucuaagauaaaagugucucauugauggugacgugguugaaggaauggugguggaauuugugaggggaugggugggacaaagcagccaacacuguucauccucuuagcaugguucucagucaugccgagaagcucugaggccagcccaugccugacaccccaagcaugagagagccgagauucccaggacuaggaacaacuuggaugacuacacuugucagaaauauugugaaagggcaaccaggaaauucccguauuuggggcugcaucauuuuagaacauuuuuucuuucuucaagguucaucucucucugucucuucuuuccuaguauucauuucugcaucacauuacuacacgcccggaaacgaguagcuauacaauuccuaaaggacauucgagaaucugucacucaaaucaugaagaauccuaaagcgaagaccacaggaaugguagggacacuuggaguuuuuuuucuucucuuggaaauuuagguguugguggagaguuugaaggaaucauaugacccggagucuguuccugccucugccccuuugccacagacaucuuuuauuuguugacuggagcugaugaucucugcaucacccaccccuuaggguugcugaagucucaaaugagauacacuauaaaguaccuuguaaguuagagacuucuguauaaaagcagcuggugguaguguccauuugaaaagaaaauuuugucacaggaaagauaguaaacauguuuuuucuggaauuuucuuaggcuagucccuuuaugcagaaaggcagacuggaaagucccugugaaaaauugacuaugccagcuguuuuucugauagaaugaugggaugccuuagguggaaaugggguagggcagugcacaugcgaagcuaggacucggggagaaggggcucauugcugcaguuuuauucuugcuuuuggaccuggccucacuaauaaugucucuuucuuuggauuuguagggugccaucuauggcauggcccagacaacuguugacaggaauaugguugcagaauuguccucagucuucuuggacagcuuguacagcaccgacacugucacccagggcagccagaugaaugguucuccaaaaccccacugaacuuggacccuuucuagucucaaggggauuccagccuucagaagguucuugggauauggaacaggccgugcacaacuuugacaucuggucuugcuccauagagcacaacucaagauagaccaugagacagcuugagccucaggauucuuguucuuccucuuaucuuccuuuugugguuuuuaauuugaagaccccagagaauuccauuacauaaugauuuugcccuuguuauaaauguuacccuaggaauuguuuuaaccauuuccuuuucuaaacucucuagcuuucaacuuuacuuaaacauugugugguagcucugaccuguccugauucuuuagagaagcugggguacaguuuaugagauagcuagagcuucuuuguuaucucaggcaggaggcguuuacauaacagauguuuccucagcugggugugagguauacucuaagcaggaggcuuuuucagccuucucucucuuuuuuuuuuuuuuuuuuuuuuuugagauggaauuuugcucuuuugcccagucuggagugcaguggcaugaucucagcucacugcaaccuccacccacuggguucaagcgauucuucugccucagccucccgaguagcugggauuaccggcacccaccaccacgccuggcuaauuuuucaauuuucuuuuucaguagagacggguucaccguguuggccaggcuggucuugaacuccugaccucaggugauacccgcccccccgccucagccucccaaagugcugggauuacaggcgugagccaccgugccuggcccugucucucuuaagaguagguucauugucugucuuagagucacuucuauugcaacucauuuucuuuuuccagggcacagaucgaccaagcugccguucccuauucugcaggacaggacuauucuagcauaccugcuucguccacccaggcaggguuugggguggucucuucugugccugcaguccccauuugacacuugguugccaccaucuuuggagauuauuguuuggaaugaugcuuccauuggcuuuuucuuguuaccauggacuaggaagaaaacaugguuuccaaauaaucugggagcuuuuggccauggugccgccuuccugaauuggcaguggucagagcacaccugaacccuauccugggcuggugaugagcagaaaucagaccuuuuucuaugcuuuuuugaauaucagaguaggaugaacacccagauucaaauaugucaccaaaguugguggugguccuucccugcacccuugcguuaagccauuauguaaugaaaauguguuugcuugaaggaacagcucaaagcaccuucacaaguugccuugacuuacccuaggugggugugaaagagcacccguagcaaggaaaauuuucucuauuaguguguucuucugccucuucccccuugauucagcuuucagagguacuauggcaguuuugccucaggugcugaacauuucucagcccuggcuaaaagggagcagcacagggagagaaacaggauaggaaagcagaauggcgagcagccuauggcccagggccuguaaucccuucccaagacuagcugcucaggguggugcagggacaggaccagacccugcgccuauuuccugccuucuuuccccuauagggaacucuguaggcugagccacuguccugcucuuaugacauuauaucuugugccuuucuccucagcagugagcagugagcuacuccuggcccaggcccuaggggaaauggaucagucuuugagguuucuauuuggggaggggaguacuuaagaugagucaaaagacacuuuccucuguuccauuccccaucucagggacuccugaauauucagccucuccaggcuggugucuucuaguuucccccacugggaaugcuggcugggagagccaugacuaccagacuuuuccucaggcuccuuggcauguuagucugaauuguucuugagcacuguacuacugacccaacaacugugacuagcuggccacgccauucagggcugguguggcauuuauguguguguguguguguguguguguuuuuccuguuugcccagcagugcauuguggguuccaagaguggguaguguguguaugugugugugucagagggagaccuggcaggcaccucuuugagaguagcuguggucagagcuguuuggucagugcauuauguugaaugagguccaggaacccagagccacccagcagacaccacuguggcuugccagcugccaagauggagaagcaugugccccuguagagcgucuccccagaaccagaccccgagccacucgcuuccucugugcugugacaacauuggugccaggggagaugguguuuuucaaagggaccuacuguagccacuuuaauuuacaauuaagagccuuaguuugacuuaacacuuuuguaggcuuuucauuguguauuuuuguguaugugugcauauagcagcuacucuguagcagagguggguagagacacuuaauaguaucaugucgcaugcagaugucacaucggccucugcaaaaacuguacugucuuguuucugcauuagacuuaaguagucaugugaauauacugcuaugucacuuuuaauauuacgaguuuuauacuuggaaaaugguacuugcuucuuuuaaaucucugucuucucuaaccucccccuucccauuucaaugcucccuuccuaauuucagcaauaaucucaaaaagcaauuaaauaguuaaaugacccuaauuguaauu

SEQ ID NO: 16264 - RNA, 1049 nt, Homo sapiens
cuaggaagacucccugcaugcagauucuccagaggagaaggugagcugucagaggggaaaaguucugauccaaaccucuucugcuucguagaugggaaccccaaguucuagagggaauguuccacagcguucaagagcaaguggagcaacccacccaaggaugugcagggaguugguggaacccagacgaaugcccagguuuccuggcugcaugcucuggguucuuucuguggcccucacugggcgcugggguuugggagcuccucuacguggcacuccuggcaucuccucuguggccacugcugccccggcugugcuguggaagugaaucagccauuggaaaccucacuugucauuuauuaaugcagauaaugaugcugaccugcuucccuagggagagcugauuaauaagcauuuuacaaccuuuugaagcaacugcuccuccgaggcugguuaaggagauggagggaugccuccuggcuccuaggaagggaccccacugcugccuaggucucagccucucugcagcuccccuggccuugcuuuucaaggggacagucccuccuuucacaccaccauaaacaaacacacugaaaaugcuggggaugugcugggggucugacuccaggggccauauuuucaccacacggagacccccccuuuccuguggauucugugccuuuucaaaaugguagcuacaccaauggacuuccuugccccaaaggcccgugugcauuuccagccagcgagagauagacugucuccaugggaggugccuggcuuccccaccacaggggagguaucccacagggcugucuucagccucaugccaacccuucucccggguaccuaccaacccucucaggcaucucggaacacgccuccgacucugcuuagaggaugaggaguguguguaugaggccaacacaggccuuguggguuccaucaacacccacugagggccuaugaccagggaggaugcuaggacggggccugcugcugugcaagagaaagggucucugcucuuggagggcauuagggacucaaug

SEQ ID NO: 16265 - RNA, 1049 nt, Homo sapiens
cauugagucccuaaugcccuccaagagcagagacccuuucucuugcacagcagcaggccccguccuagcauccucccuggucauaggcccucaguggguguugauggaacccacaaggccuguguuggccucauacacacacuccucauccucuaagcagagucggaggcguguuccgagaugccugagaggguugguagguacccgggagaaggguuggcaugaggcugaagacagcccugugggauaccuccccugugguggggaagccaggcaccucccauggagacagucuaucucucgcuggcuggaaaugcacacgggccuuuggggcaaggaaguccauugguguagcuaccauuuugaaaaggcacagaauccacaggaaagggggggucuccguguggugaaaauauggccccuggagucagacccccagcacauccccagcauuuucaguguguuuguuuaugguggugugaaaggagggacuguccccuugaaaagcaaggccaggggagcugcagagaggcugagaccuaggcagcaguggggucccuuccuaggagccaggaggcaucccuccaucuccuuaaccagccucggaggagcaguugcuucaaaagguuguaaaaugcuuauuaaucagcucucccuagggaagcaggucagcaucauuaucugcauuaauaaaugacaagugagguuuccaauggcugauucacuuccacagcacagccggggcagcaguggccacagaggagaugccaggagugccacguagaggagcucccaaaccccagcgcccagugagggccacagaaagaacccagagcaugcagccaggaaaccugggcauucgucuggguuccaccaacucccugcacauccuuggguggguugcuccacuugcucuugaacgcuguggaacauucccucuagaacuugggguucccaucuacgaagcagaagagguuuggaucagaacuuuuccccucugacagcucaccuucuccucuggagaaucugcaugcagggagucuuccuag

SEQ ID NO: 16266 - RNA, 20372 nt, Homo sapiens
ccaaugaaaaaaaaaaaaggaaauagcguauuuguuuuaacuuuuuauuaaaaugcuuaggauacagauugacuuucuuucguaaaugacuguuuuacuuuuccugaaguaggacauauaugcacucugauaaaacagaaugagaagucauaauucaugggaauuccuauacaaggugcugauccuguguuuggagcugagcuccucacagcagcuucuuucagcuaucuuauaggaauaguguuccguggggcaagaaauacauugguucuaacugauuuucaauccccuuucuccaguggaauaaaccacuuucacaaagagcugcccuauguauaacccacagauuucuagcuugcaacaaagugacaagggacaaauaggggaaaaaaaaaauuaagaaaacuaacacugaaguaaucauacuucucaugucuccgaacagagaaguaugggggaccuuuaaccaaaggaaauuaaaaauaugcaaguuauauuaccuaguucauucacuguuagcuagauuuguucacuuaaggcuuuaaccccuuuccaaaccaacaacuuugucuuaauccagcuauguuugcuaauaaacgaaaugcaugcacuucccacauauauacuucacugagccucugcauucaguaccuggcagugaaaaaguaugcuuuccccacaagucaguacuggagaauaagaaugagaacuccaacuaaagaacaaugccucccucaccccaguaauguuauccacauuuucccuacccucacauuagaauaaagacauccucccaacuuuucaucuccuaucuccaaucuguucauaggagauauaucuuuugaucuuuuauuauaaggguagaauauagauuaagaucaucaaaauccaauuucacauguggcacuaggaaaauggaaugcuauaaaauuaauccccaucacccaaguagggaugccggugcuuuuauacugagucuuuacugccaauaagugaugcugccuccaaaggaacagcucuacagaaaguuuuuggguuaguguuucccuagcuuauuucugcaauggagaaagacaauuucauaccaaaaaaaaaaaaaaaaaaaaaaaaaccuggaaaagcuacagauguuaaccuuuacuuuaaacaccaauaaaauaggugucaaaggagaaaaaauguaaaaaaaagagcucccaaacagccugagagaccaaauucugcaaauggaaauuuuaaagcccacugaauacauuuuucauggauccaaacaaaugcuacaauacuuuuaaguccucaacucacagaauuaagagcccuuaagcuguuaacuuuguccugucuuccuauucagaaaaaugucccccuagaaucugugcaaaaguaacugaugcaccugcaguaugugacacgagagauguucucaacucuuuuaugaggucaaagucacuuuugauaacugaaaacgaaaaaggaaggugcuauagagagaaauuaaauuucacaaaaguauaaaagcaaagacuggcuaaaaucuguaacuucaugaguaagaauaacaacaauaacccauucuauaauuaacuccuccacagugaacaaucugcuacacauuccuugaugaggaaugaaccuagcuuaccacaguggaaaccugccacaacugcaaggccgggguucugccccuuuucuaguucucugugcacaagguuaugccaccuacuccaaggcagucagagagacaggugagcucaggggagcuucucucaccaaccugcuaacucagcaggaguaaguuuacccaaaugagcucuggccuccauaucuguucauaauuuuaugaaguaucuaaaugucauucauuaguuuaaaaaaaaaaaagaauagaaaacucuggaccaaguaaauugugaacucaaaaaguuaggagggauaccaauuacauuaacaacgcuuucuuuaaaaaauagaaucacuuucuuuugaaucaaccacaguggugagacguguuuuucuuuucaggugccccaugauggcauacagcuuuacccggcaaauccugccagcuuccaagucccaggauacugaccugcaccagcacguggggcagcauuaccucccaacaguguggagaagagcacaugucaccacugggcaaugagagaguugacagagacucuuggcuucucaacgccagacaugguuggagagcuuuccuuguucuauuagaaaaguucaugaggaagcugugaauaggaucaguccagagaaguaaaacucuuuuauuuucaccguccaaacaucagucaauauacugggagagccagcggaaacccucgccguaaccuugccucuugagcacacugcacaugaacacuuccauggggcgagcauucagcuccuucagggucacauuccccuaaaggaggcaaaaccaagaaaggccuguuagcaucucugugguggaaaagauugaaaggacgaucauuacaaucauuuuauccauuccuuaaaagcaaaccuaaguagguauuaauuacagaaauguggucaaggccauauagaugacuuccccaggcuucguguuuucaggauagaauaagcagcacaguucuauucccagccuuucucucucugaagagcauuugcuuugaacacccaauauuuaucuguaaaguuauggcagcaaaccaagaaaaaagccacugggacuuauggaaccagcaugcccucugaugcagaaaagaggucugggacuguuuaaaaauaaggacauucucauuaacaaaagcaugcagaaauaaacacucauaacagguggcacugaagaaaugaagaauucauguguauuuaauacugaugcaaaagaggagaaauuaaaugaaagaaaggaaguauuucuauaaagaaaccgauaaucaagaagaggugagacuaaggaaccauguaaaaaagucagaaaguuaucacagaaaaggaagauauuuaaaaacuaaauaugccaaaaccccaagcuaaaaagaacaguaagauuccugcuuaacuuuaucugaucuagauuuucucucucucaagccugcuuuucuacaagaguccuccuuccaauugaagacaguaaaaacuauugauuuggaagacucaaguucuuuuucugguuuuaucacugacuugcuguguagaccugaacaaaucacucucuguuucuuccucugcaaaaugcggccaacaguccuaccucucucagcaagaagcaaugaggauaaucaagugcuuugauuucaaugcuuggaaagugauugaaaugauuauuuuucuucauaaccugcaaacuccaguccaaaaaaaaaauuauuuucuggcuaaaaagggcuauuucaaaagcaauuucucagaaucaaauuugaaagauaaucauaaacucuuagaagaguaaaucugccuuuucuaccauuuccuucuuccucaaauaccugaugaaugaaucccauuuaaaacguuaaaaagaacacacuccugccucuagugagcuuacaaaauacucacaguaaaacuaauccuaagccuguuuaagccuuuaaaagaaaaggguaaucuagauagcgaaacaucauguuuuaaaaacuguuaauguccuuuauauguaacccaaauauuuuucucuuaccuuuccuguggucuguccauaaagcccaaauaucucacggaguuuuucuucacugauugcaucuguucugucaauuuuguuacccaagauaaggauuggcacauuggauauuguuucaucagucauuaaagccuaaagauugaaaaaaaagaaaaaaagaaaaaaaagaauuaagugaggaaucuacaaaagcccaccagauaaugaaaauucugacuuccacuaaucuuuuaaggcauuaauguaaagugaaaaucugaucaacuuuauaccugagugauuaaagauucaccuugacauuacauaacacccaugacauuaaguaaaaaucuccuaagugccucgaaacaguugcaacuuuauucuauuuauuuacaaggcagcagaacugccccaauauuaacuuuugagcuaaucugcucagccacaaacuauccucaggaugucccucagcaaaguccuauaagaaugaaugcucuggcuacagagccucaaagaugacuacaggaauuccccaaguauucaccaagucccauugugugcgaagaacucucucaggcauugagaggaauaaaguaggaaggguaacuaucucaggcacugaggauacaaaaggaagcacauuccuguccucaaaaaaauccucacucuauguucacauuauguuuuuuuucuuuuuucuuaaucucagcucacugcaaccugugacuuccagguucaagcgauucucccaccucagccuccugaguagcugggacuacaggcaugugcuaccacgccuggcuaauuuuuguauuuuuuuaguagagauggaguuuuaccauguuggccaggcuggucucaaacuccugccccucaaguaaucugccaaccucagcaucccaaaaugcuggaauuacaggcaugagccaccacgcccagccacauuuauguuaacaaagccaaguaagaacacaauauaguggauaagugucacaaugaaugggaacugaauauuaacauuaagacaaguucagggaaauaaaauggcaauuuugggcuugagcaaagucuuagaaaagaucuggaaccuaaacagggcucuaaaggaagggcaggguuuggauagguguaaaggagaaguaagaacauaaacaacggcuuugcauuaggacaauaauucaggaagccacacaguacugcauggcuggauucaagcauuuagauagacaugcagcgacaaaguaaauggaugagaagagaugacucacauuaggggccagugugagaagugagcugcaauauauccuaaaagaccacaaauccagaaguuagugaauaaaaucuuauuuuucaguauaaugaauucacaaauaguaucuaucugugguguucauguaagagaucaugaucuagcuuaagguagagcauucaaugaauacugcaggaggcauuuugaagaaagaauugaagagaccaaugucuaaaugauuaaaaaaaaaauuuaaaaaagacaaaugagucaaaacugccacugauuucaagccugggaaucuaguugucaccaauaggaaagcuagcggggaaagcagaguuaaagagauaaagaggaauguacuuugaccaucuggaauuccaggaaauguuacacaaaauuagaauaagaauguccuucauucauuaagcaacaacaaaguaccuaaugugucuaaugcuuugcuaggugcagggguuuugcaaagaaauaagacacagucccuaucauguuaguucauagucugaugagagagaacuauaaaaaaaucaauaaagacaacagacauugguaaggugggagucuaacacagucucagaggucaagggaggcuuaccagaagcagucauaucugaacucugaggucucuuauagaacauuuuaaaauuugccgacaaagcgagggguugaggagagguacaggugaaaaagccaggcaguagcuacuugugcauauucaaggauggcuaaguuguuuguuuggaauauaguucaagguaggcaguaaaaagaaacagagggaggaucaugaaugauccuaugugcuaugcaaaagauuuauagauuuuauccugaaaaugauagagaacuaucaaaggauauuaaguagggcaauuaagucugagaaaguuccuucuagcauuauggugcauaucagggucaugguaggauuuauauuaauucacagauuuguggacugcauguccagguagguggugggugggaaagacaaauaguuccauucuaggaaaacagaaucaguaguaggaguugucgagaguaggcaggauuagguaugagauuagagcucaggagaggucuagaggagagaaaugcauuugagagucacugacauguaggugccaaaugaagggaguagaugggaccagccuaggagaaaguacucuggagaacaccaacauuuaaggacuaaccagaagaacuagugcuucucaaagagacagaaguaucagccagagagguagcuccaaaaucaagagugaaaagaggaguuuaaacaaagagaauggagaccaugcaugguggcucaugccuguaaucccagcaccucaugaggccgaggcagaggaucaccugaagccaggagacugagacaagccugggcaacauaaugagacccugucucuacaaaaacacuuuuuuaaaaaaaauuagcuggguguggugguguaugccuguaguccuagcuacuugggaggcugaggcaggaauaucgcuugagcccagaagucuggagguuacagugagccgugauugcaccauuggacuccagccugggccacagaggaagauucuguuuaaaaaaaaaaaaaaaaagcaagguaaagacugcguggcaggcaauucuacaugaggcuggagcuauagaugugagaaacauacuuagaaauaaauucaagacagguucaaguugccagaaacaagaaugcaaggaguuauaaaucaaagagaaagaagagauauaggguaaaggaguagggauaacaaagccaauaguauagaaaccaucaagccaugagaaaaugcaauguugacaaaggagaaaacuugaagugaguccuuaauaguaucaaaggauguaugcaaccaaaacugaagacugagaacagaccaugaaggucuggcaagucauucagugggaggguggguaggcacaagcugagaaugcagauucaaaaauguaaagaacucuaauaucgcuuuuaggcuuucacuaugccaacacuacuuauaaagaauuacuguucaugggccaggcgcgguggcucaugccuguaaucccagcacuuugggaggccaaggcggguggaucaugaggucaggagaucaagaccaaccugacuaacauggugaaacuccgucgcuacuaaaaauacaaaaaacuagccgggcgugguggcacgugccuguagucccagcuacucgggaggcugaagcagaagaaucccucgaacccaggagguggagguugcaguaagccaagauugcgccacugcacuccaaccugggcaacagagcaagacuccgucaaaaaaaaaaaaaaaaaaaaaaaaaaaacagaauuacuguucaugacacgugaaacagaauacuauuaauuaugcugggacaacaggcauaaaugaggaguauccugagcaaacuuggccauauaaucacuguaugauagaaacaacaguuaauuuauuuaaguuugagcugaguuuccucaggacauugaaaagcaaugucuuagauuuaaaacauuuuccuccugcaacuaggucuuuuugccaaauguuaacuggaaugacuaauuauuggcacuacugagcuauauuccuuaaaaaaaaauagaggccaaaaaagaacaaaauauacauuaaaauacacauuaaaggacaaaacauacauuaagcucaacuuuggauuccacgaggcgagaaugaucugcacaguccaccagaaagacaaucccauuaauugcugggagauaauuuuuccaaacgcgacgugcuaaaaaacaaaguuuguaguugcaugaguaaaaaauauacauugugaaaaugaauaaccuaauggucuauaaaauggacaaaucuuggucggguuucaguaagauuagacucuauggauuucuccaaguucuggccaguauuaauucagaacagaggaugcaaacugaugguccaugagcugaaccugauuuuuguaaauuugaaaaucagaguuuccgcuuuuuuugaaaaacugcaacaucuggcaaucccaugccuacuuauccacgugacaauuaucagcaggaacuaagcaguggcugccccuucagaugaugucugaacacuuuugcuugacaaaauuucccugcugucuuacagucagccaauuuuacucacuuaaaugacuugccuugccccuggggccaagucuaguuugcaaccucugaguuaaaacaucaggauacaaauuacuuguccauguaacuuuagucccaguuaguuucuagccaacuuguguguaggcgucuugacacauuccucugcucagcccuuagggagacuaggccugacaagugguucaaggccccaggccaguuaucucaaccuaccauauuuaacccagcaugccuuauaaauauuacuugguuuuuugcuugugacaugaaacgauaaaggcugggaagcagugauuuaauuguacuaucauuucuaagccauuaauuucuagcccuugcaauagaaugaauaacgaaccaucucuacaucaguuaauaaugguuaccuuuaaagaguggagcuaggaaaaagagguugaaggaacuuuccauuuuacuuuccguaguucuauacugauuuuguuacaucgaacuugcucuccuuuuauaaguuaaaauuuuuaaguuauacaaaaaaaaaaaaaggaaaccuccagauguacaguacuuuaguaacuuuuauaaaaugguggcuagguuauuauguaaaaguguuuuuguuaaguagauuuuccucagucaaauaaacaaaacuaauuacaucaauacauuucccuucuuacuuuuaacaaaaccugaaaccuaaauuuaucacaccaaacaaucuacaauucccaguucagguauauaaaaccaucuggcgucugguccuucuacauucuccagauggucuagguucagucuuaucuugcucugaauuuaaauuuguaagcaguuacaaauccuuuuguggaagcagcagaaaggacaccauauacccauucuuacccaaaugaaaaaaauacaagcuccuuacagaaaaaaaggaaacaaaaucauuucuaaucccucuaucaaaacacaccccuugucaauauuuugauauuuucuuccagccucuuuucuuuacugguauuuuaugugauuaugaucauaauauacaugauuuuucagggcauaaauauuaaauaaauuaauuaaaauguaauuauauguuaaugaaaucacugacuauaaaauuauuaggcuuaacaacuagaaaugaccaauguuauauuuuacuauacauuuuuuaaaaacuguauuaggcugggcacaguggcucacgcccauaaucccagcacuuugggaggcugaggcagguggaucaccugagcucaggaguugaagaccagccugggcaacauggcggaaacccagucucuacaaaaaacaggugggaggauugcuugagcccaggaaguagagguugcaguaugccaaaauugugccacugcacuccagccugggcaacagagcaagaccccaucucaaaaaaaagaaaaaaacgguauuagcucaaccuaauguuucaaaacaagacuucuccacucaguguaauaacaaguaaguaaaucugacagaaucucaauaguuccuuuucccuacuuucccagaauauuuauucucacaucuuaaauguuuuacuccuauaccuacggucuugucaaaugugaacugagugcccaucagacaaagaugacacucuguaugucucuaaacaccugauaggaaucuggaaaccaaagacauagccugaguaggcaaaaagcacuucugaggaaagcaaaaagguagaaggaaauguuccaccaacugucugaaauggauagaauauacaaaauaucaacuuguaucagaguaaucacacauagucacuguauuacuuuugcaacuuuugacaagucugaaauuacuuauaaauauuuaauuuccuacauacuuucacuccauugaauaaaggaugcaaaaaugacuucauaacuagauauaugauaccguauaccuggucaagaugaaaaaaaugguauaaaagagauuaucaggacaacugaccaaaaaaaaaaggaaauacagaguggauaaaaauaaaacuuccuggauuugauaacuauuaugauuauauacaaggaaauaucuuuguucuuagaaaauggcacuaaaguauuaaagaguaaaggggcaugauaugcucaccaacacuucauuaaaaacaagcauuaauauguauuauauaaagaagaggcacuaaaguauuaaagaguaaaggggcaugauaugcucacaaacaguucauaaaaaauaagcauuaauauguauuauguagggaggaggagacuaacaaauuugagcaaaagguauagaagaaaauauacuggcuuagggcaagccuaguuaaaaugaugaaauaauuacucuuguugaagcaauacauauaucuuuuaacauauuuuccaguuacaagguaaauuacauuaauaaguaaaaauguaguaaagauuaaaauggcaagaugcuguccugcuuuguaaaaauuuucagucaagauuugaguugaguuuggcuauaucaggcaaauacuuaaaaguucaugaauaguuauacauuauggcuaacuuuaucccagcucaauaggguaauauugaaggggacuucuguguauuauuuaaugcaacuuuugacaaguuugaaauuacuuaaaaaaauaaaugaauaaaacaacuucacuaaaguaauaagauccuaauucuaaaauguaaguaauuuaaaagguaaaaaugacacacugcuuuuaaaaggagcugggaggcacaaaaaaaauaagucaauaaacaugcuuuccacugagucaucacuuaccuugcucgugcccaccaagaucaaaaguuguaaaggucauuccagcaauuguuagcucuucugaugcugaaaaauuguuuaaaaagaagaaaaaaacuugucaacucaacaacccccaacuacuaguacuauaagccaauaucaaugcuuucaucuuguaaagaaaaagauacaagaaguugaguguggugguacccgccuguaguuccagcuacucaggaggcugagggcaggaggauaaucugagcccaggauuuuugagaccagcccaggcaacgccccacucccaacaaagaaaaggaauacaagggugaaauguucuuaaacuauucuaaaagccaaagguuucuuuucuuccaagcuauuuuccacuucuuagaaguagguauaggagaggugucccuuuacaggaccagugacaacagauaaugacaaaguuccagagguuuagaucugaaaguacauaaccugagugugucuuacagggaacuuucucguaugaguuggcuuuugggacuucaguuaauaaaagaacuccaccaacuagggauucauccuccacgccuaacacugaccuuuaaagaucaaaaggucaccugauauuuucaaaccuacucggauguaguguuggaacauguuggcccaaucugucaucuuugagcaugugaagaagagugguuuugccugcauuauccaaaccuaagaauacaaguuuuccagauuucuuguacaguccuaaaagagaaaaaaauuguuaacacauuugcucucuacagaccaaagccuauuuguaguuaaauuacugagggaaaggcacaaacuuugaaaccuguauuucaaggaaauggcuuuaccuaggaacuggagcacacugcugaagccauuguagauccacucaaagaugaaagacauuauuaaugcuuacuaccuguauaaaauaugaaaguagcaaacauuagcuuucugaaugacaguacaauuguggagagguuaacucuuguucccuagccaugaugcacauuuauagucucuuguuuucgggaauaagaaagcaggccaggcaugguggcucacaccuggaaucccagcauuugggaaagccaaggcaggcggaucacuugagcccaggaguucacaacuggccugggcaagaaagcuggacucaaucucuacaaauaacuaaaaaaauagcuggacauaaugacacacaccaagagucccagcuacucaggagggugagacagaagaauuacuugaacccagggguuugaggcugcagugaggcaugacggugccacugcacucacuugggcaacagagggagacucugauaaaaaagacaggacaggacaggagaaaggaaagggaagggaaagggaaagggaaagggaaaaggaaagggaaagggaaagggaaagggaaaggaaaggaaaggaaaagaaaagaaaagagaggggaggggaggcggggcaggggaggagggggaggggaggaggggaaggggaggaggggauggaaggggaggggaggaagcaaaguaaagagaaacuaauauucuuucuugacacagauuuugcaaucuggaggagagucuagaauccuuauaugugcaaaaauaacuuguuuccuaauaguuuuugaucuaugauacucagagaacuaggaguuaaaaauauaaaggcauaccucauuugaugauacuuuguggauccugagguuuucugguuuuuuuacaaauugaagguuggaagcagcccugaguugaguaaguguaucaguaccaucuucuaacagcaugugcucccuucaugucucuauguuacauuuugguaauucucacacaauauuucaaacuuuuucauuauucuuauaucugucaucaugaucuaugaucagugaucuuugguauuacuaguauaauuguuuuguugugccacaaaccacaaccauagaagacagcaaacuugacuuccuccacaguccugcccccaccccaagccucccuauucuccaagugaaaguaacaggucucucccuugaaagcaaaaguuagaaaugauuaagcuuagugacgaagacacaucaaaaccugagauaagccagaagcuaggccucuugcacucaacaguuacccaaauugcaaaugcaaaggaaaaguucuugaagaaaauuaaaagugcuacuccagcaaacccaugaacgucaagaaaaugaaacagccuuauugcugauaaaaaauaauaauaaaauaaaaacacgagguaaaaaagcaagugcugauguagaagcugcagcaagauaacugaugaagguggguggcuacacuaaacaacacauuuucaauguaggcaaaacagccuucuauuugaaaagccaucuaggacuuucauagcuagaggggagaugucauugcuuggcuucaaagcuucaaggggcaagcugacucucuuguuaugggcuaaugcaaggugacuuuacguugaggccaauauucauuuaccauucugaaaauccuaggacccauacucauuuaccauucugaaaauccuaggacccauacucauuuaccauuuugaaaauccuagggcccugaagaaugacacuaaaucaguccaaguggagcaagugagcgagcagagugguugugugguugcgucucggaaaccaguagcacuugcagcauggcugaccaacugacugaggagcagauuguagaauucaaagaaguuuuuucacuauuugacaaagauggugauggaacuauaacaacaaagaaacuaggaacuguaaugaggucucaggcagaaucccacagaagcagaguuacaggacaugauuaaugaaguagaugcugaugguaauggcacaauugacuucccugaauuucugacaaugauggcaagaaaaaugaaagacacagacagugaagaagaaauuagagaaacauucuguguguuugauaaggauggcaauggcuauauuagugguguagaacuucaccaugugaugacaaaccuuggagugaaguuaacagaugaagaaguugauuaaaugaucagggaagcagauccugauggugauggucaaguaaacuaugaguuuguacaaaugaugacagcauaaugaagaccuuguacagaauguguuaaauuucuugcacaaaacuguuuauuugccuuuuguuuguaacuuaucuguaaaaggcuucucccuacugucaaaaaaaaauaugcauguaugguaaucaggacuucauuccuccauguguucuucccuuacugucauugcccugaaaccuuauuuuagaaaacugaugaaguaacauguugccuguggcuuacuccggauauaucuaagcccuucugcacaucuaaacuuagguggaguuggucaaauaagggaacauccggguuaugccuuuuuuuaaaguaguuuucuuuaggaacugucagcaugguguugaaguauggaguuguaacucuguguggacuacggacagccaacaauauguacuuaaaaguugcacuacugcagaauggguguauuauccagguacucccagguaccucacacacuguuuuuucuguacugcugguccuguaccagaaacauuuucuuuuacuguuacuugcuuuuuaaacuuuguuuagccacuuaaagaaaaugugcuuauggcacaauuugccucaaauccauuccaaguuguguauuuguuuuccaauuaaaaaaauuacaauuaaaaaaagaauuauacuaaaucuacucugccuaccacacaucuguuuacagcaugguuuacuaaguauuuuaagcccacugugaagaccuauugcucagaaaaaaagauuugaagauauuacugcucauugacaacgcaccuggucacccaugggcuuugauggaggugcagaaagaaguuaauguuguuuuaaugucuacuaacaacauccauucugcuucccauggaucaaggaguauuuucgauuugccagucuuucauuuaagaaauauauuuccuuugggaggccgaggcgggcggaucacgaggucaggagaucgagaccaucccggcuaaaacggugaaaccccgucucuacuaaaaauacaaaaaauuagccgggcguaguggcgggcgccuguggucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaagaaauauauuucacaaagccaucaaugccauagacugauuucucugcuggaucugggcaaaguaaacugaaaaccuccuggaaaggagucaccauucuagguaccaguaagaacaguuaugauucacgggaagaggucaaaauaucaauauuaacaggaguuaggaagacagugauuccaacccucguggaaaacuuugagggguucgagacuuuggaggaagaaguaaccuuagaugugguagaaacagcaagagaacuagaauuagaaguagagccugaagaugugacaacugcuguaauuucaugaucaaacuaauggauaaagagaugcuucuuauggauaagcaaaaaaagugguuuuuuugagauggaaucuaguccuggugaagaugcuaugaauacuguugaaaugacaccaacaauuuagaaaauuacaaaaacuuacuugaguuuacauaaacuuacuugagcagcagcaggguuuaagaggacugguuccaauuuugaaauaaauucugcuuuggguaaaaugcuaucaaacagcauugcaugcuacagagaaaucuuucuugaaaacaagcauuaacugaugcaacaaacuuccuuguugucuuauuuuaagaaacugccacagccaucccaaccuuuagcaaucaucaaccugaucagucaacagcuaucaacguggaguaacauggagguaagauccccaaccagcaaagagguuaugacucgcagaaggcuccgaugcuuguuagcauuuuuuagccauaaaguauuuuuuaaauaagguacguauuuucuaagacguaaugcuacuguacacuuaacagacuacaguauaguguaaacguaacuuuuaugugcacuaggaaaccaaaauauucguguuacuugcuuuacuguacuuguuuuauuucaguagucuggaacuaaacucacaguauauccgagguaugccuacacuuucuuuuacugugugacuuacuccuccaggcagcgguucauucacauucccuagacauacgacugcugucauccagugaagaacaacucuaggaaaucagucuuaucaauaaugugaaucagaaugccacuuagaugcacuaaauagaaaauaagaaugaaaagcacauugauuugaaugaaaaacauauuaaucuauccuguaaacaacucuaaaaaacaaaagucacccaaaauucuacuggccagcaccacuugcccugcuccauuuaccaauguuaucucaauauuuaaucauuuuugcagacacgggucucaauuuauaaaaagaaaugacaucacuauuuuagagaaccauuaagggauaagaagagaaucuuuucauacaugaauaaucacacccaaacucauuuuacaaauagauuuucuuaaaauaagaauacuuauucaggccgggcccccguggcucacaccuguaaucccagcauuuugcaaggcugaggugggggauuccucccugaccucaggaguucaagaccagccuggguaacauagagagaccugcaucucuacaaaaaaaaaaaaaaaaaauuaaaauuagucaggcaugguggcacgugcuuguaguuccagcuacuugggaggcugaggcaagaggauugcuugagcccaggaauuugaggcugccgugagcuaugauugugucacugcaccccagccuggguggcagagcaagacccugucucaagaaacaaaaaagcaaaaaaagaauacuuuucaggauauagcaguaaguucccaagccaguaaauaacuuaacugguacugauauuaacacuacuuuuucuauuguuucucauagcuaucaaaagcuacuaaaagguuuacauauauugguaauaagcaaaaugaccucugaaugaaauuaagaggguaggaucuagacacacuggugggucuuaagguuucucagcauugucuggccaugcugaauuuuugcuuuaguaucucagaugcggugcagaaaaauggaagguccacacuuuuacuccucuccaucagcaggagcaucugaacacagggcuuuauacuagauaugaccaacugcauucaaaauuuucaugaacaguaaccaguaaaagcauuacccacaaaaaaauccccuuacauucaaagaaugccagaugaagaauaaaaugaacagcugggcgcggcagcgcuugcuuguaaucccagcuaugcagaaggcugaggcaggagaaacgcuugaaccuagaaggcagagguugcagugagcggagaucgcuccacugcacuucagccugggugacagagcaggacuccaucucaaaaaaaaaaaaaaaagaguaaauugaaaaguagagcugguauguuuuucauccaauuacuggguuuuuaucaggcccauggccuaaucuguaaauuuuagggccuaauuaauauuuauuuuucacggcccuuaccaaagacagccaaauaaaguuuggcaguuuggguggauacauacuaggcucuuacgaaaaaauacuaaaugaggugauuucuuuuuugccuuuucaauaacaaauauauuucagcagaaagacugcauuuaucacauuaacuaauaguuuucucuggaaauugaguccgcacuuuaaggaguccaacaacuuaaauauacuuaauaaagcuccugugcugaaauucccauuuacuguaaauaaguaaaagaacaaugugcccuuccucugcaacucccucaaaccaaacauccuccuauacuuuucucaaucuacugccuggagaagcacagcucaccuuuagagcacaccccucauuaaggucauucccacucagaucauuuuggagggaagaauuaaagcauccaaguagcuaaaucccggcugcugcugauuuguaugcuccaagggaggagauggcuuaaaagcaggagugucaaaggaaaauaaaauggaaaauuaaaguaguucaauugccaugaaaaacuauuuaaaguguggcauuuucuccuuuucaccuuugcagaauucaucuaguugaaaauacuuggcucaugccuguaaucccagcacuuugggaggccgaggcaaguggaugaccugaggucaggaguucgagaucagccuggccaacauggugaaaccccaucucuacuuaaaauacaaaaauuagcuaggcauggugggcgccuguuaucccagcuacucgggagguugaggcaggagaaucacuugaacccgggaggcagagguuguagugagccgaggucaugacauugcacuccagucuggacaacaagagcaaaaacuccaucucaaaaaaaagaaagaaagaaaaauuucuaaagugauguaaacauuuuuuacaagucuguaaaguauugacugaaaaccaguguaguacaaauguauauagaaguguuggguuguaaaggagugaugagaguggaggcugacugaagaaacucuucaggugagcuaaaaauaauaaaaacccuuacuagauccaaagagucggguugcacugcuacccaaaguuaagaaaaugcccccgccccccuuuucuuaagacagaccaagacucugucuccaaggcugaagugcaguguugccaucauggcucacugcagccucaaccucccaggcucaagagauccucccaccucagccuccucagcagcugaaaauggccuugguggcuccucucuccuuaagaucuuaggauuuguaccaacucaucaguaguuuuacaaucugcacaguacuuguacaucucauuucauccccacaccaacccuaccaggcaaggaucacuggccucauuuaacaagauaaagaugaggauacuccuaguuuugcugaguccuuuaagacggcucaguugaaaaaguaauagugccagggcuuaaacccucaucucuaacaccaaagccuaagcucuuccuguuaacaguacauaaaauucaaacccaaaccacaaaauugcuggggaaaaaaaaaaaaacuaaaacuucuuuaacccaccaacuacacagaggaugaucuuccgaaguucucuuccuuacaacucaucacaucuuuugaaugguauuuuaauaacuagcauucuauuuauuuucuauucuugguccauuguaccaccuuacgagaaguuaagaguaaucuaaaauuuaagguaggucucuaaacuaucaacaaaacacuauuaauguaccuaaaaugaaaacuugcgaauuccagggcuaaaugauucaaacaaauguuaauagaaaaggagggcaccaaucugaccauuagccaauuuaaaaauuuacgcauuacuuguuauacauaaucagggcaacuuuaagacgccauuccaggcagauuugggguaguaggcggcuggcuuuuagcuaacucugcuuagcugcgggguaaaugucaaaggucagccccauggcgaaucucccuaagcccccugucgcaaccgaagccgauggaaucaacaagacaaagaugcuccugacccacuggcuagaaucgugaagaaaacgcuaauccaugucaaaugcacauaaggaaauuuuuccaugcagagaccagacaggggaaaaggggaagggagaaggagaaaauacaggguucgacccgggccaucggaagacaaccaagcgcugacuuggggguaagcccuggacuaggggccuguagaccagguucgagcgcucacacucgcuaacugcggagccuuggccagccucagucuccgagucuacaaaacaaggauaaucauaaagggcucccacccgccucaccgagggcugugaggcucuuccgagacagaggacauggagccauuucguaaaccggagcgcacgguacagacaagaaacuguuauccggcccagcagcugcgagacccccgagcggaaugcaaguggaccccaggcaaagaggacagcaggggacggagcagaucuggccaaguugucccguccccgcccagaaucagccccgcggccccacagaaccgccugcgugucacuucccccccacccaaccccgccagggccagccuccgcuccgaccuccccgccuuccgucccagccccucgagccccaacuccccuccccgacgcgacccucagacucacggccugaggggcuccuccggcaaaacagcggcuggcucggacccucccucagagcacacuaaccagcagcacccgggaccgccagcuacucgccggauguacgucacaccccuccccgggacuuccgggcgcg

SEQ ID NO: 16267 - RNA, 7512 nt, Homo sapiens
acagagguuuuucaauagaucauguuuauucccaagccccaaccagacauguucuaccccucaagaucccugagacccaggcugugggcuggaaaaugaaggcacagugucaagagcgccccuguuggcauaugaagacccaggagugcugaccuucagggaucugccugcacugcccaugggccuggcacagcaggaggcacuccuguuucugucccuucugucucuggucuucagagcaagguuucugcugagaugcuaaggaagcugaguccuuugucagcccugacucugacugagaggcagacaggagccaaggccccauugaagcuccaggaugacgauggcccucaggggaacagacgcaaaaccaggcacgggccugccuuccagcuggaaucuaccugucaggcccagaacuucugugcaguuggagugggcuccccagaaggaaaaacaauacagcugagucuagugcuaggggacagagaacugggggcucaagaaagcaccccaaaacgggcugccagguuaaggauccauggggcugaagagaaguuugccccagagcccaaagcccagucugcagucaguggguggagaugagaggcagccugggccccugcaggggcugggcccugaauccugaggccaccgucaccucaacaucacuuccuacagcagaaaaaggucacucuucuuuccaaaggugguaacacagccucagagcuugcuccgcggggccucugccaggggccgcugcaaccgccacaccacccugacuggcucagcagcgcgguccagcucacggaggccaccuaggucuugggucuggcuguacugcugcagggccggcuggagcaccgugaugggaaugcugaaguucagguggggguagguggcccccguauuauugucccggguguugcuggugauuaugccuguugaggagucagagagcaaaagaggaugugagccagggggcagaaaggcuggagaagggaggaggaccaucuccacccuggagcccccagggccugguagggcuggauaccaccccacguggugacagacgcugagcuucuagacaugaacaccugcugcccacacccuuuccuggcuuuacguuuucuccuuaacacucucaaaaucuaacacacuagauaguucacuuauuucacuuguuaucuuucucucgaccuagugucagcuccauaagggcaggacuuugagguuuuguucaugcagucuccccaguaccugaaacagugccuugugccaaguaggcgcgcaacaaaggcuuguugaaugaaugaaugaaugaaugaaugaaugaaugaaugaaugaaugaaucagacccacagacauauuuuguuuggccugcucggugcauggauguguguguaguuuuuuaaagauaauuucagacauacagaagucuugccuaaauauugcagaauucuauauacccuuugaccagcuuuccuuuauguucguaucuaaugucaccaaaaaauauuuaucaaaaccaaaacauauaccuugguagaauacuguuauuaagugaacuacagaacucauugacaugaguugcacuaguuuuuccacuaauguccuuuuucaguuccaauauccagucuaggacuccauauuccauuuaguugucgcaucucccaaaucuccuccaaucugggucaguuccucagucuuuccuuaucuuucguggccuugacauuuuuaaaagugcagguuauuuuauuuauuuacaguuuuuuuuuuuguucuuguuuuuguuuuuuuagaggcaaggucucgcucugucacccaugcuagagugcaguggugggauuauagcucacugcaaccucaaccuccugggcucaagugauucucccgccucagccucccuaaaauauuuuguagagauggggccucacuaugguuguccagcuuggucuugaacucccagacucaagcaauccucccgcccuggccuccaaaagugcuagaauuacaagugcgagccaccauaccuggcuuuuuuuuuuuuuuuuuuaaauaaacacuguuuauuuuuuugagaugggucucgcucugucacacaggcuaaaguguaauggugaccauaguucacugcagccuugaacuccugggcucaagugaucuucccacuucagauuccugcagagccaggacuacaggcacauaccaccaugucuggcucaggucagugauuuuagagaaugacccucaauugaggccuaccuaauguuuucucaugacuauuggguuggugcaaaaaugaaugcgguuuuugucauuacuuuuaauuguuuugccauuacuuuuaauuguuuaagguuacacauuauugggaagaauaccauaaaagccauguguccuucccagugucucagcuaucugaugucuguauggaguacuucugacguucaccuugaucacuuggcugaggugguaucugccaggccucuccaagguagacuuaguauuuuccuuucuuuuuuuuuaauuaaaaaaaauuuuuuuaaauaaaaauagaggcagagucucacuauguugcccaggcuggucucgaacucccauuucaagugauccucuugccucagccuccggaaguguugggauuacuggcacgagcuaccacaccaggccuagacuuauggcucuaaauauuacuuacggcuccaauauuuccucuuuguaaguacuaaauauuuagaggaaauauacuaaaguuaugcaaauacaauuuuacuuguauacuaggauggaacagauaaguaaacauauuguagacaacaagagcaagguuuuucacuacaggagaaagaagaaacaaggagaguuagacuggacuggaguuggagguuucuagaugaacucauguuuuuuucuuuuugacagcuaaacagacuguuuuuuaaaaaccugaauguuaccaaaauuuaaaaauugaucgauuuaacggccacauguauuuuuuuaaaaaagcuuuacaugucuugugaaaauauuagaauaccagccaacguuaggcccauccuccuucauggccacagucugcagcagcugagucgagugcgcuucaguuuagaccccuccccuccccucccuguugucuucucauucauuugcuuuaucuuuccagccucuguuggcuuuugagucugugacgcuuugacuaauccaacuccucaauuucacagaucaaaccagauuagauuaguagcagagaagggaccagagcccagaucucuuuccucccaguccagcauccgucccucuccaccaucaggagaacagccugcaaaccuucgcuagcucacucauaaugcccaccauuuucccagacagagggugcacuggggcuggccacaagcacucauggggugggacugagguucuggcaagugggagggcgggagggggccaaagagcugguuaccaaggagguuuccugagugguuggagaagaggggucccccacuggagccgcugugcacagcacacguggucugcagcauuacgggcgugccauucaccugcaccacagccgaaaggaugccugaggucaccgagggcccgcaagacuggccaaagacgccaaagcccaccacacucacagccucgccugccagggaaggaaggagggugaagcuggggacaccuguguuacagcaggacucacacucccuaacucccaucccuacccucuccaaacauuccaaaccucuccacccuucaaguuucugcucagauacuccugccuccagagagccuuccccauguccccuggcuggaagaggcugagaacuccacugagcuccuagcacuguaucugcaugaccacuucugagcaacaggcuguucccuaguccuuguucccuggacaggcggggcagugacuuuuaggaguuccuaacaccuaccuacaugcucaauaaauguuuguggaauucacacccaucuccuccuggaacuccuaagaagucucuucgugaaaagaaauggugaugauggcuauaaugcagccaugaccuuccuuuuccaagugcaggguauggggguaagugcuuuacaggcaacgucacacccagcccucacaacacccagaaauaggaugcauuagccccauuucaaagacguggaaaaugaggcagaggauaguuaacuagccuguccaaggacaugggacuaauagguggcauaggaaagaugcccauccagagccccuggacccuucaucacuguaucacacugccuccauggagugcaacaucaguacuuauguggcagcaucacaaagccuuuuacccaaaucgugccccuggagccuugaaagugccacaugccucucugaccagccugaaguguuaaggaaccccaaaggcccagcauccucacacuacauugcugcaggcacucggggaaagggcgugcagcauuauccuucccagggcacuccaugugccccaccagcacaaaaagggaggcaggccuccaaggaccuugaccaaugcuacccugacuucaugagaaugcccaacacugauucuccuuccugaggcccacccuagcucagaggggcccuccuucaggcugcgcccuucguccuuuaccuucauggaagugcucagcgggcacagggauggggacaucauccagguccuccuccaggcucaccacugcuaugucauagggacaugucuccugaguggcaaauaccacacggccccagauggccacacuccugggagcaagggaaacaaaugacaggcuagcuuucugacuccucaguacuugggagaaaucaaggagcugagagugacaguaaaagucagaagaucuggguaucagcccugaaucgaccagcaggcaacucugggcaagucauguaaccauucugugguaucuccaaaggugguugacaaacugugcuacuucucuaaagcuuccuguaccugaauaaucaaccugacacuuagugagcacugugggccagguuugguguuaguguuuuguggacaucacuuuauuuagucuucacgacccuauaaacuaggcacuggcauuaucuccauuuuaggugguauaacugaggcccagagacgcucaguaacauucccaacaccaaacaaagugggaggagccaaggcaaacacaacacuuuccuucacugccucguugauacccacaacaaucccgucaguuggugggucagauaugacaugguuucacuccucugggucccuauuuacguacacgcuaacacuucuguagcacacgacgugacaggcuccguuccacgacauucagcgucaacucccggggaggcagcuuagacagguuaagugacuugcccgggaucagacaggggcguccuacuacacacucugcagggguagcuuccaacagaccuggcagucuccuuaggagcaaggggcauguggggggaguggaaggaaucuggugggggccacacaccauaggcaaaccuucaucaucagucuucccuauaaagucauggcuguccuauaggccacaguggggacaccuauggcaaaacugggcaguguuacccacaccuggcuaagcuuggggauucaggaagagauuuggaaaagccugggcugcaaggcugggcugaaccauguacagcugcgugggccaccccccuaccuucugauuacguagaaacucacguuucacucagacgggaagcucuggcuaagcacuaaaagauggauaaaauuaacauacccaucuccuuaccccaggagagcaccauccugggccucugggaccuuaucacuuucagaggagaagcagcaggguuagggaaucucuguucaaagggccagagaaccgagggguauggcgugcagggcuaucagacagugaagcugcccagaagaaacucagccuuugaggggagcucaaagaugcccuguuccggauucagggugucccacaguacccaaauccagagcugcuucgagcuugacaccuugccccagauucuccccacagggguucuggguauaaaggaugaggggaggguuccaggucucuacccacuacacgcccaaagcauccgcgugacacaagaaaggccugcacaauacucaagaguauuagggcuggacccagaucugagaccuggaaagggaugaaguggcgucagcccugcgggcuuacuugggggugguggagcgcaccaggacccuggcugcuucccgaggggacacgugccgacaggucacuacaaggcggggugccacagccacuccggagccccauacggugccgcacuccaccaacacugccgcggcugcccacaggggcccggagucucggaggggcagaccccacgggacgcccaccucuggcggcagaagggcggccagggcagcggugcugugcggcaggcggugaagcgcgucgcgggcggcgcggaaaaggggggcggcggcgcagagcagcgugaagcccacccauucgccggccuuccaacagagcggcgccaccaccagcgccaccagcgcccccgcgggccgcgcggugaacacgccgccgcccucggugccgggcaggcagcgugcgucgguaagcagcagugggccggccacguugcugagcaccccgcagcucagcguguugagaaagaugucggggcagaaggcgccgaaaggggagccgcagaccagcaauggcgcacccuugggcacggccccgagaggcgacaccgccauggcuggcccgcgcuccuccuccaccuccuccuggccuagccgcacgcccagcagcgcaaaccagcccagcgcucucaguugauccgccuccucguccuccgacacuucgucaucccgcgccgcgcucgagaagcgccacuguuccgcugccucguccccgaagaggcgcgcgaagugggcccagaaggccgggcagcucagcagcagcagcagcucagcaggaagccggggcugcaggggacgcccgcgggacggggcaggugggccgggcucgaggcucgcgcacuggggcgugcacagcccugggcggccccgcuccgcgccgcccccgggacccgcggccguuggggcccacugcacgugcaggcgcaggucgucccugcaacugucgccaggcaggaagacggcgccggccgcggucaggacuucgcugccagcucgcaggaaggggacgaagaugcccccguggcaaagcaccaggcccgggcuacggcucaggauuaccccgcugcagcuccacgggcccgccucgggcuguccggcccgggaggcgcucaccaugcagcccgccugcucggccgcccucauggcagacccccacugccuucucauggccucuaggccggacacucgggagcuucuccgagaaacagcaagcuagcgagcgaggaccccuacccgguccggcugaagcugccuagcgccacccacagcuggaagcgagaggcgcaagcucug

SEQ ID NO: 16268 - RNA, 2342 nt, Homo sapiens
aaggaccaggccucagucaggcccacggugguccacugcacgcgacgggaaacuccuggaggaagcucguuuggcccuuggggaaccaaugccccuuuggccauuguuguaaggaacaaagagggcaagaacugagggcgcccccccaaggaaaggcgggggaggacacccacgggcgauccggggggcuggccgggcuggggcugaggugcgccggggcuggaggcugggagccgggggaggcagggcugguccccaaccgccgcgccccgcgagcgauacgcacggcguccggcgcccggcagagcccuuuccugcgccgcagccaguuuacuuuuauucccuuuuucgauauuuuuauuauuauuauuuuuucccgcgcaaagcgggagccagacugcccaggcgagccacggccgggccgccauuucccggugaaagcgcagcgcgcgucggcaccgggcgccccggaaagggaaccgaaggggagugcccggccucgcgcccucuuccgcgccggccccggggcgcacgcccgcccgcggcgcccggguguccgcgcagcaacccccagcccucgccccgccacccggcguccccgaccugaccuuccccggcgcggcccgcccccggacucgggucccuaaccuccgcccggcugcuccgcgcccccuccauugucagccuggagccgccggcgcccugcccgggcaccuucagaggcccccgagcggcccuccccgggcucccucgggcccugcgcagccccccacccaucgccccgugcccaucggcggccgggcgccuccguccucccgcuccugcgcccgaaacuccgcauucccaggagaccuccgcuuccuccggguccagccucgccuggggcccgcugcugaaccucgcaucccuccuccuuccccucucaguacccucgacgcccccggccccucgcuggccgcaggaauuugaccacuucuuuagcagcccccccuuuaucgcccaaggaagcaaguugggcagcuggauuuaagaauuuguuuuugcagagggugggucggcuaucgagggugcgcccgcaggggcucgggggagaggcagaggugguucucuccggccccugcacugccccggcggcgcguuuuguuuccagaccccggagcacccuaaacaauaaugccaucgccauggcgggcucaccuggugcugcgccgccugcucccggcgcccggugcccucugcgcgccccuccacgggcgcagguuuggcccacgcggcgccggugccgggcaggacucuuugccuuucuuuggguucuaucugugcgugucaauggcggcaagcggcaguucucugggccgcggauaguagcggggggaggaggaggagggagaagggauugcuccuucuccacauaaccaccucuaggaggaguugcucagccucaucccccgccagcccaggcuccgcgacggguccggggcuuucgguggggcuugaugagcuauuguccuucaggaguauuaauggugaaaccgcgcggccuccgcguacuuggccgaucugcgagacgagccgagggccacucgcuaacaugaggcuuuccccagaacugggcacaaacgcgcuauggucgcgauccagucuccuguuagcuggauccaccuuuggugggagaagguggcgugggcguucaucuggcagcucuggggagagucuucgaaggggaaagcgaaaaaugccaccuucuauauuuuuguguccuuaaauaauaacaaguacauuaacguuuguguccaccacugggaagagugcauagggcggccacagccacgagagcugagaauuuauauccgugccuguaggcuuuuuagaaauuaagaccgauuuagaauccagcguugcauaauauuuggagaggcagauguauguuuuggugggugagacuguguguaugggcauaauuuuuaauuggguugcuuuacaagguguuaauuugcaauaucccaacggguauuuagaugagcgcgaggcuauugucuucaggaccaguuuuuauuaguuacuagaaaaugcaucuuuaugggggugugguggacacugucgggugugauaauggggauuagcaguugcuguguuccuaguggaagccagucucggcuuuguauugugaguuguuggccagggcuccauggcuggaggggagucaaaagaauguguuuauuucagugggaaauacuaacuugcuguggaccauccagguuuccucugauuucuccuacagucaaaggacugugagaggcaacauuuugaucccuuccaaaaagagaaaccggugcaaacag

SEQ ID NO: 16269 - RNA, 850 nt, Homo sapiens
gaugccgaaaggaaagaaggccaagggaaagaagguggcuccggccccagcugucgugaagaagcaggaggcuaagaaaguggugaauccccuguuugagaaaaggccuaagaauuuuggcauuggacaggacauccagcccaaaagagaccucacccgcuuugugaaauggccccgcuauaucagguugcagcggcagagagccauccucuauaagcggcugaaagugccuccugcgauuaaccaguucacccaggcccuggaccgccaaacagcuacucagcugcuuaagcuggcccacaaguacaggccagagacaaagcaagagaagaagcagagacuguuggcccgggccgagaagaaagcugcuggcaaaggggacgucccgaagaagagaccaccuguccuucgagcaggaguuaacacugucaccaccuugguggagaacaagaaagcucagcugguggugauuucacacgacauggaucccaucgagcugguugucuucuugccugcccuaugucguaaaaugggggucccuuacugcauuaucaaggggaaggcaagacugggacgucuaguccacaggaagaccugcaccacugucgccuucacacaggugaacucagaagacaaaggcgcuuuggcuaagcugguggaagcuaucaggaccaauuacaaugacagauacgaugagauccgccgucacugggguggcaauguccuggguccuaagucuguggcucguaucgccaagcgcaaaaaggcaaaggcuaaagaacuugccacuaaacuggguuaaauguacacuguugaguuuucuguacauaaaaauaauuaaaauaauaca

SEQ ID NO: 16270 - RNA, 1584 nt, Homo sapiens
uuuuuuuuuuuacuaguguaucuuuuaauugucauuuaauagcuacccaccacagcugccccccacccuucccuuuaaugacgacguuugcaggcuucaggggaccagggaacaaagcuggggccugguagccccacuacgcugccagccgggaagaacaagucacaauuacaaauuaucacaacaauuagcgccuguacuugggggaucugcaaauugaggaggcuccagcuccucauuguacaggggucuauuuggcagugaccuugcucugcagacgaugauauuccuauuccuucagccugagggaauugauguugaugaacccgguggcaucaauuggcucauaaucacccuacacguucaugcucaccggcuccucguuguagggagagaguggggacucccagccaaggauguacacccggcccuugaggacggacaccugcgcuuucccucccacuugccccuaggacuuggcgaugcaguggcggacaaauucacacucagggcuaugccagaaagcgguguacaccagcucagcaaauuucaagcccaggccuuguuugauuuugcacaccucccaguccauggugaaggccuugaugucuaaaugagugugguaaaggauggugccugcuggggucucauagauaccucgggacuucauuccagugaagcgguucuccacgaugucaguacagcccacaccguguuuguccgcgacuucguucagguacaugaagaacuccaaggaggucggguggguggagccaucguugacguuggucaccuucacggggaccccuuuuuuaacucgaucucgaggaugucagggguguugggggcuuugaccgguuccuaggucuucguguagagaccuggaggcacuugguucuugggguucuccaggauuccagccucguagcugaugugcaugagguucucguccauguuccacggguucuugggagugaccgggauaggaaucccgugcugcuuugcguauuccaucaggucauuacggcccuugaaccgguuguagaacucgggcauccuccagggagcagugcccuuuaucugggggaccagcgaguaccaggugagcucaaaccggaccugauauuccccuuaccgguggcgccgcgggacacccccuccugcugggcgauuuccacuuguuugcuggcaaugcagggccuggcgagaaaggugcccaggagguagcgguccucauacagugugcuggacuggauggccggccagaugaacucuuccacaaacucccugaugacauccucaaugaacaccuuuuuggccccaaguuucagugccuucuuccuggcuuccucgaagucuuccuucuggccaguguuggccagguaggcaaugacaucauagccuuguuccuucacccacacgaggaugcaggagguguccaggccgccaccauaggccagaacucucauggagccuuugcuggacauagugucugggauuggaggcgcgaguucccagcgucuggaaucugucuucagggugcagugaaccacucgggcucaggcagcaguggcaggcgacaga

SEQ ID NO: 16271 - RNA, 1745 nt, Homo sapiens
aaaaaaaaaagaugcgcggugcuccaggcaccugcagcgcagcucacguuucaggcgcaguucgcagggaggcuggggagaugcucccuggccgggcuagcgcuuucccaguucacagccuggucuuccgccccgggagggcaauggcuccgaaaagugcacgaggagaaggcagagggucgccuucguggcuuuaaggcagagugaggcgcccugaaaucccggaccugauugggaguagagcagaucggcagcgucuuuggagcaaggcaaggggaguaagcgcugagagaccaaacauuggauugaaucacauuggaggaggggugguaagagacugagaggcagacagacuugagugaggguagggcgacccaagacggugggcggcuccggccggguagugcuaccauucuaguauucuuugaaugagauuauggggugguggcagagaggaggccuaaaaugagcgcacuuugcaaugcccacuucgcgcgggcagcagcaaggguugcgugcguuggcgcggcucggagggccggggaaugaacccagccugccgcccccguggaggccugggccggccaggggucagccagggagaagcagaaggaacaagugcuuuugagggccgccgccgucggccacccucuacggcucccggcucccucccucucccuuacccuuagcacccacagcccagcgacagacagguccuuucacagaaaaucugagaaagccagacugccugggcucaagcaggcggaaaagguggcccccagcagcccgggucgcuccuccagcgacgcggcgggacucaggcugccagccugggagacuggggaguagagggacccccaguccccgggggaaccgccugggcugcccagcuccccgcagugcggcgccggcggcuccagcgcguacaagcugugguccgcuaugcgcagcguuugagucagcgcccagauguaguugugggcgaagcgcagcgucucgaucuuggugagcuucgcgucgucugggaaggugggcaggacaccgcgcagggcguccagugccgaguugagguugugcauucgauugcgcucgcggucguuggccuucuuucgccgacuccgucgcugcuugcucagugccaacucgcucuuaggccggcugcgucccccgcgccgugcccggagcuuccucggggccccucggcagccucccucuuccgccucugcgcaguucccccgugugcgaguggggcugggcggggcggacguggggcaggucacuucgucuuccgaggcucuggggaaggaccgcuccgucucacgggucacuuggacagugggcgcacccgaggguugaggcgucauccuacggcggggucagagggaaggguaaguuugaguccgucacugggcgcaguccgcgauuccgaggcuaggugggaaaaaacaaaaacagccauccucccagcccccgcugggucagaggaucccucuuuccccugcccgucccucggaggccuccaaauauuaccuuucuaccggcgcaaaagaauagagagcgaugagcagcgagggccguggggagcucagcgggcuucuggucgccaaguucagcugagcugcaggcgcccccgccugggaguugccccagccccaaaggagaaaagaagagagaaugggguccgaggccucugucacgcucucucucgaggcgcggcggugagaccgcagggauuuccugagcag

SEQ ID NO: 16272 - RNA, 60791 nt, Homo sapiens
uggggcugugauugccgcgcuccagugucagucccggagagaacgccgguggcggggcugguagcccggcagccgcagguggggccacgagcgcuggcugagggaccgagccggagagccccggagcccccguaacccgcgcggggagcgcccaggaugccgcgcggggacucggagcaggugcgcuacugcgcgcgcuucuccuaccucuggcucaaguuuucacuuaucaucuauuccaccguguucugggugagugaccccaguagggcccggggauggggguggggacccacaauccggccgcccccucacuggcccgggguuggguccacacuuagccgcuccagggagugcgcgggugagcgcgcgcggacuccuugucuuucuaccucacauucgggcggccagagcucagccugaauuuucagccgcccuuucgggagugugagagccgguugucgaccgaccgagugccaccuggcucaccugugugcaccggcugggcgguuugcccgcugugcguccgcuggccggcuggcuaggcugaggugaacgcgcuggccgcgcccaccacgccuacccgguaggacugacugccucugcaucggccuguggagcuuaaguaguuaggauuugcagucgggguugggagaccuggauuccgggucuggucccugcuaguuacuugcugaugccccugagcgagacgcuuccccgcuccgucuugguuuccucuuugguggaugcacgugccuccugcguggcgaggagaaguccaccagacgacgucuccugcacaccuaggugcucaguuuccgcugucgcugggcuuuaccuccuccucugccuuguuagggggcaggaugguaguguuuagacaugaaccaagcuuugaauuccgucgcuccgaguggucuuuuauuuuauauuuuauuuuuuauuuaaaacauugcuaaucucuguaucguuccaauuucaguuugugcguuucugaaaugagcacuugcugagugaucuuggggaaguuacuucauuccucucggccaugguuuccucaucuguaaauggacacaguaauuauauucaacuuguaggaugcucgcggagauuacgugaaauaggccggguauggugccuagugaagagcucaagaagugugagacauuauuacuaucgugggcagggaauuuggacaccugugguguaagcugccccaagagauuggguuucuguaagggcguuucauauuaggcugggcccuauucuagagaugaggauaucuuccuauaggccagcuccgccccugucacuccagaaucgcucucugccugcaguaugccacaagagcagacuugcccagggacccaggguggucacugacaccccauucccaccaaauacacacacucuccccugguguccuccuuagccccuugcugggucucuucugcuagcaggagcugcuggauuugccaucaggacuggcuuucccugugaccccuuuguggguggggccuugccugguaaucggagauccagauucagcucuguuacugacuuauggauaucuuaggcaagucacuuuccuguuuugggccucagaacuguucauugacuuuuccaucuagaagacuagucugaggccaguuuccaauccaauucucugacucuagguaauguggaggagagaugaacaguauguuuggggggcggaggauggagcaaggaccuguugguggaagcucuagggagacagaaggucauaugugggaugggagugggggugauuugagcuauaaaucagcgguugcaucagauucuugugcccuggcauagguauuuauuuaaauuuacauaagcuuaauuguaguaaauuacuuacuagaauuaagguaauucuagugugcagucaguauugaaaacugcugcccuagauggucucauagguccccuaaguccccaggauuucugugccugccccuuguguguucugugagcccuucucucuguaaaucagaguugaaagagccuaagguugauggguggggagguaggaagauggaguuguauuuugggcuucaccccuuccccagauauauaaucacaaaccagucucucuaccuccucacguuuccauuuucucaucuauaaaaugaauaagugaaucucugcccuguaccucacugaauuguuuuaggauuagugauauggggaaagagugacauaugagcaaaaucagugcaguacaaacauaccucaugcaguuaaauaaaacugaacucuaauuuuuaaggcuuuguucugucacuguccuuugcagcccccagagaagcccacccaauggcccuugccuugcuucucuugggcagggugguucucagaacuuggaaucccuccucugccaacugagguugccuuaccaaauccuuaacucccaucccuggaaguauuucuguuuaaaagucucuacacccaugccaagaacucagccaccugccaacucugccagagcagcuccaggugccagaguuugacugcagggcagggcccagugugaguaaguaaucuguccuggaccagguuuacuguuauuuggaaaccauuuacaggaaagccuauuaucucuggugccaucucuggugccaucucugggguugagggaaggguuacuugcuuuguaaguccaaacugcuagcaauuugcaucucaguuuuuaggucuggagggccauaaguuuuaugacagccuuguaccuucuguaagacuuuuugcuuacuuuaaaaauuacuacuggggccgggcccgguggcucaugcuuguaaucccagcauuuugggagacugaggcgggaggaucacccgaggucuggaguuugagaccagccuggcuaacauggugaaaccucaucucuacuaaaaauacaaaaauuagccaggcgugguggugugugccuguaaucccagcuacucgggaggcugaagcaugagaauuguuugaacccaggagguggagguugcagugagcugacaucgugccacggcacuguaguugggugacaguguaagacucgguuuaaaaaaaaaaauuacuauugaccaggcauuguggcucaugccuguaauccuagcacuuuggaaggccaagaugggcagauugcuugaaccugggaguucgagaccagccugggcaacaugaugaaacucugucucuacuaaaaauacaaaaauuagcugggcgugguggcaugcaccuguagucacagcuacuugggaggcugagguaggaggaucaccugagcucaggagacggagguugaagugaguugagauugugccacugcacuccagccugcaugagacucuguugcagaaaauaaaaaauaaaaaauaaauuacuacugauagaaaugcaugcaugggcuuguuacaaaauuuagaaguagaaaaggguaaggccgggugagguguaaucccagcacuuugggaggcugaggcgggcggaucgugagguuaagagaucaagaccguccuggccaacauggcggaaccccgucuuuacuaaaaauacaaaaauuagcuggguaugguggcgugugccuguaguuucagcuacagcgagggcugagguggagaaacgcuagaacccgggaagcggagguugcagugagccuagauagcgccacugcauuccagccuggugacagucucaaaaaaaaaaaaaaaaaaaaggaaaggguagugguuagugacaagccuccccuccuaccccucucuccuggccugcccaguccagaggaggccuuuguuaucaguuuccugucacucuuuucugagcuaucguagucaaaggauguccuaggacaaacauauguauauuuaaaauaagguagcacacuauacacagaacuacguauguagccccucuuucacuuaaauuuaaauccacgugaauuauggagaucugcuaggagcugccucauucuguguguuggcuacauagauuccacucuaggcuaugccacauuuauuuaauaguccccagcuggggaacucuuagguuguucccagucuuucuuucccucucuuucuuucucuuucuuucuuucuucucucucucucuuucuuucuuucucuuuucuuucuuucuuucucuuucuuucuuucuuucucucucucucucucucucccccccccgucucuuucuuucuuccuuucuuucuuucacugagaacagugacacagugaguaucucugaaugugucauuuugcauggguguauaugucuguggaguaauucuaggagugggguuguugaguuaagggguauaugaauauauguuauacaugcagacaugcaccugccaucaguauauacagcuugaugaguuuucacaaagugaacacaccuguacacugagcccccaggucaaccagcagaauggacagcagaaggcagauaccccucaaacccucuucuaggcacuaucucuuaccuuugugggugaucaccacuggauuaucuagcaguauagaauagcuuugccuguuuuuguaugugcauuuaacauuuugauguuauuaaauuguccuauauagaggugacaccaauuguaauauuauuuacuuaauauguuuauuuaaauuuacuuacuuuuuuuuuuuuuugagacagagccucgcucuuucaccuagacuggaguacaauggugugaucuuggcucacugcagccucugccuuccaggcucaagcgauucuccugccucagccucccgaguagcuaggacuacaggcgccuacuaccacgaugggcuaauuuuuguauuuuugguagagacgggguucuaccauguugaccagacugucucgaccuccugaccuuaaaugauccaccagccugggccucccaaagugcugggauuacaggcgugagucacuguguccagccuaaacuuccuuuuuaaacuuaaauuucuuuuccuuuuuuucccuuuuuuaaaguauauauuuuuuauuuuccaggcacauagguucaaguugcccugaauaugcacgccuuuaaauuuauuuuuaaaaggaggcuuuauaucaguauuaugaaugggaaaccaagacgcccaucauaaauagcagguaaagguuuaaaauaaguacaguacagggaaaacaaaacaaugauacuaaauccuagcuggaugucaugggugcugaaggcugugacccugacgccuacccucucuguucaaaagguagguuggcaagugcuugaggggcugaaagacaaacuagcacccaaacugagacccgcuccuugaugcaaucggaggggucgaaagggcauugaacgaggaaagcucagucuguaagucccuaugauagguauaccccuaaaccacuuaugguuaucugucccacacucagggcccucuuguuuucggcagggaacuuuggggcugcaaaaggguguguuugaggcucacuugucagagcuggcauguaccccaggucccugcauccucagguaggugcuccuuggcccuuccaguaagucauggggaugucugcgggagaaaugagcucacgcugaggcacuuagagccuccuuuucccaccacacagggugaaucauucugacacaugcgcccucagcccauuggggacacaccucuaauuuuagcacugcccacgggguaucuuagagauccguuuacaggacugcuuuuccuugcuggacugugggcucccagaggucaggauuguaguucauccauauccuccucugaaugcugccccuggggccugugcacacaguaggugcucaggggaggcauguugcaugauggugauugagucccacuuguaccuacaaggcgaggauccagcuuggggcagaggccuggcuggggguguaacccgcaguggucaggucugcugaggccuugacuuugcaaagugggcagggcugaucauggugcuacggacucuccacagagcaccaagccuguuuccuugauaacaggguaggacuuucaaguggguaaaggugucauggcuggggaguguugacuaaucaggaagaaaaggacuuggugggaguugggggcaaguagggaggagcugaggguggguaggugguggaggcagcaaaugccagaggcaauaggaacucuuucugggcuuucuccaaggaugaaccugcuuauuagagcuuggccugugauuucuuacauuucuuauaguuuaaugguuaagagugugggcuguguaccagguugccuggguucaaaucccagcucugacacuuaaagguuaaguggccuagacauaacuuccaugcaccuaaccuaccugaagaguugcuaagcagauuagauggauuaauacaucugaagagcuuagaguggugccuggcacaugaugaacacuccaucaacuagucauggauuagucguucuuuuccugccuuccucucuagccuugcugcucaagagccauagacuaagaaugagaagggcuguuaaagacaccucuagugcagccuuuuaaauuuaccgauaagaaaucagaggccugaagagaagugaguugccugaaagcccacagcaagucagugacaggccaagaccagauccaggcugccugacuccaguuucuuccucgggcccccaugaccuuuccaggcgccauguauguuucucccuggucucagggugaggguagaagauaaccuuucugaaagaggccacgucccuggccucccagugaagcacuaggugaagccaggccaaaaagaaagcacuucucuggagacaguuuccaggagauuuuuacuuucgagaagagcuuuauuauuuuugugaaaaucauacaugcgcauagcuuaaaagauucaagccauuugggaaaguacaacgaaaacagcaaaaguccccuuugauucuaccacugggauucagccacuguuauauguugguaaacauccaucuggacaucuuguacauauauguagacauuuuauuucuuuaauuaucuuucuuauuguguuugauuugucgagcaaaguucauuuucuggcucuagguaagcauuccaaauagugaaacucaaauagugaagcugaaaguggggcagccuucauauuggagaaguggccagccgugccuaacgggcugucagagaugaucucauagcaucagacugggcucaggccucgggcacagagagguccuccccucccccagucuggccacagagccuuuaaaauccagagaaucagggcugcagcccugccagggguuuggagaaccuuccaacaccuucauuuuauagaugagcaaacuaaggcccugagaaguguccuucgcucuuaaccuagacuuuguacauggucucguuccccgcuuuaauagaggaauugcuuuaugucguaggacuggaccuugcugccuuuggguugguuccuggagaagcaggaauaaccaccugcccuccugcccggaggccuuucuucccaggugacucacagugccacccugggguggggcucacggucaaccugauaagggacugauaaugaaauuucuguaccaacuggcuccacacaggggaaagauguuuucuggguaagucuggucagaagagguugauggggggaaaacaaaacagacaaaaaaaaaaaaaaaaaaaacaacaacaaaacaaccuuucccagagagaacuuuuagaugugaauggguuugaauugacuucuuguuggaaggcaggagcauucagucuuaaccagccgugcucucugguugguugguuuguucauuaagucaacaaauaguuauuugaugccuacugaaugccaggcacugugauaccgugauaggugugggaagcaacuaugaacaagacagguuuaguccaggccuuggaagacagagcaguaaauaaauaucacuugugauaggugcuaaggagaaaauuagggagcaaguggggagggaugggcguuuccacuuucgaugauguggucagggaaagccuuuaugaggagcugacauuucagcugaagcucaaauagagaaggagccagccauaaagacuuguccagagcaucccaggcagagagagccaugaguucaaagucccugaggcaggucgcaagcauggcuacagcagaugaggaagcccgggaagggcugcgcuguggguggagaggguggcaggggccuggcugugugaagaguuugggguucgagugacugagaagcaggguuucauugucaggcccuguggucuugccauccagagaccuagaucagguguuggcuauucugugugacacuggguaaaggaccagcucucugagccuccgagaugccuccucuguggguaccccagagggcaguggggaggauccugugagaugagaggugccaaagcacggggccuacucuagggucccccacccacggagggagggagacucuaggcaccccccccccacgaauggagggagacucuagggcucccugcccacggagggagggagagucaccugggagccuugcauugcucagggguaguuggggagaugagaugagaugagaugagaugagaugagaugagaugagaugagaugagaaccucuggaauccgucuugucagaggaggcuccuuugccccuggggguacucagccugccuagaacagauggcuauggaaccaacuccuccagccagcuggucugaccccuagggugugcauguggucuuuuccagaggcugggccccucccaccccuuaguuucugggcuaccauggcacacugucagaagcacuaggccacaacaggcacgcggggccaggcaggccgucugagaaguguccugcuaggcucugaggggucccagcccucggucagcaugaguuguucagcuccaagcuaggccccugggcugguggaggugaggaagagacaccguagagacacuguagacuuacgaugucaccuuccccagcuagaggguuggccugugaaggagcuggcagccaucucugccucuggcgaugugccauguuagcccaggaacuaaggggugggaagggcccagucccuggaaaagaccacaugcacgcccaaggggucagaccagcuggcuggaggagcugguuccaucaagggccagucugagcuaggcugccugacugugguggccugaccaccacauuuugcuucaucucuuuggauucucagagugacccuugagcugggcuggacagggggucuuguccuguuuuacagaggagucuuugggaggacucugagggcuucacugggcagggaggccucgcagagaggaguggagaugagucuuaggagagggagggcgggcuacagaauguuuuuugggccugaguguugaggucagaaauguccucugggaagaccaggucuggaggccaagcagagcugaggaggaugagcacuucuugguuggcgggugaggagaagguccaugugacaagucauggacaacucucugugccuugguuuucuugucugcugggaggggauaacuguugugcugcccacaggggugaggcuuagaugaggcagugcccacagagcgcugagugggcaucuggcuggguaaccguucaugcagaugcugggaggagacgccgucugccacgugucucaccacaguuugcuucaucucuuugcauucucagaaugaccccaugugccuugucccauuuuauagaggaggagacuaaggcccugagcggggaaguaacuugugugagaaccaucauuugcauguguuccugggacaagaacuguuucacugugggaaagguuacuguuggguuuuaauuuuuuccaaaagggacuuucucgccaagacauuugcaucugggccugcagggaagcaaguauuucacuggaggguggaaggaaaacagccuuggcccagaugggcuuguuuuucccucuucagagcccucccacuuccugccugggagagcaggaacccccuacuccuggggccacuggaagucccucucaggauguugccugugaccuuguaugagugacacaggcuguuucccaucuccuaccagaggguuggccaugcugaccucuccggcugugcugggugcaguguggggagacugugggggugcuuggggucagaguguucauuucugggcacucacugugugccaggugcugggugcaggcaugggcacaguguggcugguggugggcugaggccagccucuggcccacccuguggcagauugggaccauccccugggugcaguaggguuggggugcuggcugccgaggcugcacaggauucugagacuaggucacuucccagagucaaaagacaggaacuucuuggccaguggaccuugacuucauggcucaaggccuccuacccugggaggauuucacaagaacacauguccaccacccccccgccaccaccccccccaucaccagagcuucugauucagugggucuggucuaggcccaggcacccguaauuaaaaaaaaaaaauuauaaugacagggucuugcucugucacccagagcaagugguccaaucauggcucacuguggccuugaccuccugggcucaagugauccucccaccucagccuccugaguagcuagaaccacaggcaugugccaccauaccuggcuaauuuuaaaguuuuuuuuuuuuuuuuuuuuuuuuuuguagaaauagugucucaccauguugcccagccuagucuugaacuccugggcuuaagugauccaccugcuuccgcuucccaaagugcugggauuaugggcgugagccaccgugccuagcuuuaucuguaauauuuuuauuuuuauuuuauuuuuuaaguuuauuuuauuuuugagacggagucuugcucugucgcccaggcuggagugcaguggcgugaucucggcucacugcaaacuccgccucccagguuuaugccauucuccugccucagccuccugaguagcuugggacuaugggugcccaccaucacgcccagcuaauuuuuuguauuuuuaguagagacaggguuucaccauguuagccaggauggucuugaucuucugaccucgugauccgcccgccucggccucccaaagugcugggauuacaggcaugagccaccgcgccuggcccuaccugugauuuuuaaacuucccugggugauucuaacgugcagcuggagucgaaaccacagcucagggugguaucuguaagggaauucugaugguacuggcgauuuccaggacaccugucucugcaggugaauccugaguaaugugaaaccuucuucugacaucucuuacgaucuggacagguucucugagcuggggaaaguuagcaaacacaguugggagaggcccagaaagaaagagaacacucuagccagggguuugggagaagugcagggggagucaguagggccccaugugggcgaggaagggcugguggagguauguggagaccacuggccugggaaugugggagacuaugggagcuggcuucuccugcagggaaccaggaugauguugugggagggaggggagucugugaguucuagaauuuugcuuuccuuuugguugucuucaaaacauucuuuuaugugcucuaaaggcaagguuucuaugcaguuaccuuuguaaauagaauaaguuucuauagaaucagucuuaacuuuuaugagucagggauucagaaacuugugggguggccugugauaauuuuuccuccuucaaugauaucucgaguuugagaacucucgaugcaggauuaucauguuggaaagcuggcugugaucuccaggucagugaacugcaguucuggccuccauaggagagguguggcaggugguggucuaucucuacuucacagauggugaaagagggccagacaggggagaggaccuugcuugggaucauggugguaagcuaggggccaguuagcagaaggaugaggccuugauuucucacucugacuggugagcucuguuguggguugagucguggccucaucaaaaagguauguucuuggccgggugcgguggcucacaccuguaaucccagcacuuugggaggcugaggcagguggaucacuugaggucaggaguuagagaccagccuggccaacauggugaaaccccaucucuacuaaaaauacaaaaauuagccgggcauaguggcacaugccuauaaucccaguuacuugggaggcugaggcaggagaauugcuugaaccugggagguggagguugcagugagccgagauggcgcuacugcacuccagcugggcaucagagugagacuccgucucaaaaaaaaaaaaaaaaguaugaagguauguauguuuagguccuagaaccugugaauguaaccuuauuuggaaaaaggguuuuugcagauauaauucaguucaaaaucuugaaaugaaaucaucuuagaugaccugagugugccauaaauccagugucaagugccuuuauaagagaaaggcagagggagauaugagacggacagaagaggaggccacgggcacacagaggaaacugaguauacacggccuucugugugcagacaggggcagacaaaccgagcaacucugggagccacuaaaagcuggaggaggcaagagggcuucuccccuagagccuccggagagaguauggcucaccagacaccuuggccucuggccuccagaacugugagagauuaaacuucuguuuuaagccaccccauuuguggucauuuguucgggcagccauaggaaaaugcaagcccuucugccucaccagguggacuuauuagggaggggcccaacugagcagggagggcccugagaaccaccuuccuucuguggguugugcugaaaaccaagggggaaggaguggggcgagaacagagggguugggggaggagugagacuguggggagugaggcuucugucccguccucaggccagggggccaugcccuacugcugguuucuuggggcuucccuucugcaaggaaaaccuaauggaaagagguuaaaaccggggaagguggaugcgagcuagcucucaggaaggacuugccggcugugaaaacaguuaaaucaaaacugcuugccaagcugagcuguaaaacgugggauucccugacagcuucagaacaggagcgucacccauuguguggggcaguuaggauguggccugaacuuccaguggguugaacuuugaggggccguagagggcaucuaguguuaccccuuccuuucagagagaaggaaaccaagccccaagccacccagcaugugccccugguucugaaacucugccaaugggacaaucucuagugugcaggggggacaauggacacuacucagugguuucaaaccaggagcuuccucuccagccaggguguggggacagaggccugacuuaugacuucucacagagaagggaagaauguucucugcagggucagaacccaggcugggggaacccuguucaugccucuggcuugguucugacucagccucugaccugggagggaccgggucacagggacagaugaaccagcccugucccuguccccuugagaagcuggcacucacugaguccuagcagcaugcucugacagcugcagacauucugugaucuggguggggcaagcaggccuggccagagucucccaggaggcuguggcagagacacuuagcuucgggguguugggcucugggcuuccccuggggguggcaguggccacuuggcuuuccaaccacuagguggguagacucauguucagagcagagacaagaugagggcaggaguuguucagggacccacagacccugagaugggguggggccuacuucuggccuguucauuucuacaguauuuuccuucuccacuguggucuucuggugccggccucacauggaaugaaacuugacuuuuuucagccaggaauucccccacacucugucuagcuggguugugccuucugcauccuccuagguuguccuauauugucuuuaaagcuaacaguuaacgagcccuucuugugugccaggcucugggcugagcuguuuucuagccauucucucacuucaaccuccagcaaccuaagagacagcgcugcucuugccugguuugcacuugggaaagagaugcucagagaguuagguaacucacucgugagagcuagagguggggugugaagccucucucucucggcagacuuaccagcuuccuuccuggccuagauguuuguucuucuuucuuggaagaacuuuucuuagagugauggacuuuuuggggaugggugguuuggucauuuagucacucaucaaacauguucuaggcaugagggcaucucugauccuccccgaagcucugcgcuuccagaaggccaucccggucagguuuguaacuuuacguagaaguuacaagacauugcuaacacagggacugguaucucugcuggaguagcaccagcuucccagggcaggggccacaggcuccccuagggaggugggccgguugccaccuuguguggggauagagggagcaagcugaccugaaguggcaccagaggccagggcccagaucccacuggcucucuggagcugcaggaaggcagaaguggggccagcaucacuguccuucagaaaugcauccuuuaauuuuuauuuuuuuggauaggauaugccagggcgugagaagucuuguuccugaugagggaggguggccuguggugugacagagcacuggccugggagcugggagacccgggucgcagcugcugagugagggcuaauuuguggugugaccuugugggagugccagccucucucucagccucagauucccgucugcaaaaucaggggguugggccagaucagcauccccccgcugauuccugguggugcacaagaugauuguagcugggccaugggggaacauuuaaacauuuuaauaugcaugugggaagugugauguguauuaaaaaaauaauuaguaccucaaacuugugauuguguagaucuugauuaguuuaggucaggaccguauuuacuugaguaagaaaagccagugggguuuuauuaaaacaucgaguuaauaauaaugcaaguagcuggccaaccugaccacguggagacgugauaggagaauggcuggaguuugggagacacugggaguucucagugguuccuuccagcucuuuucugggaauguaggcaguguggcaccucuuggucaggugcagacacuuaacacagucuguguacugcugacuguuagagaaggaaguggcuucucauuaugguacagcaucuuacaguuuacaaaggaguuucaccaccucagggucuccuucgcgugaccauuauauucccaugucacaguggagaggcaguuggcgcucugagggagauggucuggccagcauugugcagcucguaaguggcccagcgccugcagcuggccugggcucuuugcugggucgcaucagcgccagcccucugggagcccguuccugaccuuuaccuccuuucccggcugccacuuucugcacaggguuucauggucauguuggcuugucgcaugcaucuucucuuguccugauuuucuuaaagcagaggagaaaaggauuuaaggugacaagagacccuccuucucccuucccccaggccucuuccccaugcagugaggggcauguucuaaagcccucggcacccuguuuccuaauaggugcacuuggauguguaauagguagguucccauuacagccuguauuuagcuccaaguagcaguuagugaaacaucugguuugggcauuaauuccaggccagaacaggccaccagacccaggccucuggugagcugacccuugccuggggccacugagacuuuccugauggcacugaaucuggucugaagcuuuaggcaaaggaagacgcaaaccuguaguaaacaaaccucuuccuuuagccaggugugguggcaugugccugcagucccagcuacuugggaggcugaggcaggaggaucgcuugagcccaagagguugaggcugcagugagcuaugaucacaccacuguaguccagccugggcaauagggugagaccuugucuccucuaaacaaaacaaaacaaaacaacacacacacacacacacacacacacacacacacacaccucuucuuggaaaacagaacuugguugcuguagaaaaggugaaagaauguucuuggauauaguuauagccacaacaccauuaucaugccuaagaaaauacuaaguuuaugcaaaaacauaucuaauugucccuaaaacaucucucauagugucuuuaaaaaaaucaggacccagcaucacaguuuauacauugcguuggguuucuuuuucauaaaaaaugucccagugcaucugaaacuugaggggugaccucugaggcccugaauguuauagcaucugggguccugauggggacugucguguguuacuugccuacguuguaccugauccaagaccuaccggggccagcugguuccuuuuguuguuuaagggaaauucagaaagccaauuaggaaaggcuugccuggaaaacuguccccacccaugagacuccagcccccgccccccucccccacguucucauuaggagagcugaucggugucuggaagccagacccaagacucccugaguccccacccuuaaucaccaggugcacacacugggcccugugucaggcacuggggaaagaugcucuaaagaacugaaagacccccagcuggcugcccacagccugccuggggagacccggugugcccugguguggccgggucauggcucuuggcaagucagugcacugauguguagggcaguggcucuuuguuccuugguucugaugcuugggguaggcugggguagggccgagagagcucccuucucucauaccagauggggagcauuaucagguggcuggaguauccccuaaucaauacuuucuguaucaagcugcgauagaggaaauggacuuuuuuuuuuuuuugaaaaaguuaaacgcacagaaaaauggaaggaggaauucaaagaacaucugccugcuucugaguuaucaguugugaacaucuugucuuaagagcucucucuaaauacaccacuucuuuuuuugccaacccagcuacaaggaggcugcagucguugugaccccacuccucuaaauaccccagcauucgccuucccagaaagggcauucuuccucacaccacugcuguccaucugauuaaaaaaaaaaaaucaccaugaaaucaaacuuuucaguccuauauacaggccacauuucuuaugacauuccuguguuguaagaaauauguuuguucuuuguccccaguuccuggcacagagcucuuaaaacccuuggaauuuccugauaggaaugcuuuuuguuauuaauaaugagcccguuuagucacaccugaguuuacgcugaugcgaugacuuaggguaaggcccuagacggccuuaggauggggcgaaucaccagaaacaccaaauaauuagagggcuggacagaaagggugaggguggggguggggguuggggcuuggagauugagcucuauguaaaacuuuuuuuuuuuuuccagcucucaaccaguagaagagaaaaacucuugaacaaugagauuugaugagcuucuggguuugggaacucacugagguguuaaggggugagcgugggcucagagagggccugggagcucccuccccaccuugcccagugcaucuccucccucuggcuguuccugaguuguauucuuuguaauacacugguuaauauaaguaacccugaguucugugagccauucgcgcaaauuaucaaacuuggagaagggguugugggaaccccugacuuauagccagacuuugaguccuggacuugugauuggcaucugaaggucaggcaaucuuguaggcucuuuugagacagagucuuacucugucacccagguuggccggagugcaguggcuugaucuuggcucacugcaaccucuaccucccaggcucaagcaaaccuccaccucccaggcucaagaaauccucccaccuuagccucccacguauuagguuggugcaaaaguaauugcaguuuuugccauuacuuuuaauaauaauauuuuuuuaaauagcugggacaacagguggacaccaccacguccagcuaauuuuugcauuuuuuuguagagaugagauuuugccauguugccuaggcuggucucaaacuccugggcucaagcaaucuguccacuuuggccucccagagugcuaggauuacaagcauaagccaccaugcccagccuaaucucgugggcuugagcacauuaaccugugggaucugaugcuaacuccagguaaaugugucagaguugaauuaaauuguacgacacccagcuggucucucaagagaaucaaagaacugucugaugguauuggaaagcaccucauuccccaaauguucuuuguggugauauuuuacccaauucaggauccacccaagguuuguacauuacuucuggcucuaugucucuuuaaucucccccaggcuagacuauccuuacuucuuuugaguccuuugaagccuccaggccacuugaucuguaggaugucugaguugcuucauagcuucacagcuuccucaugauuagguucaggccacacauuuccugcaggagcauuucacagggugugcagcgggagguauggaauaucacauuagggggugugugcuaucuggccacaccaugguuggccaggcugaacuugaccaguccucuccauugcaaaggcaccuuuccccaugaugaugaacacauaggcugaugugaaacacccuggugaaagaacuuuuaaaaguuaaucugaaugugagacuccccugcuuaaauuauuucaauuauuucccuauuccagccucaaaauacacugccugcuucuagacaccuucacaugcccacugugguccaggccacugucaccucacauuggucaccacaguagcucccugaccagccccucccaccugcaucucccagucucuuggcauagcaguccaagcaacucuuuuaaagaucacagccaggcaugguggcaagugcuacuugggaggcuaaggcaggaggauugcucaagcccaggaguccgagaccagccugggcaacauagcaagaccccaucucaauuauuuaaaauaaaaaaagaucacaguuggaacagagcacuucucugcaaacuuucagugccucccauccacucagagcaaaagucaagucuucucaguggccucagaguccccuccugaucagcccacugccucaucuccuacaugcucccucuccagcagccccgucccccuugcuguuucuugaaaacacaggcacaucccaaggccauggugccugcuuggaugcuuauucauguauccguguggcuuggucccuccucuacuccaagucuuugcucacaugucacccucccuggccacacugacggccccuuuccccagcuucccuagccuuccuccccguuuuauuuuucuuaguagcacuuauaaccauagcacaguauauguuuuucuuacuuauuugccucugcgcaaguagaaugugagcuccaccaaagcugggauuuuugugguuuucuuucauugcucucguugcacacccaguucuuaaaauaguagcucccaaagugggucuagggaccucuggguuccccuuucaggggcucuuguaucuagaaccacuuucauaguaauaguaagacucccacugccacucucuugggagcaugugauggaguauuccagaggcaccugaacacucgauguggcaguggagccaaugaggagcagaucugagaauccagcugcuuucuuggcagccagacguuaacauuuacaaacaugcagagcccacgccacucugcccacucaguuuuugugucuuuugggggaauuuuuuaaaugaaaaaugcuauuuaacauauaaaucaaucuuucuuucuuucuuucucucucacucuccccuucuccccaccuucucucccuccccucuucccuccccuccccuccccuucucuuucgacucugguacccaggcuggagugcaguauugcaaucucggcucacugcagucuugaucugagcucaggccauccucccaccucagccucccaaguagcugggaucacagagccgugccaccacaccuggcuaauucuucuuacuuuuuguagggaugagggcucccuguguugcccagguuggucucaaacuucuggacucaagugaaccuucaacuuccacuucccaaagugcugggauuacaggcaugaaccacugcucccagcuaucucuuguuauuucuaaaugggcuaauaaauauuuaaaauaagucucaguuuuaauuuaugguaaauaauugauggauaucaucauaaacaaaagcuccagaaucuucaaacauuuuuaacaaugaaaaggaguucugagaccaaaaacuuugagacccacuggcuuuaaacaaugccuggugugcaaaaaccacucagucaauagaugucaugugaauaaauggacuucuuggcuuaacccaugagaccuggccuuggugcucuugcuucugugaaccucccuguucgccuccccuucccucauccucugccuguccuugauuccagcucugcugaccugaccugcuguuccugugguaccuucaugggcaucuggaacuccuuaucccuauuguccaccuuaggaauuccugcuuguccauuaaauggacuccguucaaacguaaccuccuccaggaagccuucccugaucuugccuuucugauuuagugucuccucucuggcgccuuugcacacuugaucacaucuaccccaggguuuugcugauucccacauguguuggugugcugguaugucucucaccagacagagcuccuugaggacaggaacucaucuuaucugcuuauuccaaaugucugguacauaagaggugcuuaguguauguggaaucagugagugcugccuuggaauucagaauagggacuccucccucccuggaauuaacccuggaccaaagagggucugaaggggaaaugguuucuggcuucugacuuggguuuugaaaugucagcauuacaacagugcuacaugguuacuggggaagaaguaacauuuacugagcgccugccgggucccaggagcuuuugcguggcaucuggcuucaggauauugugguuuguuuggccauugugaacuggcuugggcccuaaccacuuucugucuggcuuccaugaggacaguguggucuuguaacuaagucaccaaacuucugugaacuucugggacauccuaacacauuugcauaguacgugcagacugugaaguuguugagggcaaaguuguauguguguugcuggaucuagccaccauguccuguaugcuguccauaagagauacccggaauucccuguccaaagggcauaguuaauacucucaauaucacuaccagcaagggcuucccauuguugguuuuauagauauucagaaguggagagauaucccuauagcuggggugauccaggaagacuucccaggggaggagggcauuuuguuguuguuguuuuuagacagaaucuugcucugucacccaggcuggagugcaguggcacgaucauggcucgcuauagccuugaucuccugggcucaagcgaugggaggagggcuuugagcugagcuuggaggauggguaugagccccuuuuggcuuuaguauuuccaggaaacugucuccuuuccaaggcugcuaugggaggcagugcuggaggugugugccuucaucaaggcuggggagggaaggcauugcuguccgcuuuaggguuuuacccuugcggaaaugugacauccuugggcugggugggagagcagaaggcagcccgugggggcggagucagagcaguguguggggcgagaggaggaggggggccgcccacagucugcugaugugccaggauuugaggggaauuuccauggacucccggagcaguagagcaacccuugggguugucaugccaacugggaaacugaggcucagaaaagguaagggacuugcccaaggucacaaagaguugauagcagagcugggauuggagccuagggugcccauguggccagccgcccagugcuccuucccuuuccccuuuguccucuuuggagacaugagcccuuggacuggggccauuuaucuucauuaaggcccugcacguuccagacacuugagaucugauugccuccucugccuucuauccauaguucaggggcaaaggguacaguuccgaugugggauuccaugcaaagggggaaagaauaaaccaagggccacauauauaaaaagcaauuugaugcauuucuuuuuuauauaggaaacuacaucuaacauuaaaaacaagauacaugaaauaauaauaagccuuaacauugcccaaguuguguagagacaguuucuauaugccugauucagccagguguccccugggagccggcaguucugacugagccucacauccucggcuccugcugcuggaguucccuucaucucugcccacccuccuccccccaccugcucuccccaccgccugcuccuuuucagauggcucucccuuauggcggcuucuccucucagcagcccagaggggucaggacagugagaccacagggcacucccauaccccuucccuggaacuccucuugcccucacuuugggccccaugaggauaacucucaggcagucucuagggaagacccuaggccaguggaggaauaggggaugcaugaaccaguucccagacaggaugggcuccgaaaggcugccaggaccuuggacuggaggcuguuguauaggacaaagaccuccugucaucucugugagcccaugucuccuuucaaagggucugagagaaggaagaucugggccaucuuacucacuucugcuggugguggccuauaguuacgagugguggaggcuuagcugauugggugcugugggcugcagagggacacaguccuggccagaggaaggaggaggaggggugaccagcaguacuuugacacaggaauauaccccugagcgguuacccugggaggaagcaagccccacuccagcccaccccacccagcucuucauuccugggcucccuaagcccauacccagaauuccagucuccuuuccccauuccuaccccgcagcuagagcuccaaccccagacagaggaugcugcuggcaguggccugagcuggggacuuccugucucacugccagggccagacauccagggugcauccgggagcacugucuucugcucugacugaccucuggcuacugagucagcggggucugggggggccuggccggagguccacccagggcugagaucugggaagaaaaucaccagacaccauuacccauguacgcuggggacacagccuugggaggcaggcccguggcucucuugguucagacacauggaagguggggagagagagacagagaggucuggagagugagggagaaagaaaaccagggggaggaggguguuggguggagaugaaguugcucuugacucuccuucccauggcuguuucugugguucuccgauuaaccaugagucauucuuauccuuaagccuuggaaggcucuguuccagacugggaucaucgcagaguuccuucuuugggcuuacaggcgucugaagccauaaaccauuucucagauuuauucucccagcagauauauuaggccagucccugugcucagggaggguccaguugcaugaagucaaacucugugcauccuucagaguccuucucugguuuccccaggaggaaguaauugcucugcaucuugucucagaaugccuuggucaguuauuuguucuaccgcuucuaccugccuguccccaaacucuuccccaaaacagcccagggcaugccauccccacucccacccugugcuucauuugugguuguucuggauuagaaauuccacucucugcccuggcuggauugaauaacugggguuugcaaaacucccagccuagcuccuucacagccuggaaugugcugugugccugugggagucuuaaaucaaguaucugcaacuauugccaacaggagggguagcaaaacagacuggugugcccacuuugcuuccuagagagguuuguuuuccaaaggcuauguuugucaccuuugaacugaugaacccaagacguuagaugucuuucuccagcucagacaccauggaaaacuugagggaggcaaugagaacuguuguuaaagaagccauaauucuuuaaagaaaccauaaauuaagaagggauuauuuauuuaauaacauuaauaaagggauaauuuacaaauaauaaauauuuauuuauuauuucuucacuuaggagcaggaagaccugcuagaguagaaaugucauuucuccccaaacggaucuauagauucauucugguuccaaucaacguccaguucaguugauuuccucccgagacuugagaagaugauucuaaaauguguauggaagauucgagaucuaagaauaucuaggacacuucugaagaagacaggaagaagagacuuggccuaccagauggcaagauguguuguaaaacugaagucauuacaauaaggagguuuguuuagggacagacagaaugaccaauggaagagauaggcaaaaacagccccaggcauauguagaaccuuagaguaugacaguggggucauagcagaucaguggggacagaaggacugguuugaucaaugugcucugacguuaccaaaaguaacaaacaaaguugggcauggcgguucacaccuguaaucccagcacuuugggaggcugagaugggaggaucgcuugagcucaggagaucgaggcugcagugagcuaugaucacgccacugcacuucagccuggaugacagagugagacccugucucaaagggucucaaaaaaaaaaaaaaaguaacaaaagcaggcugugucagagaaugucagggacugaggauuacaauucaccagguucucuguacuugauguccaguuuuuauaaaggaagaaguccuguccagagucaaggcagggucgacagcaaaguacuagugacaaagacaagugaaugcgccuuugcuggcggcaggaggcagccucugcugcuuucucaagagcuggcuuugauuugggguugugggggagccccguuccucaagcauaaguagggccaggucagugggauggagguucaguguccccagaacuuagaguaccgccuggugguccuggagguggggccggugcucccuaggggagacagaaugggcccuuuagcgguuuggauugggggcacugccaggaccuccuauccuuggucuguuuugcuuuccuuacaggaaaggggagugggacagcaggaacccagcugcccuggggaugugggagagaagacuguuuucucccgaguaaguuggugaauacuugcugagccuucccuagcuuguggcaggaggguugaagcaugugccuuuuucuuuuucuuugagacagagucucacucugucgccaggcuggaguacaguggcacaaucuuggcucacugcaaccuccgccucccggguucaagugauucuccugccucagccucccgaguagcugggacuacaggugcacgccaccacacccagcuaauuuuuguauauuuaguagaguugggguuucaccauauugggcaggcuggucucgaacucccuuggccucccaaaaugcugggauuacagacaugagccacugcacccggccaccuuuuucauaaggaugggcucuaccuucagaaaggaaccuuguaggaguggugaggggcagcaccagcgagagaugcucuagacuugugcuguccaaaauguggccaccagcuaccuguggucgaauuuaacuuaaagcaaaauaacauggaagguucaguuccucaggcaccagggccccguuucaagagcuugcuagccacacguggcucguggauaccacacuagguguuggcaucaucuaggaaguucucagcacugcugcuccgcuauugucggcuuuguauuuugcaaagguguuucacaccccuuuccccccaguucuucauaaaaggcccaucugguagccuuaguggcuggccaggcagacgaguuuugguugugaauccugacugucucauggguucugugcugcuuagucucuuugagccuagucuguaaaacgagauuaguuguuccuuggauguuugaggggguauguugauuaagggagaugagaugaugcagguaugaccccugacaggauaguggcaaagcauaaucacuauaagagccaacaggcuuuacuguuuuacaggugaaaaaugaggcccacaagcgggaagugacauggccaaggguacugagcucacccauggaggcccagaacuccugccuucuauguugccucugcugcucccgccagcacccugcucugggacaggagaagcuggggcagcagugugcagagcagguggcagugugcagagcagguggcagugugcagagcagguggcugucugcagggugggcuuggucuggggccaggcaggaugggccucgggacagagggccuugggaagggaggugcaggguuucucugggcaggaggaggggguccugcuagucccacuuuauucaaaaccucucucaagccuuggaguuuagcucuuccccacccccuuucaagcuagaaagucugaaaagcgcuuuguuuugguccaacacggagcccuggaccucaaauacuccaugagacgguuguggaaugaagugguucucagggccuuccaggaaaugcgggcucuggcagggggcucauccugauguucugcgcucucccucuucccugucacuuuuguucaaauuccuagagcccucuucaccucuccauggcaggaaugauauuugcuuccuguagaccagggguucuuuuuuugugccagggacccuuugguucucuggggaagcccguggaucgauccuuuuucagaacaagauauuuaaaugcauaaaacgaaauacacacggauacaaaagaaaccaguuauaguaggauacaauuauuaacauuuuauacaaccaaauuuuugauguaauaaugugcaacuuuaucagcgcauucaaucacaagaucuagcagugagccuaauacuaucauaauuuugaaguaaugaggaauguaaaugacauuuuaagauauucagaauaauuguaaagugauuucuacuggugacaaaauugcaggugccguuaauacuacuucaguuuguugcccacaucccacauggaagggauauuucaguuagagguaaacaaaaguaaagauguggauuuuucuccaucuccaguuugagagcucccuaaauuccauccauuggaccaucaguuccagccucucuuacucucccuucucaauagucuucuggccccuugugagccuauagaacguaauacagggccuggaacacaacagagccuaguauuugccuuuugggggugaaaaugggccuugcagguccucguuaagugcagauuugccccagcuguggugagccagccggcacgggugaccagaugcuuccuucaggaggcacaggugcuggaaugccucacagagucuccugcuucccagcagcugccuggaacugggccucucccugcacaggaggaagcaggguuccaggaugcagaggaccuucaggucugguucaugcugggccacagggcuccucugcagccuguugaagaugccacgugguucacaaagccugggcuuuugggcuuggcugugggcugccagcagcacgcacuuucccucuuuggccccaaaugggcauggccgugugccccccacccccagcccuguuuagcugaggccauccugcuugacagaugggccauuugcuuccuguucuagagcugaguggccggcugccuaguggaaggcuauaauuagcagaguggagcggaugggauugcaugcuggcauugacagauaauuuuauccucagauggauaaacugaugucaucagagauguaaauaucauuuggaaauuuugaaguuccugggaagguuuaugcuggccucuccccaugcccgcugcucuugggagcacuugaauggggaggccagagaggccugugcuguauggggagcugccugggaguugccugccaggcugcugggaggguugggguggcagcuccuucugcuagaccaggagaaauagggccuaggauugcuugagggaguucuugguuuacauuugcuuugggagcuuuucccaugggguuuauggucuggaaaugucucaaggcuaacuagcaaggaaauggcaaugcuuuauaacagcagagagugagaucagagcaagggguuuuguuuucugccagcaaggguguucuggagugggucccagggcucuggggagcuuguaaaaauagaagaagccacugacugccuuuauggagagggcuggggucaguucugcucagcauuggggccaguggcagcucugguguuugggggaugguuuccaaagcagacuaccuuaacucagaagcacagucucaggcaggaaggaggaaugggaacaggaugggggcaggggaauggggaaggaugucagcuguccccauccugccagggaagaagaagcauuuuuuuuuuacaacagggaacacagaacuuucaaaaguauaucgggccaguucugaaaauguuaagauacaauaguuguguucguuccacgacagggugagaauuacgcuuuucaucaaaauggaagauaaaacccuaccucugcuaccuuccaguacccgagucccugaauauuuuauucacuccaugccuggacucugaaaacuuccaugcucuaugggguucuuauuuaaccaugauucucugcuuugagguggaugagccucagggcucuuuuauuuguccagguuuagaguuuagugagugauuccucauggguggagucacugaggaaggggacuuggccuuuuuuuucuuuucuuuucuucuucuuuuuugagacagagucuugcucugucacccaggcuagagugcaguggugcaaucucggcucacugcaaccucugccucccugguucaggcgaugcuccugccucagcuucccaaguagcugggauuacagacaugugccaccaagcccggcucauuuuuguauuuuuaguagagaagggguuuugccaugguggccaggcugcucucgaacucuugaccucaagugaucugcccaccucagccuccuaaagugcugggauuacaggcgugagccacugcgcccggccuggacuuggcuuuuuaaaggcugcucgccauugcucuccgaggaccuggggcacuuaggcugcccccaaacagugauuucuccauguucuggguuuuggagcaugacugugucuguccagauagucucugguuuaccuuucucuaccaaaaaguagauauuuuucauggucuucauuuuccuguagaggaugaguauguguauguguguguccugccuucuaaggccaacuuguuaguaaguggcugauggcugagcuugucagugucuugagucccugccggccuguguguuggaaaggcauccuucuagacuggggggaaaggucucacuaauccuggauuaauuuucaaaccaaggggaauggcacuuagccuugaaacauagcagaguacuggauccaagugagaugguuuccugguaauccucuguuauccuguguuucugcauaagcucugucugcuuauuugacuuuuggcauccccgucacgcaucaaagcuuaggaggaagcagucacuucccuuuauucaggacuuagcucucuuuagaaggaggucacgggcaucugcuuaaggacaugaugaucaguaaggagacccaugaagucaguuuaaggcucaggcagcccugugaguggcuggaggggcggccuccucgguguuuugcauggugacacugggguggcuaugcucaugucaccucccgacaacaucugucuguaucaucccuuccuuuccuuggacccuagcugacagcaccaugucuuccacuuacucucccauguugccuucagcuuaguggagaaguccaguuaucugaugacuugucccugcccucuggaacaugaggcccagaaagucagaauccuuggacaggcaggggacuggguagacagugccugacuugaacucagagggucuauuggaaagcccaggucuuguucauucagaagauguugaucauaaaugcugauucuacuuccucagugucagaaugucuuggugcuggggauguccgaagcaauugaaaaaucccuccuggagcuuauguucuagugaggaagacaaauucaaaaaaaaaaaaaaccaaccagaaauaguguaguauguuaaauacugguaagugcaaaggagaaaauaaaaaagagaaaggagaucaggaguuucauggggaggaacuucccaucuguaaauaaaguggcccugaagggccucccuuugcaggcggcaacugagcaaagaagagaaggagaugggggaguaagccaugagugugucaggggaagagcauuccaggcaguuggaacugccugugcaaaggcccuggggugagcacacauggcaguugacaagcaucaagaagccuggguucuccuaguggaaaguuacaggguguucugugacagcauguccacuauuagaaaaguugagugagggauucuacuugcgaauucccucaaaauucuuccugcuccaaccuuuggccuucucuguggucauccugaaaguaaauuccguguuaugguacugugugaaaugucuguugcccugagcacggggugaccugccuguuuaauacgcguuguggcggccucgcacuuccagguuuguaguguuuccacauucauucacucgcgaaagccguggugugagcagugcagaaaugaaugucuucaagucugucuuucagaugagaacacagacucacauggucaaaugccuguccaaggcccaggguuagcaaguagcagagcuggggcucgaacccauguucucugacccuccagccaguggcauuuccccuaacccaucuauacucuccucuaaaguggcaucuccagauugggucuguaguagucugcuagggcugccauaacaucaaguaccagacugaauggcuuaaacaauagacauuuauuuucucacaguucuggagguuagaaguccaagaucaagguggcaggguugauuuuuuuuuuuuguuguuguuguuguuguuuuuuguuuuuugagaccgagucucgcucuguugcccaggcuggagugcaguggcacaaucucggcucacugcaagcuccaccuccuggguucacgccauucuccugccucagccucccgaauagcugggacuacaggugcccgccacuaugcccggcugcuuuuuuguauuuuuaguagagacaggguuucacaguguuagccaugauggucucgaucuccuggccucgugaucugcccgccucggccucccaaagugcugggauuacaggugugagccaccgcgcccggccugcaggguugauuucuuccgaggcuugucucuggcuuguagacgcugccuucucccugcguguucacacagucuucccucugugagugucugugucauaaucucuuccccuuauaaggacaccagucauauuggauuagggccaccuuagugaccucauuuuaacuuuaauuaguucuuuaagggcccugucuccaaauauagucacauuucgagguacuggggguuaggauuucaauagagaaaauuuggggaaacacaguucagccgcuaacagggcccuuucugugcuguaaccuggggcaagccucccccacagcagguaccacagccccagaugacucuuugcuguagaaaaucaagugaccucagucucucucucacccucuguuuucuugcugcagcugauuggggcccugguccugucugugggcaucuaugcagagguugagcggcagaaauauaaaacccuugaaagugccuuccuggcuccagccaucauccucauccuccugggcgucgucauguucauggucuccuucauuggugugcuggcgucccuccgugacaaccuguaccuucuccaagcagugaguggaccacaccaccccucagccgggacuccccaggagagcuggggcgccugccccugugcccuugggcagcucaguuucuuuugucccugccucaaaccaccuccuuuagagagcuccuuagaucagcccaucugaccacacuggcccaagaaugcccaggccaccuccccuccugcauguaaaagcugauuugaauacuguucuuacuuaaacucuguguucaucuggaugcucaguugcgaguaggaaaaaccacacucaaaugagagcaagcaaagacaaaaaaaggagaugguagugagucauuagcucaugcaaccagcaaacccacacuggguccagggguuuagauggcgccacugggcaggguugggcaaucuccccagccccugccagccggggcugcucccuuugcaguggucacugccggcgucaggccaacaaaguccuuaugguucuagaucucaggaaaucuuuccuaccagcucuggccaaagucccaggacucuggugggccuggcuugggccaugugcccauucugggauggggcauggggagucaauccuaccuguaucccauuauuguggggugagggaugacucccuaaagcuggggguagugaguaggcagauccauucacucugcacuugugugucucuugaccucauugucuccccucauaugggaagccccuacgauccacuguaaaccggguuugggugcuacuugaggcuggaauuugcugaaaucaguuuggguaaugccugcucucuaguaaagggcagaggugggggugcauauccucuaagcuucagccaucccccucacccacugugggggaucugggaagucacaucugagggcucucuguggggagcuggacauacugccccagccugcccauuaagccaggccuagccccucuggcucaguggcaacgaggcccagcucuccuuaugguggugggggaagggcgugcucuuccacauagacccccaagacaaauggagguaaccauuuggcugggacagcugagucacucuuccugcccuccggcuccagagacagguuuuccuggggccugccuguccacguccacguucucacaggaggagggggcagaggccuaggagcugguaggagcuccccgagggaugcuucucuuugugcuugcucuuggagcagauggugccuccccuguaccccacacacgcccacugcuccucuccaggugagucucugaauucuguuuuccaguucauguacauccuugggaucugccucaucauggagcucauugguggcgugguggccuugaccuuccggaaccaggugggccuguggauuuguguaucggccauguguguauggagcacccacugugggugccuugggcuaacuggggguauggcagugagcagggcagauaacccccauggagcuuucauucugcugaaagagaaugacaggcacugaacaaguaaagcagcgacuaagaaaaugaaccaagcugacaugagagcgccuggggaggagaugggaggcccgugcugaaaugguaaaaggagccagcugagugaggucccagcagagggaagcugagcagaaaugagcuuagcaugugagcaaaacagcguggaggccacguggcugaggguaggugggguggagagggguggaaggugaagucgaaagggcuggccaggcagaucacagagguccuuguaggccaugaguugggagcuuggaguuuuuucuagaggugacaggagccuuuggagagucuuaugugggaagcgaugugacccaguuuauauuguaccauggcugcugaguuggggaauggacagugaagaguugaggguguacacaggggcccaacugggaggcuguggggggucauccugggaaugggguaagauugcuuguaccaagguggaggcagugggccugggccaaaaaggcgauuugauguauauuuuggaggcaguaccaucagaggcuguuaugccggcuagaggagugaggagaggggcagguugacagggugaugccuggcauccuggcccuggcaggguuugcagaauccgggccccuuagagccagaaagguucucguggcucccggcuccagcuccuucaggcaggauguacgcaccucauacuagcugugccaccuugggcgaguuacuuggccucuuggauuauuaggggacaccuagcucacagaucugaugagagaaugccugugaaggacugggcacgguucuggcacauaguggucaaggccccacaagaagcuggugguggagcagggcugacuccaacccagggcuccaucuuuccucccauaaucuucuuccuuguccucauccugcauugcugccauagguggggcuugaggagcaggacauguuugcagaagccccauucucuguguccacugccuggccuguaccccucccuaccccagacagcuugguccuggugcaucuggacaguugcugcugggacaugcgucagagcugugagccaaguuaucuuuuuuuuuaaaaauaauguuuguuuauuuuuuugagacagggucucacucugccacccaggcuggagcaguggugcagucauagcucacugcagccucgaaccccugggcucaagugauccuccggcuuuagccucccaaguagcugggacuacagucaugcaccccugugcccagccaaauuaucuuucuuuucagcaguugcucuuaaggcagcaggugcugucccacacccuggguugugcagaccucucagauggcccaggaucuggcccugugaaaauguucaugggagugccugugauuccagcccaggugggagcagggaccacaccaguucugcuggggccuccugcagugggaccuaaccacaggcaagucuacaaaccuggaauccagaggucuuccuguuuuaugagccccaggaaaggggcuuuauuccauuugcccaugaggcugcuucucccuuuuccucuuuucuaccugccccucccuuugccucuuuucugcuuaucagagccucucuucugagcuggcagauccagcaugcugguucacuuuccagcagccuugaggggagagaucuuuauuccauuugcccauggggcugccuuucugugcagccaccagagcuccuggccagccugcggcuuuccaggggcuacggguuagugcuuuccuggcuggagcccagguccaguuuguggccaacuaaacagacuccuggauauaaggaggaaucuccaccagcccgugaccccgggcaugguuucugcugcuaggcauggcuugacagucagacugaaguggcuucuccacucauacaggggcaaguggccauccuaucaauggagucauggaggcacacaggaguuaagaauucccccgagagcacacagcaaggcagaggugccucaggaaugcuucccaguccugacuugcuaccugccccucccugucccucuuuucuauuugucagagccucucuucugagcuggcagauccaggaugcugguuuacuuuucagcagcugugaggggagagaucuuuauuccauuugcccauggggcugccucucugugcagccagcagagcucccggccgcccugaggcuuuccaggguuagcacuuuccuggcuggagcccagguccaguuuguggucagcagcguccacggccuucauaaacuauccuccaaugaugggcagcaguucugguuucuagugcauugcugcagaggccaucugauuugucauuuuccagugcccuguaggucaacagaacaucaccuccuucuuucaagugauggagcugggcugagaugaaggcuuuggcuggcggaacauccaggggcccuucagugcucacagcuuggguuuccgugggccugaggucaggccugacaauuucucaucauccccagacccugcagaugcuguaguccgugaagggugcuccuuccccuugggugguguccccucauggguagggccuugguaugcagcccaggaaggguccucacugacgccucuccgcuguuuggaggcucaagccaugauucgucaucuugaaaacuuaaaaaaugagauacaaaauuauaaaugcaguaagaucgcuacaaugaaaaaaauaggucuacaaaaagacuuaaaggaauggaaauaucagcauaugaacucauauuuccucugagggaugagacuagggugauuuuucuccuccccuuuauauuuuuccuuggcucucaauuuuuuuuuauaaucaaggggaaaauaucacaaaaagaaaaauaauaucccuuccaacucuaaugugauaugauuuuguaaaacaggagucaggccaguggcggggaugggggaggagcggccuggcuguugaugaugguaggaagggcaguguaugauggagaaaaaggugaggagcaaucaaggucagcuuccaggaggaggugauuucccaauuccauuuuucccugaucaagaggauuucucugagccacaauguaacaaguucagucuccagugccaugggcccugguaacucugaguaucuacuuaugaaaagucagaacaagucauuagguauugggggaacccacccccaauauuucaccauagguucuuucuauuuuccauaagugucagccagcugagaaauaaagagaaagaguacaaagagaggaauuuuacagcugggccgcugggggugacgucacauuaucaguaggaccaugaugcccaccugagccuuaaagccagcaaguuuuauuaaggauuucaaaaggggagggggugcaagaacagggaguaggucacaaagaucacaugcuucaaagggcaaaaaggaaaacaaagaucacaugcuucuaagggaaaaaucagaaacuccucauaaggguccaacaaagaucacaaggcaaagggcaaaagcaaagaucacaaggcaaagggcaaaagcagaauuacugauaagggucuaccuucaguggugcacauauugucuugauaaacaucuuaaacaacagaaaacaggguucgagagcagagaaccagucugaacucaaauuuaccaggguggaguuucccaauccugaggguacugcaggagaccaggguguauuucaguccuuaucucaacugcauaagagagacacucccagagcggccguuuauagaccucccccuaggaaugcaguucuuuucccagaguguuaauaucaauauuccuugcuaggaaaagaauuuagcgauaucuucccuacuugcauguccguuuauaggcugucugcaagaagaaaaauauggcucuuuuugcccaaccccgcaggcagucagaccuuaugguugucuucccuuguucccugaaaaucgcuguuauucuguucuuuuucaaggugcacugauuucauauuguucaaacacacauguuuuaaaaucaacuuguacaguuaacacaauuaucguaguggccguaaggugacauacauccccagcuuacgaagauaacaggauuaagagauuaaaguaagacagguguaagaaauuaugaaguauuauuugggaacugguaaauguccaugaaaucgucacaauuuauguuccucugcuguggcugcagcuggucccuccauuuggggucccugacuucccgcaacaauuaggcuaaggauuacauguuggguucucagcgaggugcacagaccacggccacagccaggcauugaaagcuaaacagacuccuggauauaaggaggaaacucccccuggcucugaccccaggcaagauuucugcugcuaggcauggccugacagucggacuggugccgcuucuccacucauagaggggcaaguggccaugcacuggggagcugggcacagagcagcccuuaggagcaggagaaguacgacaccccugaccccagccaggggcuggaggaggaccugagugacuuccccaguugugugggucucaacccucuugacaccugcuuuugucccagcuuguucuggggcuucuugugagggugucaggugucagaggugggcagcuccucaugcuuccagccaggugcagcugagcuuggacaccuggaggguccgggcaguagcgggugugucuauacccccaucccaggccuccucucucuaccaccaggguaggaucagugggcauugugguccuaccugacacuguggucagggaacaguggggagcaccagccugccuauuuuaucauggcacuggcacaagcuggcucugggcacaaccuugaggucagaggcaggagaaaguaggcagcaccauggcucucucggccaacaccugaauauauaaaguuuucccuugguguccgacggggauugguuccagaacaugccccugaccaaaggauacccaaauccacacaugcucaaguccuuuauauaaaaugguguaguacuugaauauaaccuacacacauccuccuguaaauugcaacacuccuagauuacuugcaaauaccuaauacagggccaggugcgguggcucaugcuuguaaucccagcacuuugggaggccaaggcagguggaucauuugaggucaggaguuugagaacagccuggccaacacagugaaauccugucucuaguaaaaauacaaaaaguagcuaggcgugguagugggcaucuguaaucccagcuacuagggaggcugaggcaggagaauugcuucaacccaggaggcagaggcugcagugagccaugaucgugcuacugcacuccauccagccugggugacagagcaagauucugucucaaacaaaacaaaacaaaacaaaaaacccagauaccuaauacauuguaaaugcuguguagauaguuguuuaugcuguauuguucuuuaguuuguaucauuuuuuacuguuguguuauuuuuuauuguuccuuuucccaaauauuuuccauccacuguuguuugaaucugcggguacggaacccguggauguggagggccggcuguguauccuucccacuuacagcagagcggucggccuuacagaaguagagagugcuucucgcugguuuggccagacucccccacgggugugccccacuguggaaagcugucagggagugaggcuggagcccccagucccaaggacacugaaacauaacccucucccaccauggagaugaaccugugacccuggccaggucugaggaagggucuggcagaugcucacuccacacgccccuucccaccuucuccugguccccuggguucucuuccauuccugauugucacauugggcuucuauugggacuggagcagaggcuaggguccgggggcaaugaggguaaguccccguucuagagggacugggaaaggcugagaugauggcuuggcuccaggcgcaaaugaaggaggaaaauccugggccaagcaccucuccuccaaguuuuuguuuuguuuuugagacagucuugcucugucacccaggccggagugcaguggugcaaucacagcucauugcagccucagcuccuaggcucaagcgauccucccaccuuagccuccugaguaguugggacuacaggugcaugccaccaugccuggauaauuguguguguuuguguguagaugaggucaagccauguugcccagguuggucucgaacuccuggacucaaguaauccuccugccuuggcaucccaaaguacugggauuauaggcagggaccaccaugaccagcuucuccuccaaguuugagagcuaggccugcacuaggccagcagcagggccuucccagccucaggucucaggcuuacauggaagugguguuagccagaggcagccugagggagccccgggccacuccuuccccagagagguucuugguccugugcaggcagcuggccugguaggaagcuuuagcggccgccccuuccacuccuuuuccuaccccucuguccucuguguuggaggagcugccgccacaugccucacccccuucaguuccucauucauuuaaaaacccugagagaggggugauguggaggcuucagauaaaaacuagauuuaaaaggcaaagcuagaaaggauaguucuucauagcuuucucuggugcuuuaaacaacaugcuuucaaaccuuguggcuuuugauguuugcuuacucuuugcuuaauuuagccugguuuucuaguccucacuggagcugccccugcuggcauggccugguuuggaggggaauggggugggggcaguggcacuggguauguugggcaucugggaauggcagaggaagcuagaauucucucuucccuguccucugaguggcuccccuggucucucggaacauuaccagugcugucaacggcggcauagcacuuuacaguuaaacugcacagccagcuugccucacgggaucuucucacacacacccacccccaaccaucgccccucacagcacaggaaccaucucaguguccucgucuccccgguacacauacacacgugcacacacauacaaguggugcacacuugcaagaaccagcaugccucaaagagcucccugauggggguugggggcagcugcuguccaugaagcccagggacaucuguugcuccugcagggccccccuucccccaacaacagggcucagcuuaccagaugaaaggccgaauuuuuccaggccccucucgaagcccgagccuuggaaagugcccaggaggcgggaugguuuggggaggcgggaugguuuggggaggcaggcuggggcugcucaccagagaggcagagccuuuccccacagccacagagcagccucuacucugccacuuccccuccuuccugcccugggcuucccaccuucaucccacccuguuggcagcccugggagaguccaaacagcacaguggccagugggggugcuguaagugggccagugggcccggguaggugcagagggacauggugggccaggacugugucuguggugccuugagaguagggggaagccacccgggaggaaccuccccacguguggccuuaggcaaggcccugacccuggcggcaccccaugaguacguagcucagccaaucaugucguucagugcuguaagcucauuccccugccccacccuggguggcagacuggccccacccugguauccuguuuuuuaggcacccccaaccacaccccagccagcuggccugucccuucaucacccagaggagcaggcacccaaggauggaaaagcuuugugaccugggggccucugggaggugggccuggggccaagagaguccuuguucugcccaggcugcucggcuggaaggcaaugcucccacccaacuucugccccgggggccagugccagguccgcgaagggccaugggcuggugaguugacagcugcucacaggagccugcaucuccucucuucucuuggggcugacuccagucuucugcaaucccaggccugcuccagagcugcuguuuaucaucagcagaggacuuuccuucuggccacgaaggccaguuucuccgagcccaucuccuuuuuuuuuuuuuuuuuuuugagacagagucuugcucugucacccagucuagagugcaguggugccaucucggcucacugcaaccucugccucccagguucaagcgauucuccugccucagccucccgaguagcugggacuacaggcgcacgcugccacgccuggcuaauuuuuuguauuuuuaguagagacgggguuucaccgaguuagccaggauggucuugaucuccugaccuugugauccgccugccuuggccucccaaagugcugggauuacaggcgugagccacugcgccaggccgcccugcuaauuuuuguauuuucaguggaggcaggguuucaucauauuggucaggcuggucucgaacuccugaccucaggugaucugcccaccucggccucccaaagugcugggauuacaggcaugagccaccgcgccaggccuccaucuccuucuuuaccuuggcuuugagcagagcgaggcucggggaggaggugggugcugcagucuuuguuccucuuuuccugauccuggagauaauuuugggagauggccccaaaccugaaccuugguuucuuagcaccuuaaagugugucaggcugggaguuugacacccuggucccagcgucucucugccaguggugugcugggcaaccucggacuagccacaucgcucucugggcugcaggguguugugagagugggguuggccaggacucgugccucagaggcugccuccauugcagucaguuuuuugaacaagaguuggggccucgguuucccacgggauuuguuuuccaccaaugacgugggugugaaguaguaccauagaguauuugucuccuuuaaaaacagacaaaaaucuugaauaauaacaccaggaccuacaaugugccugguguccugcuaaacaccuucacagcuuuuguuuauuuaaaucucacaacaucccuaugaggcagagaguguuuuccuccugauuuugcaggugagcaaacagaggcucagaaguuaaaagaaguagcggaggcccagguggcuguagggagguguccuugauuaugaggcuugacagccccucugagacuugguuuuugauucucagagcucgaaguuaccuuaaagauaggccuacggguuugguucacaguugggaagcugaggcccagagaggagaaguaagccgcgauggggccuggaaccaggauccuguugucccagcguacgcuguggugccacccccgggaauugucuggcucuucagucuggcaccggagccgagaaugcccccuucguccccagucucugcugauacucgaccuccgugcucugaaagcugcgauuguuacagugagcugggcugcccacgcuccugcccccgccccuucccacuguggggcccuuugugcuucugggucucagcacaacagccgggcuguugauccagaaagcgcagcgugacugggagagggcggccugccauguuccucccggcagggauugucccagcccuagccgagggggaccgagugcugcagugaugaggagaacagcccaugagggaggucaggagaccugaauuccaguccuggcaagaccccacccagccugcucugugaccucacucccuccccaagucucgagcuccucaucuguaaaacaagaggcuggaugguggaggaguguggagaggggcucuggagggcaaagggaagauuccagcgugggcccaucccugggcgguagaaagagcacugggccuggaaccaggacagccaggucucagcucaggcauggcggcaucagagcuguguguccccaagcacggccccagccucucagggccugggcugucuggucugcaaagggaguggagugaauuacuccugcugggacauagcacaggcacucaggcaucagaugaacacuggaggcacggggaggauguguggguagggaggucacgggcauccaggguggggaguggagggggcuccaugcuggcugggcgcgagcugcauuggcacaaggcauucucuacccauccaggcuucuggaaaaccuuggguuggacuccgggagugugugguucuuuuccuuuguaauuucuccuuuugaauagaccauugacuuccugaacgacaacauucgaagaggaauugagaacuacuaugaugaucuggacuucaaaaacaucauggacuuuguucagaaaaaggugagccaggcgcuuugggguagagaugcgccucccgugcucuuagccccccauucaggccccugcucaagaagauggggugagggaccaggugacuuauccauucccaaagcagguggcuggccagauugggaggcaacagugagcauggauggcccaccaaggauggggaagccagggcccaaccuauucagccaguccucugcccacauuccugacccaaaaccuucacacccuucuguuccucuccaguuacacuggcuuccugccccauacccccaaauaaaacaaagucagguguugcuacaagcaaccuugcagggucccagggcaccacccuccaaugggcaaggauccuccuuccuugaggugugagcaaccucaaggggaguaaccuaccccaguccaaagcccccucugccaagucucuucagugacaacucacuccuugucaaguuaaagacaucccugauugggagaaaguucuucacuaauuucaguuucccccaaauaugggacagugaaccagacgccucucuuacuuucaugacacuuccuugaaugugaugaugauccuauuccuuuugggacaccaucucuccccucuagguccacccaaaucuguuggugcaauaauaauaauaauaauaauaauaauaauaauaauaauaauaauaauaauggcagugguagggccagcugcuguccuggguggcuuuuguacaucaacuucacuugguccugagccucagcuuccucaccuacauaaggggaauaaugacaggagcucuuggggcgucgucaugaggauuaccuugacuuaauucaggagacgugcuuagaacagugccaagcacagggugagaccacagugccagcuguggggaucauugguauguucuccugggugaggacaaguagagugagggcugcaggcccacucagccgggacagcacuuccugggacauaaucuugggggccucagcuggccuggauccuugugccagcucucaguggggacuagccucuccccacaugcagggccacuugcuguggccgcucccuuggcccagacuuucucuucagucacaacaggugcagccucuggaaggucuuuuucugccagggaugugccugccagcuugggcugggagagcugacuucugcuccggguggagugagauguuuuuauuggaaccagccuuuagcuggcuuggggauuucauuucuccuggcauagagguaggaggugauuaaugcugaaugggcacuugcuuggugccagguccagugcugagugcuucaugcauggcacucuauguaaucacagcucagcugugcagagcugccauccuuauucuugcuuuacagacaaccaucugaggcucagagaggcugaccaacuugccugagguugcacagcagggagugguggucugaggauuugaccuugggucuguuccauugcaagacaaaugcccuuugaacuacauugcagaaagacaguucuaggucccaaaaccugguggcuuaaggggcacuguggggacucugaaaggugucuggcuaccaggacguguacugcagcccugguugagcccuccagucccagcucccugcuucagcuggcuggcaaagcuuugcaugguccagccugugccgcccuuucauccucaugcucugcacucucucuguuccaggcuuguuggccuccgcaccugcugcugaaauacaagcuuguuucugcguggggccuuugcaugggucgucuggcuucuuucuguuuccauguuucagaugaaauauccucucuacaaagagcccuuucaugaccugccaaccuagagcugccccuccccacuuucccccuauuucuccauuuccagguugcacagcaccuuuccauccagugcucacucucugucucuccacuggaauguguuccaccugagcaagggcugccuugcuuuugcucacccugucucuccagugcccaggacaaugccaggcacauaccagccaucaggaggguuaccaacuacuuccuacaggagcagggaggggaggcagggaggggcucggcuaaggggagagcuccaggcagguugugaggugugggugcucuccuugcuaagggcagggccagcugagcuggacgggguggcuccuagggugggugcgaagguugguugaggugcagggacuuucacagaaucaugcuuggucucugggacuuuaagggccaucuuuuccagccuagcaccugcauuuggggacacgaagaugaagaaaguggaggccaguugucaaggaaggaccuuuccucccagugccuagucacuacccugauaucccaccaagaggcagcccagccuuggcuuccauaccucucuagugacaggggguucacuacccucuaggcagccaugccacacuuugacagcucugacuugaaaguguacagccucucccugccccagggugacccacauaauaaacugccuccgucuccugacagggccccuuccugucgucugagcagggccugggcgaugacggcagcuccucuuuccugcuugcuucccucaguucaagugcuguggcggggaggacuaccgagauuggagcaagaaucaguaccacgacugcagugccccuggaccccuggccuguggggugcccuacaccugcugcaucaggaacacgguagacacugcuccuguggggacuggggggcugucggggaccccaggugguauaaauguucucuuuucucucuucccaacuugaagaugggugguguggguggauggcagggaaguaggaguugguggcagagcggaggcuuuccugauucucaagggcuccugaaaguggagcuucugggggucggggguagggagaccaugucuuucuuagugguguugguuaaaaucuauugagcaccuaccuugugcaggccugcucugggcacuuuggugguauuuacucauuuaguauucacgacaacccugugagguauguacuguuauuuuacccacuuuacagaugaggaaauugaggcacucaaaggcugggugucuugcccaagguuggcagggcugggaugaagugcaggcagcuguugccugagcuacacucuggagaacugugcaggccaggugagggcaggagggagaggugcccaggccaggggagcuuagcggggguagcuggcucugcagcauuaguggaggcaggcaggaccugcaccuugggcaucuccauuggucuuuggccuugagguccuggugaucaucagcagcagagugcuuggaagggggucuggugacguaaaugccauccucuuccucuccccagcacgauccucucgggucugucaccuuggucauuugggaugaugucuuguguugucagcgcuuaagugaaaggcuucaucaguccuuguguuugacaaauguguccagaaacuguuucaggauuggaacgagguggagagcuuugcaauuacucauggcccagauagucauggaaaguuuuucuccugacauugccaccauucugugcccacugcuggauucuguaaacugagcagcugcgggugggggccucgcccaugagucagagagccagugccaagugcacuagcucuaaaaaaggccgggccaggagggaagcuuuguuuggaaguguuagcugccauuuuaggguaguucucugggaaguggggugcugaggaguagcagaguuuccagagaggccugcguggggugauccugaaccucaucacccagggcagcagcaucugaauaccuaagcugagauguggaagccaaacuuguauucauucauucauucauucauucaacaaauauuggcugagaaccuacucuaugccagacacauuuccagguucuggggguguagcaaacaaagucucugcccgcaaggaggugacauccuaguggagaaaacugacaaacaaaauaaguaaaagauagaggaucauaaaugcugaguagaaaaagaaaguagggcauggaggauugcaguuugggauacugagaaaggcgggaucugggugaagcucugaagaaagugaggaaggugucugggggaggggcauuccuggcagcaagaacagcugugcaaaggccccaggugggaaucaccccagggcguuugagaaaugcacagaguggcuggagcagagggagcacagcggaggaugguaggagguggagucagggaggucauggguaccccgaaggccacaggcaggacuguggggcacccuugagugauggaccauacagggcugcauggaagaggggcacucugacuugguuuuacaagaaucagucuggcuguugugagggacaugcuagaugcagggauagaguuaggggcugauaugcagugauccaggggucauaggucaucuuguccaggaaggugcucuuggaucaacaccuguggaagugggagccagaagcgggauugggcaaugaagggaguugagcagugaugcagccucagcucaguucggcuggaggccucagccacaucuaugaggacagcccuucagaguuguccccuacuggggugagggggccaggccuucacacucccacccacauugaccaggcauugcaugaguccagugguccacccaagaagggacuugcuggcucuguucagccaagaacagacuaauacagcaagaggaaagagagggauugauugaugauaaggaauuggcuuguguaauuauggaggcgggcaagucccaagaucugcagggugagucggcaggcuggagacccaggagagcugaggguggaguucccauucaaaggcuggucaggcuucaaaccuaggaagagccagcauuucaguucaagcccgaagguagccaagcagggagaauucucuuauggucacugaggagagggcagucuuuuguucuguucaggccuucccugaucagaugagaccucucccccuugggcagggccaucugcuuuacuuagucugcugauuuaaacauuagccucaugcagaaacacccccacagagacacccaggauaaugucuggccaaauaucuggguaucccauggccuggucauguugacauauaaaauuaaugaucacaugaaguaguuauugcagggggcugacaccuaagggcuccccacagcaucccugcaccagggaggggaagacagaugcuuggagcugggugguggugguggugguggaaguggcaaaccguggugacauucuggcuguauuuugcaaguaagccuacaggauuugcucgcauagcagaugugggcgaugaaugaaagagagaaaucaaggaggauacccagguuuuggucugagccacaggaaagacggggcugccacugccugagaggggaggacugcaaggaggcaggcugggugaccaggagcucaccguggacgugggggguuugagagccuguucagcaucccaucaggggugucaaagaugcgguuggauauaggagucuggaguucugggaacgacuaggcaagggguguaaacacggacaucaucugcagauaggguagaaucuaaagacagcaucugaaugagagcacugagguagggaggagccuuccccuggccgggguuaucugacccuguguuacacaugaccauugagucucccugugccaccacaccuggaugauuuucucuaaaugugaaacagggcguucgcuuccuccauagaacugguugauuuguguccagaucuauuuauuuuacacuguacuauucaaccugggauuugaaugaguacacgggaaauauguaguguaaaaaacuaaaauagcauuaaaaaucaggacugugggaauuguauucucagauaggaggccuagaugauggagaaaaauauaaaauccugcuaucuaagccucaggaccucauggacucacugaaaaggagcugagccucgugucugguggcuuggagcagggcuccccuaccuccaggccaugaaccaguaccggucaguggcuuguuaggaaccaggucgcacaacaggaggugggcagagguugagggagcauugccaccugagcuacaccuccugucacaucagcagcagcauuagagucgcauaggagugugaacccuauuguaaacugugcaugcaagggaccuagggugcaugcuccuuaugagaaucaaacuaaugccugaugaucugagguggaaugguuucaucccgacaccaucaccccccacccccccgcaccccauccuguggaaaaauuauuuuccuugaaaccagucucuggugccagaaagguuggagaccacuggcuuagaguuuccuggcaaccaaaaggaaaagggagacauggucuguuacauuguuacuguucagcagaacauaccagcagaacauaccaguucuucagggaaaguaaccuuuucccuaacacucagcuuuaaaagaaaugucuuauaugagcuuccaauagaggauuugagccauagaaguucacauagggcuguaaaaucugguuauaccaggauauaucccucggagauguuggugcagagggcagcgugcuucuacauuaaauggcuccagacugcugugccugcugagcucuugggaccaauuuucacguaccuccccucccuuguuguuggcuaccccuugggggccugucgcgaaggccccucucccuguccccauuagcugcucagucuuuucagggugagaggaugcacacacaaacauugcugugaucuucuggcugcccaggagucccccuucugacuuccuguccuguggccccgugcaggauggaagaggcuacuggacccuggucuuggggccugugaacuucagcagagccucuugcagaauaucgauucuauggucaggcagguaaacccaggcaggcuuuacuuuuggaaagacuauggaugcaucguauccccucaccccuuggugaggggcucuccuggcagggugaggugaguccccccugggccuggagaaggguucugggcucugaugccagagaggccucugccaguugccugugugcuaagagacucaucccccgaggucaccagagcuggcccagugaagucacucuugucaccucccuacguaccaugcagcuuaccuauuuguuauguucauuaucucccuuucuacaguguaaguuccaugaaggcagggacuuugucuuguuguucuguauuucaagugacuagaacugggauugacaugcaauaggugcucaguuaauauuuguucaaugaacaaaugaaugaaccaaugagauggaaagcacucacucccaucaugugcccgugcaccugcucuccaggccugacccucuccauagggguuguguuuauggccuggaagggccaaaaacacuggcugacuaaugcccagugggcacugggcauggcugggacugaggcuaccuggagaaccagcuaaaccgagggaggucgucuugccugcacaucaagcccugacauuuagaaugaccuagaugacaucugaggcccaacccucucucggaaggagagaagacacccucccuuuccuuugcaggggcuggaauugugaacaaaucacgccagccagcauucuugugcuccuccaugugcccagccccgugauaagcacuuuauauguguaucucacuuuauguccaaaacagcccuaggagguggguucugugaucaucacaaccuauucauucauucauuuucucaguuaacaaauauguauugaguaccucugcgugccaguuccuuagcagcccaccuaagguugggcucugcuccuaaguggcagagcaagaucuggacccaggaaaugugacaccagagggcacgcugggggcucugcuguugcccuccugagucaucacuggcgccugcagcacucacggcagcguucacuuacauguagagcagcggggcugggggggacggucaugggcuggaccaggaagucucacucucuucccuggugguuggagaaggagacccugcggggcacagguggugaugggaagugcccgcggcagccugugaguuagggccugccuggggagggguuugaugaggucuagggcgugaccacagguuucccuaugccuaaauuaaucaguagucgggaguucuggagagcaccucucuucccaagaaggaaguuuuggcagcacucuccgcugguggagcaguggucuauggaacggaagcauggccaggggcccugcccuggaccucagguaaaccacagcugacccugugccagcuguagucugaaguuuuccuccccaagagccagcggcgcaggaacagccccaccccgaccucugagacggugugagcaaagcggugcucuggggcggucauagcccgggagcgugggcagcacaccuuucucugggguccugaucugcugcuaguggaggggugguucucccagguaaaagucauggaaccugcauuccuacaguuuuuucacggggcauuucuuggaggaggaggugguuaugauggagacucaagccagacugccugggucggaaucucagcuccaucccugcuggacggugcaacucugugcuucgguuuucaucuguaaaauggguaggauaauagugccuuuuugaguuagaaccauuauaaauauuagcuauuauacauuuccauuucagacagaaguugucaacaccauguguggcuacaaaacuaucgacaaggagguaaugucuuugaaaugccuuucccuggaaauguugcucuuccugguccacccuggggugaucggagggguuuauugaggucgggguccuggccacugagauuuucccacauuccuggcugugacccagagccaggacugcugugguuuuccaccccagcacagaagggcucagggaaccaagaauucccccaggcugggagaugccgccugucaggguuugccgagcaccuacugugggcuguuccacaugaagccaccacggcgcuuccugguacccgcagcgugcugugugcccagccaugcucagcaccagcuugccucugccccuggggccaccugggacccaggaguccuagaggaugguaacccccucuggggguugcuccugggucagcuuccugggcaacaccccuggucuaggagagaagcagggguggugcugagaagggaccuaaaaggaauagugaccugacaugcagagcaguggcuuucaaagugggguccccaguccagcagcaacagcauccccuaggaaugugagaaaugcacauucuugguauggggcuagugggugauucugacacaugcuugagagccauagaccagcagugguucucagccccucagaaccaauggccauuuuuauaacaaacagugguaauguccuauuuauuauccccaagugaaauucacagauaaccuaccuacaugcccaauuccaauacaauuaacauaaugaucugagauaaaguagaaaugaaauacagcaauuuacagcuguuuaacauaguucaucauguaagugcuuaggcaguggggggugcagaagacacaauguagucaggugucugcacugaugugaggcaucccugaggcuguaguagcuacagggcagcugauacugggcauuguguuggcgacucacauaccaugggcaucauuuuugccacuggcaugguuuuuaaaaacggugaacaauucuugauaaaguucugaauuaaauaauguguaaucauuccuuaauuuaccuaguaguacuucuggaaaauucuuuguauauuaaaaccaaugcagaaaugcuuuuuuuuuuuuuuucccuuaagagacagacagggucucacuguugccuaggcuggccucaaacuccuaggcuuaggcacuccucccaacugagccuccauaguagcugggacugcaggcacuggccaccaugcccaacucugcuuuguuuuuuauauguaccuggaguggggcuauuggcuuggauaauuauaaauaggcuuuucauguauggaaaacauccgugaggcuuuucaugcagggacaucugagaagcacacaggcagggcaguuguuuguggaguaggauuacccugagcucugcagucccucagccgccaaccucguuugcuggggcaaccaaaagugccaccacgguguccccaguccucucuagagaacaguacuguccauuaagaaucagaaucuagggucaccuucucaugcugcauaugggaaacugaggaucacagcgguugagggacuagccuggaccuuguguacauggcagagucggggcuguggcuccugccagccgagguccucugcugggcugacccagcuccuucccaugcagcguuucagugugcaggaugucaucuacgugcggggcugcaccaacgccgugaucaucugguucauggacaacuacaccaucauggcgggcauccuccugggcauccugcuuccccaggugggcaggccguggguucagagaaagugugacuuggugauugcagaagggcagagaaggugcagaggggaagagcgaagaggcuuuuuucauagaaguccaggacuugccuggggagggcugcauggcuggaaggaggggcaaauggcaauagcagucguggcgaagcucuuccaagugcugcgcaggcacugcugcuucacuucuuuuugugagggaggcacuauuauaaugccuauuucacagaggaggaaacugaggagcagcaagcuucagugacuugccaagauccccuagauagugugcagcagagcugggguggaggcaggaaucccagaagggaggggcccuugcugauggggcacagcgaggcgcucugggauuuccugggaaggggagagggggcccaggugggagcuucuugggcagugugggugcugggagaagucucugcuguggguguugcccaggucacacaggaccaugagggcuugggacuggcugcuuggguuucugggagccgggagcugcagggagggcugcccugauucccagcaggcccucaccagcccugccccuucuucucaguuccugggggugcugcugacgcugcuguacaucacccggguggaggacaucaucauggagcacucugucacugaugggcuccuggggcccggugccaagcccagcguggaggcggcaggcacgggaugcugcuugugcuaccccaauuagggcccagccugccauggcagcuccaacaaggaccgucugggauagcaccucucagucaacaucguggggcuggacagggcugcggccccucugcccacacucaguacugaccaaagccagggcugugugugccuguguguaggucccacggccucugccuccccagggagcagagccugggccuccccuaagaggcuuuccccgaggcagcucuggaaucugugcccaccuggggccuggggaacaaggcccuccuuucuccaggccugggcuacgggggagggagagccugaggcucugcucagggcccauuucaucucuggcagugccuuggcggugguauucaaggcaguuuuguagcaccuguaauuggggagagggagugugccccucggggcaggagggaagggcaucuggggaagggcaggagggaagagcuguccaugcagccacgcccauggccagguuggccucuucucagccucccaggugccuugagcccucuugcaagggcggcugcuuccuugagccuaguuuuuuuacgugauuuuuguaacauucauuuuuuuguacagauaacaggaguuucugacuaaucaaagcugguauuuccccgcaugucuuauucuugcccuucccccaaccaguuuguuaaucaaacaauaaaaacauguuuuuuuuuuuuuuuuuuuuuugccuuuccugugugcuguuuuguuggggcggggguaaggaaggcugcaaccuggauuuggaaaccccuuguggaugcgaggaugaagggggugcauggggugaagauuuggcauagcuugggauacaggugggggguuggggggaaagccucagggccagaggugaccacgccuauuuuaccgagaaccgagggaaacagccugggccagguacagcaugaggcuccaccuccaggaaaugggguggauggggugggggaccagggaagcggaguugcccacagguccaccuaccgcgcucccugcagcccucagugugccuaauggcugccgcgcaacgcaugcagagcguggugucggucgaccccugcuggagaugccgggacuugcgugcgucaguccacucaaaccuucgggccagaagacaugggaucuagauuuuuugugaggcucuuaguagccagggcaauagaaauaaaguagcaagaggccgggcaugguggcucacgccuguaaccccaacacuuugggaggcugaggugggccaucacgaggucagguguucgagaccagccugaccaacauagugaaaccccaucucuacuaaaaauacaaaaauuagccgggcaugguggugcgcgccuguaguuccagcuacucaggaggcugaggcaggagaaucgcuugaacccgggaggcggagguuguggugagccgagaucacaccacuguacuccagccugggcaacagagugagacuccaucucaaaaaaaaaaaaaaaaaaaaaaaaaaaaaagaagaagaaauaaagcagcaagagccccaaaccugaaggauucuaacggugggaaccaucuacacacccaguaguuaaguggucagaugcuuggucugccaugggugccaaacgcauguguaagaaggggcaggaggaggguauuuuaaaguaugcaauaacacaacaauaacaaacacaccauagagcauacuuugccaggaacgauauuaacuccuuuaauccucacgacuaggguaauucuuaucuucauuuuauuaguggggaaacugaggcacagggcaguuaaguaacuugcccaggcaggcagcugguaagugacaaagccaugacuugagcccagauaggaucucuugagccacucagccccucugcuuuacugucucuguugccuccugugcacacaugguacuaggcaugcaaaaccaguggaggcugcagcugcuucugaagcucuguccuggggauauucacuguagccgcugcugcagccucugucuugucccacuuugaccuaauggacacaaggccaggucaagcucugugucuggcuggaggccuuguaguccuggggcucuggcuguucugagaaccccuuuugugcccagaggggagacggcagcugccuuuaggggcagcaggauggcagaggccccguaggagacaggcuggucugaaucgcuuauccaaggucaccuuaccuggacccuggaacccggaccccuugucuucccucuuuccagcaccacucacagacaccccucuaccucacacugcaccgcuggccagcugcuuauguggaccagcgcuggugccacagauggcuaagcuccagcagacacucaucuccucuuuuccaaaccuuggucacucaccucuaaagaaauggaagcauaaauaucuuauuuuuuuugagaaguguguguucauauccuucgcccacuuuuugaugggguuguuugauuuuuuuuuuuuguaaauuuguuuaaguuccuuuaaauucuggauauuagcucuuuguaagauggauagauugcaaaaauuuucuuccauucuguagguugccuguucacucugaugguaguuucuuuugcugugcagaagcucuuuaguuuaaucagaucccauuugucaauuuuggcuuuuguugccauugcuuuugguguuuuagucaugaaguccuugcccaugccuauguccugaaugguauugccuagguuuucuucuaggguuuuuaugguuuuaggucuuauguuuaaaucuuuaauccaucuugaguuaauuuuuguauaagguguaaggaagggguccaguuucaguuuucuguauauggcuagccaguuuucacuacaccauuuauuaaauauuaaauagggaauccuuuccccauugcagguuugucaaagaucagauauuguagaugugugguguuauuucugaggccucuguucuguucuauuggucuauauaucuguuuugguaccaguaccaugcuguuuugguuacuguggccuuauacuauaguuugaagucaggaagugugaugccuccagcuuugcucuuuuugcuuaggauugucuuggcuauacgggcucuuuuuugguuccacaugaaauuuaaaguaguuauuucuaauuaugugaagaaagucaaugguagcuugauggggauagcguugaaucuauaaauuacuuugggccauauggccauuuucacgauauugauucuuccuaaccaugagcaaggaauguuuuuccauuuguuugugucuucucuuauuuccuugagcacuaguuuguaguucuccuugaagaggucuuugacaucccuuguaaguuguauuccuagguauuuuauucucuuuauagcaauugugaaugggaguucacucaugaauugguucucugucuguuauugguuuauaggaaugcuugugauuuuugcacauugauuuuguauccugagacuuugcugaaguugcuuaucggcuuaaggaaauuuugggcugagacgauggaguuuucuaaauguacaaucaugucaucugcaaacagagacaauuugacuuccugucuuccuauuugaauacccuuuauuucuuucucuugccugauugcccuggccagaacuucuaacccuauguugaauaggaguggugagagagggcauccuugucuugugcugguuuucaaagggagugcuuccagcauuugcccauucaguaugauauuggcuguggguuugucauaaauagcucuuauuauuuugagauauguuccaucaauaccuaguuuauugagaguuuuuagcaugaagggguguugaauuuuauugaaggcuuuuucugcaucuauugagauaaucaugugguuuuugucauugguucuguuuaugugauggauuacguuuauugauuuucguauguugaaccagccuugcaucccagugaugagcugacuugaucgugguagauaagcuuuuugaugugcugcuggauuugguuugccaguauuuuauugaggauuuuugcaucguuguucaucagggauauuggccugaaauuuucuuuuuuuuguugugucucugccagguuuugguaucaggaugaugcuggccucauaaaaucaguuagagaagagucccucuuuuucuguuguuuggaauaguuucagaaggaaugguaccaguuccucuuuauaccucugguagaauuuggcugugaaucugucugguccuggccuuuuuuugguuaguaggcuauuaauuacugccucaauuucagaacuuguuauuggucuauucagggauuugacuucuuccugguuuagucuuguggggguguauguguccaggaauuuauccauuucuucuagauuuucuaguuuauuugcauagagguguuuauaguauucucugaagguaguuuguauuucugugggaucaguggugauaucccuuuuaucauuuuuuauugugucuauuugauucuuuucucuuuucuucuuuauuagucuugcuagcggucuauuuuguuaaucuuuucaacacaccagcuccuggauucauugauuuuuugaaggguuuuugugucucuuaucuucuucaguucugcucugaucuuaguuauuucuugucuucugcuagcuuuugaauuuguuuguucuugcuucucuaguucuuuuaauugugauguuaaaguaucaauuuuagaucuuucccacuuucucuugugggcauuuagugcuauaaauuucccucuaaacacugcuuuugcugugucccagagacccugguacguugugucuuuguucucauugcagggacauggaugaagcuggaagccaucauucucggcaaacugacacaggaacagaaaaccaaacaccgcauguucucacucguaagugggaguugaacaaugagaacacauggacacagggagggaaagaucacacacuggggccuuucagaggguggggggcugggggaagauagcauuagagggaauaccuaauguagaugauggguugaugggugcggcaaaccaccauggcacauguauaccuauguaacaaaccugcccauucugcacaaguaugccagaacuuaaaguauaaaaaaaaaugaaauggauggaagcagaguaccuggagagggcuuuguccauccugugguugaggacucccuggccaugacacccuuuugugcuuuaaagccaaugaaugacauuaucuuggccucuugucucacaaggaugga

SEQ ID NO: 16273 - RNA, 29055 nt, Homo sapiens
uguccgccgccguguccgcggcugcgccagacaguguagaaccugcggccucgauguccuucucccgugcccuauugugggcucggcucccggcggggcgccaggcuggccaccgggcagccaucugcucugcccuucguccccacuuugggcccuuucccgggguucuggggcaaguuucuguccuugccaccgccuccuccucugccuccgguggcuccaaaauaccaaacacguccuuguucgugccccugacugugaaaccucagggccccagcgccgacggcgacgucggggccgagcuaacccggccucuggacaagagugagugcgggaacuacugagggcggcagaggguggugucugcugggccgaggcugguugggaggaagcuacauccccuuccccuggggauccgaggucccaucgaguguugucaucgugccucucagugucugccuccuucgcuggugugugagccccucaaacggcuuaggacuguaucugauuaauucuuaacgccucgucccagaagcggccuuuucccuuuuacugcccugcucucugaaugguuuagacacucauguguugggaagauuugacuuuuuugaguuguuagguggacgcccgcucuuucuugcauucuuuguuucucucccacccccgaaugggauguggcagugaaaagccagcggagacuccuuuuaggauucuuuaucauugaggaggcgccgacucauaccacgcuguuaggcuguguggugguugccaagaggaaccagacucagauccagauccccucuuaagaaacguaacgguaucgugggggaggacacguguauggaaagugaacuguaauacaagguagaacaugacaaggucuagaacaagguaggguguccccggcuccagagagaaaagaagagguagcaucaguuaguggcagcgggcuuugcucagcaaaacuuaaguuuggauggauucguugacagagaggcaugugaauguuuucaaggugaguuucgggaugauuagggagguaagggaguuuccucugaccauaugaaacugggagauugaggaaaugcuauccagaauugucuccaggaauaggaggagaaaugucucacuucaacaagcgacauuggugccuccuauuguaaaucuaaaauauagacuacaauauguuuuucagagcagaaguacaguacuuucacuaaacaugugauggaacucacaguauauguuauucuuugacauauucuuccaguguuaagcaaggccuuucacuuuacuuggugcugggagacugucuuuauuuucugcuguuauaacauaauaccugagacugaguaauuuauaaacaauagagguguauuugacucaugguucugagccgggaucugaugagggccuuuggcugcaucaucacaugguggaagguggaaaggcaaaugagccugugagacagagaaagggggcugaacuuauccuuuuuuccugugauaacugacuccugugauaauggcauuaauccacucacaaaggcaaacuccucauguccuaaucaccucuuaaagguuccaccucucaacuguuaaaauagcaauuaaauuucaauaugagucuuggagaagacauucaaaccauagcagagaauguguuauuuuaauaauguaauuauacuauuauuuauuuuuaaauuauaaaaauacauaaaauuuacucuuuuaagcuuuuuuuuaguuuuuuuuucuuuacuuuuuuuuuuuuagagacagggucuugcucuguuacccaagcuggaguauagugguaugaucauagcucacuguaaccuccaacucccagacucaagcaauccuccuggcucagccuucuaaguagcuaggaauacaggcgugcaucaccaugccuggauaauuuuuuaauuuuuuguagagauggggucuugcuauguugcccaggcuggucucaaacuucugggcuccagggauccuccugccauggccucccaaagcccugagauuacagaccugagccacugcacccagccagucuuaauuguuuuuaagcacauaguucacuagcguuaaguauauugacauugucgcgaaauagaugagaacuuuuucaucuugcagaguugaaacucaaacaauaguuuacccauuaaagaacaauuuuccauuauuuuauauuauuugaaggcauaagguaauuuggaugagauaauuugccuuauuguauucaaauauugauaaauucuuauuuucugcagcuauuccaauucaccugaaaauguaaaugucuuugcugcuuccuguaagaagauagaauaaagacauggguuugucagcacuagauuuucuucugguggagaauccuuagauacuucauugggucugugugccaggugauuuuucaucuccuuugacugggauugguccagauguugaauuuacuagaaugauuuuucagcauggcaggaggggcuacagaagauggugcauuacuacacucugauauagccaugugguuaaggugucagauuuccacuuagcuuagcaaucaggacaagaagcugucacuucucaaucucuuuugccuacucauaacccaaaaaguugagguacuuaaaggcuuuguccugcgucaccuugcugccuuauucugugcugucuauggggugucucauucucucucuccccucacuaauucaguauuccucucagaucuuugucucuacccuggaccucucuccuucacccuggaccuauauaucucgcugccuaccaggugucuccacuugucuuucuuacacacaccucaccuuagcaugucaagacaacuuaccuuccccucagccugcuccugcaggugcucaggucaaaaccugguagucuuuguucuuccaucccucaccccuacaucuaacaaucagagaaagcccaguuaaugagucuuguugauucuaccucauaaauguuggauucauucauuucccucauucuccacugcaaccagcuuagucuaaauugccagcuuccaucuuuugacuggacugcacauauagccccuuaugugucuccucauaugccuuugaucccuucauucuauucucuaccugcagucagaauguucuuuuaaaaagacuaggcugggcgcagugucucgugccugcaaucccagcacuuugggaggcccaggaggguggaucgcuugagcccaggagcucaagacgagcuugggcaacauggcaaaacuccaucucuacaaaaaauacagaaauuagccaggcaugauggugugugccuguaguuccagcuacuugggaggcugaggugggaggguugcuugagcuuggguaguaguagagguugcagugagccgagauugcaccaccacacuccagccugggugacaagagugagacccugucucaaauaaaaaaagaaagauacaauuuuaauuuacauacuagaaagcucacccuuuaaaaguguauaauucacuggguuuuaguguauuugcaggauuguacaaucaucaccauaauuucauuuuagaacauuuuuaucacccuaaaaagaaaccugauaucuguuagcaagucacucucuaguuccccaguccccagugucuuuuuuuuuuuuuuagcuccagauaaccacuaauccacauucugucuguugauuugccuguuuuguguauuucauauuuauagugucauauaguauuggucuuuuguaacugguuucuuuuacuuagcauaaugagaaauuucacauuuuggaagcauuuuaauuugaguaaagcagcaugaaucuuauauaacaccguaguauuagucacagaaaauagguuaauucuaaauaaaugugaucugucuuuaguuuguaucgaguuuauaggucagcagaauuuucccaagcaaugauggcaugugccuuuuuccaaucuuuuauuugucauugguuuuucuacccuugauaccaagaaacuguuggccaggugcaguggcucacgccuguaaucccagcacuuugggaggcugaggcuggcagaucaccugaggucaggaguucgagaccggccugaccaacauggagaaacccugucucuacuaaaaauacaaaauuagucgggcauggugcauggugaugcaugccuguaaucccagcuacuugggaggcugaggcaggagaaucucuugagcccgaaaggcggagguugcagugagcugagaucgcgccauugcccuccagccugggcaacaagagugaaacacugucuccaagaaaaaaagaaacuguuguuccuacccggcacaaaguaacagagacccagaaaucugccugugaucugaaauauaaauacacacacacacacacacacacacacacacacacacuguguguguauguguaucucauauuuaauugugggcagaucuagugauucugaaauuuccucauucugucaaacaguuuuauuaguggaaugcuuuguucaggcuugauuucuucaaugaguguuguguguguuggacugugugaaaaugugguuggcacauuugugaaagguaaaaauacaggucacuuggccuuucugaauuucauggguaaaggcuguguccucauuguggcuucuccuccuagaaauacauagugugugacugagucaguaaaauguuuauugaauaaugcuguaguauuuuaacauauacaaccauaauacaaucucagcuugauuaguuuaaaauacuuuuaccucuaagauuauugauucauaguggcauguuaucucccaauagcauagacauuucucugccgucacccuugacagucaucuaacccuugcuugaguaauuccauuggcaaggagcucucacuuuucacuguucuaauuguuaggaaguucuuguauaaauuccacugaaaucugcucccacugacuuuaguuaugccaucuagcacaaaacaaguguaaucuuuuaucccugaaaucaucauccucaaacuuaacaucagcguggcuuccuuaagcaugaggaucugguccuugcuauauugguugucuuucuggauguguuuuagcugcucacuguuuggaugugcagaaucguuauaagugaaugacaguguggcucucuaccuauaaguggccuggugaaggcuugaggcugccucucaucccagagugcauugcucauuccucuaugguauaacagggugcugcauuauuugacucgaucauuuuucucuuuuuuuuuuuuuuugagacggagacucgcucugucuccuaggcuggagugcagugggcccaucucggcucacugcaagcuccgccucccggguucaugccauucuccugccucagccuccuggguagcugggacuacaggcgcccaauaacaggcccagcuaauuuuuguauuuuuaguagagacgggguuucaccauguuagccaggauggucucuaucuccugaccucgugauccgcccaccucagccucccaaagugcugggauuacaggcgugagccaccgugcccggccaacucgaucauuuuucuuaacacucccaucgcauaugaauucauaaagaaggaucgacuaaaaccuucuaguucuugcaacacucauuagacugcugccuuuaguguuauugcuucaaguuucuuuugcuuuuuuucagcauuuaucuaagauaaggaaacguuaaauuuugacaucucucuucuagaugaaguaaagaaggucuuagacaaauuuuacaagaggaaagaaauucagaaacugggugcugauuauggacuugaugguaaggcccaaaacaucuucauagagguauuuuauuaccucuuacgguacagcuuggucaggacuguacgaccccucaugugaccuggcuguuguagucuggagacacgucccugcucuuugcuucuggcugagugggagacuggcgaggcucaccuggugagccauacugcacggcagaggagcugcagcugcggccuuccuucaugcugugcuaggacuucaguuuuagcccagaucauaauaaaccagcuguacugccaaaaaaaaaaaaaaaaaaagaaaaaaaaagacucuuugaugaguuugguguggugugucugugugcuuuuuaaaaugagaacuacaccuuacaucuuuucauuuuguguuucuacagcucgucucuuccaccaagcuuucauaagcuuuagaaauuauauuaugcagucucauucccuggauguggacauucacauuguuuugaaugauauuugcuucggugcaggcaaguguuuagagacuuuuuaaaauccuauugaacauaccuucuauuucuucucauacuucaugcucauuucucuagaagggcuuauuugguuuagagugggucugguaacauccucuguaaauaauucagugcuuucacaggaugacuucuagguuguuugcuuuuauauugggucccugagcugguuauuacaucacccauaugucuuagacuggaggaagacuggggcccagugaaauaagcucucacacaaguuggaauuagugcauagcagauuccaucuguuuuugccacuggcuuccuucucccucauaucaggacaaaguucuugcuauaaaagaaaaaaaaaaagucaaaauaucauaguuucauucccacaggcaguuuggcuuugguuauguauuugacucuuagaccuguaccuugugcccagcacugaggauacaacgcagaaugggacaugccccagccuccucucagagccacuaagauguggagaauucuugcugaggaacaaacacauguuuuugccugucugugguuuucgaaguuuaaaaaauguuugcgccuucaucucuguaauguacaugucuagguucuuuauuuuuaauuuaacuuuugccaaugcuaaucuuugccuguuuguacuaaaggaguaggacguggugguugcuagccaauuuccugaaaauauaaauuaaaaggaaaaaguaagacaaaacaggaucccagaaaaggauaaggccuguaaccucaggacuuuucuacuuuuuuuuuucuuuucuuccuuuuuuuuuuuuuuuuuuuuuuuuugugacacggucucacucugucacccaggcucuggagugcaguggcucagucucagcucaguguguagccucaaccuccugggcucaagccauccuuccaggucagcuuuccaaaguggugggauuguugacgugagcuacugugcccagagaggacuuuucuuuuuacccuggcagugcccccgcaacuuagcuuguuaagaaaaaagauuucacuaaauuuaguuacgaauuuuauguagauugcacauguuaauacaguguuuuauuuuccagcucaugcggaugauuuauucccauuuuucuugagacaugccaaacaaauauuuccuguguuggacuguaaggaugaucuacguaaaaucagugacuuaagaauaccaccuaacugguuaguuucuccauuuguggauuugaaauuuucaguuucuaaucuuggaugauucguggucauuauuuuuuuuuauuguauucuagauaacaaauuauaaggagucuggauuagguuguuuuccuaaaauaaaaagaggcaguuaacucuuuuaggcaauucacugguaucuuaccuugauccggauugagugugguuuuagguuuuauuagggcagaucuagaauagcccugacuuaaggauguuguccuuaaguguaagcuauggccuuccugguguuuuagcugagcgccuggguguuaaugaguucuuuccaccauggcuggaacugcaacaucaccuagcacuugagacgucuuugagacuuuccacugaaacccuugguaggcugcucauuccuagacccugccgauucuuaccuuguacaugguuagcccagcccuuggccaggaauucgcagggaacccccacacagacuucugggcucuccuucuaugcacccuucucuuccacagucuauucuucacauuuuagcugcugaagcagcucugaacuuaaucucugcugcucgcuucagugggacugucauauucugcuuggguuccaccucccuaugccuugcuggggugcaguacggcucaucccaaguguucuuuucuuucaaggauugcaguccugcacugccuuguggcccauguccccacacauuuauugcauguauuuugccccacuuuguacuugauuuuuuuuguuuguuuuugagagagagucucacucugucacccaggcuggagugcaguggugcguucucggcucacugcaaccugcaccucacagguucaagugauucuccugccucagccuccugaguagcugggauuacaggcgugugcuaccacaccugguuaauuuuuguauuuuuaauagauacgggggcucaccauguuggccaggcuggucucgagcuccugaccucaagugauccuccugccuugaccucccaaagugcugggauuacaggcgugagccaccaugccucgccuguacuuguuuuuagugggagggcaagucuagugccaguuauuccacuauggccagagguagaagacucuguuauuauauuuguguauguuggaauucaggggccugggaauguuugccuuuagaguuauguguuuagagcugugggaaugaugugaacauaguauggaacugauagcagcuuaaauuuauuuuuaguaaccgcugagaaaaagagauuuguacaaugggaaaaauuuccaagacauuaauuugcauuuggguuuuucuguccucuaguuaguaaaugcuauucuuggaaaccagucauuauuuuaauguggauaugaaacccauuguuuaguuuuucaaagacuugaucuugugaacauuaagaggauauuucauuuggaauuuguuucauuugcugucuuugccaggauggauuuugagguuaauggauuaagcuguuuaccuacucauguuuuagguacccagaugcuagagccaugcagcggaagauaauauuucauucaggccccacaaacaguggaaagacuuaucacgcaauccagaaauacuucucagcaaagucuggaguguauuguggcccucuaaaauuacuggcacaugagaucuucgaaaagaguaaugcugcugucaguauauuaccaaauauuugcucauuuuuuucuuaauuuucuuuuuuggugggagugggaaaagauguuuguaguaauuuacuguuaacaagaaauuaccauauuucauugugucuaagaggcugucaauuguaagauguaccauuauuuuauauacaguuaagaaagaaaaagaugcuaccaacugacucugacaugcuaucaauucuuuuuuuuuuuuuuuuuugagauggagucucgcuuugucacccaggcuggagugcaguggugcgaucuuggcucacugcaagcuccgccucucggguucaugccauucucuugccucagccuccccaguagcugggacuacaggcgcccaccaccacgccuggcuaauuuuuuguauuuuuaguagagacgggguuucaccauguuagccaggauggucucaaucuccugaccucgugaucugcccgucucggccucccaaagugcugggauuacaggcgugagccaccgcacccagcucuaucaauucuuaagaugcaucuugauuucagagauacaaaaacaugaaaacaugugccaguacagugaaugaaauacaauauugaagaacauuuuacauauguagagaaaugcagaaaguaacauacaaauaagcuugaaccuauuacaccaccucaucauaucuuuacauuuuaucauacuugcuucacuuacuuuuuuaagaaauaaaauauuguugcuacucucaaaacucuguaguccuuugccccaucagaguuaagcacuacucuaugauauuuaauuuaccuuuuauagauuagaccucugaugcuaucagcuagagcuaaugauaaagacugaagcuaccuuuucaaaacugaaaggacugaagcccuguagucugaggcaucauuuucacuaaaugggcuacauuuugguucauuguuuuauuaugacuuuauaaugugaguuuaaccaguuuugguagguaauuugcauucucuuuuuuuuuuucugaacaguuugagcaauuuacauacauaauaccucuuuaucuguaaauacuugagaauauguuuccucagaacagacuuuuacguaaccacaggauauuugucugaagcaggacauuuaauauugauagauuacucuuacuuaauacacaaucuauauucaaauuuuaucaauuguccaauuacaccccauccuccaccccuccaggguucuuuucagggucuuacacuguauuuaguugucauaucucuaguuuccauuaaucuuggacaguuccucagucuuccuuugucuuucauaaccuguacauuuuggaagacuauaggucaguuguguugugaacugucucucaguuuggaugugucugguguuuccccaugauuagauucaggcuauuaugaugaccagccaucccaguuugccuggacuucuccagauuuagcaccaagaguccuccauucuggggaacccauuaguccuagacaaaccagaaugguugaucacccugauacagcauuaauguuggucccucucagggaauuauaauaggaggucuuuacauucuuaaauuguauuuauaauguucuucuugaauauagaaacaacucauuuuaaugaagucaaauaguucagagauguacaaaguuaaaaugugaaacugcugcagugucucaugcuuuuguuaccugaggauuuagcugauuugagauguuuccagguuuacccaaguuguguaagagaguggcucuuauuuuacuuuauuuuuuauaaaagggaaaaaagcauugggaauuuuuuuuuuuuuuuuuuugagacagucuugcucugucuccaggcuggagugcaguggcaugaucucggcucacugaaccuccaucucucaguucaagugauuccccugccucagccucccgaguagcugggaccacaggugugcaacaccacucccagcuacuuuuucuguuuuugguagagaugggauuucaucauguuggccaggauggucucuaucucuugaccuugugaucugcccaccucagccucccaaagugcugggauuacaggcaugagccaccgugucuggccgugggaacauuauguuuuaacugugaaacaaacuaauuuggugguaguggagagaacacccuguuaaauauccaaaacguauuuuugcauuauuuucaauaauucuaguuuuuuuucugucuuucuagggugugccaugugacuuggugacaggugaagagcgugugacaguucagccaaaugggaaacaggcuucacauguuucuuguacaguugagaugugcaguguuacaacuccuuguauguauaugcuguuuaagaaacuaugguuugguauuuuuaauuuuuuuuuuuuuucaagacagagucuugcucuguuguccaggcuggaaugcaaugguacuaucucggcucacugcgaccucugccuccccaguucaagcgauucuccugccucagccucccaaguagccgggauuacaggugcccgccaccacacccggcuaauuuuuguauuuuuacuagagacgggguuucuccauguuggucaggcuggucucaaacucccgaccucaggugaucugcccaccucggccucccaaaguacugggauuacaggcgugagccacugcgccugaccaugguauuuuuaauuuuaaaauacacuugaacaugugaaauacgauuuuuuugugugaagaaaaaauuuuaaaaucuagaaaaagaagagaauaaguaugacaaacgugcgauccugccaccacugacaaaugccugcaccugaaguucuuucccuuuuucucuuaaaagagcugaaauguuaauaagcauaauugaaauuuccuuuguaccacucuccaguuuaauuccucucuccucuuuuguucuaacugguaacagauauuugguguguauaguuuuccugucucuuuucaggauauauauuauaucacugauacguauuaccaguauucuagauuguuguguuuuaaaacauuuaugugauuauuguauuauuauuguucuaccacuugcuuguuuacuccacaaauguguuuagaucuaucuagucuuauugaaguaucuauagcuacauauuuguaguuauuucauuuaaacuguuuuauaguauuccaucuuagaacugaaauuauuuguuccccauuuguuaaaggauauuuagguuguuuaaaguuuuuuccuguuauguacacugccacaaugagcuucuauuuaaaguuguuuuguuuuguuuuugagucaggggcucacugugucacccaggcugaagugcaauggcgcagucauggcuuacugcagccucgaccuccugggcucaagcaauccuucugccuuagccuccugaguagcuacaacuacaggugugagccaccacacccagcuaauuuuuuauuaauaaauuuuuuguggagauggguucuugcuguguugcccggacuggucucuaauuccuggccuugugugguccucccaccuaggucucccaaagcagugggauuacagguauaacccaccgcaccuggccuuaacauuuaagugaaaauuaacuuuuuccuuauuauguaagcaaucauaucuucauuauugaaaauauaaaaauguaagcaagcaaacagaagaaaacaaauguacauaauuucccagucccaccuauccggaaucaauagguguuaauuaacccuauauauuuuccagacuuuguuaauauuuguguucauguuguguaugcauauaguuauaugugcaugguggguguguauauuaaacaaauaggaagguacuuuacuauuugguagcuugcuuuuuuucauuuuaauaaucaacuuugugagaagaauaguuuuuaaaaaaucaauacauuauaaaguaauauauuguacaguugcacagaaguuuauaaaucagaauuucuucucuaugucuucucuucuagucuuguuuguacauauccagaucacgaaguaguuuuuuuuuuuuuuuuuuugagacagggucucacuccugucguucaggugggagugcaguggcacgaugacagcuuauugcagucgugaccuccugggcucaaacaauccuccugccucacuuuuaaauuuuucuuuuguagagaagaggucucacuuuguugcccaggcuggccucgaacucccgggcucaagcaguccgccucgccucggccucccaaagugcugggauuacaggcaugagccaccauguccagccucaauaaguaauuuuuaaucugaugauuguucaauauaaaauuagcuuucuuuacuuuccuaagugucauuguauuuuuaaauguucucuuuucaauucuguaguauuuggggaagaaaguaaaauauaauauaugaauuacagggaauagaauaagguauuuggaagcauuuuagcuuuagaaaaugagaugagacacuacuuuuugccauagcgauggauuuaaaaccccuaaggaugagcaugacugaggcccaaggaauuauuccuuccacuucacuuucugcuccugagagcugccugguuuccugugguagagaugcuucauuaguaaaugaagggcugucaccuccuuguucuggaacuugccuucuucuuuuacuucuguccagaugugauaguucucaucagagaaauucuccaggcugucucuuagauugcaaaaaaacaggacaaguggaacugcucagugugggaggcagugugguagaguauguaagaguauggacuuggagcuggauguggugacuugugccuguuaauucuggcuacuuaagagauugagaugggaggauugcuugaggccaggaguucgagaccagccugaguaacauagcaagacccucaucucuaaagaaaaaaaaaccuuuuuuuuuuuugagcuggagucuugcuguguugcccaggcucgagugcaguagugcaaucuuggcucacugcaggcuccgccucccgggaucaaaugauucuccugccucagccuccagaguagcugggacuacaggcgcacgccaccaugcccggcuaauuuuuguaucuuuaguggagacgggguuucaccauauuggccaggauggucucgaucuccugacauugugauccacccgccucgaccucccaagaaaauguuuuuaaaauuagcuggucauggugcugcgugccuguagucccagcugcuuggaagcugaggcaggaggauugcuugagccuaggaguuugaaguuacagugagcuaugauugugccacuggacucaggcuguaugacagugagacacuguuaggaagaucacuuucaacccaggaguucaaggccauccugaacaacagugagacccuguaucuaaauuaaaaagaaaaaaaaaagaguauagacuuuggagcuagauggccuggguuugaauuucaucucugcauuuaacuguauaacuuaaggcaaguaacuuaauuucucugggccucugacuuuuucugucaaauggagauagugauaauacuuaaccucauagauuuguugugaggauuaaagaggagguacuuaagaggagguaaaacacuuagaacaaaccugcuggaaaagaggaacccaguaagugauggugguaguggugauggugaugcuugaauuuugguguuggaauuuguuuauaauacuauuuaaguagaugguauugcucauguuaacuuuuuuauuuuaagaugaaguggcuguaauugaugaaauucaaaugauuagagauccagccagaggaugggccuggaccagagcacuucuagguugguggucguaaugcuauaaaacccgugcuuuaugacaucugcgcugagaugcauuuuuaucugcuugccauugccaaccaaauagagucaccuagaaccuuucuuuuugacacaaaaaaguaaacuaaguaugaguuuuuauuuucuaaauauuauuuuaauaaugggaaaucuauuuuuuccugugcuaaaacuagcauaaccauguaauuaaaguuaaaauguucaaaucucauauuuacacaacuacaauuuauguuuugguguguuucaugcuagucuuuucuuuuuuguaugugcauaugguguuuugagaacauuaguuuuguaucuugcuguuuuucaugugacauuuuucauuauguauuaauaugaucgcauaucucuauugaagggcaauacuguaauuugcuccauagaguugaaccuuuuuuucccuauuacuaauaacgcugcaguaaaaaucuuuguggccaaagcuuuuuauuuuuugagacagggucuugcucugaugcccagguuggagugugauggcgcaguuguggcucacugcagccuugaccuccugggcucaagcaguccucccaucucagucucccgagcagcugggaccacagcuguuugccaacaugcccccugguuaacuuuuuaaauuuuuuguaaagacagagucucccuauguugcccaggcuggucuugaacuccuggguucaagcacucuucccaccucagccuccccaaaugcugggauuacaggcaugagccacuacacccagcuuauuuuuuaucuuuuuaauuauuucuuuaggauaggcuccuguaaguggaguucuugagguccauagacaugaaugaacauuucuacugcuugauguuggagugaauuuuugaucauguuuuagggcagauguuuucaaauuuaaaaacaaauagcugaacuuggcugggugcgguggcucacgccuguaaucccagcacuuugggaggccgaggcuggccgauugcuugaggcaaggaauucaagaccagcuuggccaacauggcgaaacccugucucuacuaaaaauauaaaaauuagccaggcgugguggcgcaugccuguaacccagcuacuccagaggcugaggcacaagaaucacuugagccuggaaaggagauauugcagugaaccacagugaaccgaggucaugccacugcacuccagccugggcgacagagcaagacucugucucauggaaaaaaaaaaaaaggcugaacucuuuuuuuaaacaaagaguauacauugaagccuguuauguaaaauacauggaaguggaucugcucggggauaaggagcuuggaguuucuucugcccuccaacccccaaccucugagguaccucagcgauuccauggagccuaauuugaaaaacacaaguauagggucuguguucaguacuuagcauccaaaugccagcuucuaauccuggcucauuucacucugauagaguugaaacuuuggccaaagcaauuuaaaaggccugagauuaauaaaaauuggauaaucuuugcccauuagaaguuggugauuauuucaagguuugcaucagagauaauauuuuugaaaauacuugguaagguuguaaagcaauauguaagccaacguaaaguacuuuggcuauguaaaauguuguauauuuaauuauaaaucuuuaaaauuaagaaacccaguuuugcauugacaggacugugugcugaagagguucauuuguguggagaaccugcugcuauugaccuggugauggagcuuauguacacaacgggggaggaaguggagguauucgauuagaugcuuuguucuccagguggcauaucaaauaguccagaguaccuaggcaguggcuucagaggcccuagauaaugccagcgucagaacuuaacuaaaaagaaagcuucauuuucuugugaucaacuagaccauauauauuugauugaaccucaugaucugaaguucugacagaguggucaucacacccuaagucuuccaagaguacaggaaauucuucacuucuugacaaaaccuuguggggcuugaguagaucucuucgaauuaaauaaaucaguacucuuagaaguuggagacccagcaaguuugucguuuucaaaguguuguaugucagauauuggggccuuugauacacaucuaauugccagacacaguuuauauuccuuuuugaaauucuuagaguuggaaguaacugguuuccuuuuaauccugcuucucuuuuucuuuaccagaguucuauaguaaaaugaauuauuauuauuauuauuauuuuuugagacaaggucucacucuguuacccaggcuggagugcuguggugcaaucacaacucacugcagucucagccuccuggacucaagugauccucccacuucagccucccaaauagcugggacuacagguguuugccaccaugcccaucuaauuuuuuauuuuuugagcagagggcaucucacuguguuaccaaggcuggucucgaacuccagugcucaagcaauucucccaccuuggccucccaaagugcugggauuauaagcauaagccaaggaaauaguuuugaauuagccuguuauuuuaguuuugugcucaguuuucaaggagagauaguggaauauaguggaagaaauuuuggaguccauucuguguuuugccauucuuagcuuugcauucuuuagacaagucacagaagguuagacuugcaaaaugugccucagacauuaauuuuuuauugggcucaguuuuacuauuuuauaaaauggaaauagcaguuaauaaccuuucugaacuuaacacauugccgugaaaaugaaauauaugagaaaaagcuuugaaaacaggugaaacacucuguuucaucuuauuaauuuagagaugccaaugagaagugaugguaacacuuauaauaucaaaauaaauguuuuucuguguuuucuuuugaaaaacauugguacuuaucaguuuuuagcuacucuuaacugcauuacaaucuuuucacuuaauuacuagucacaagaaguugaguugggugugucauuuugccauuucaugucuuuauuguagguucgagacuauaagaggcuuacccccauuucugugcuggaccaugcacuagaaucuuuagauaaccuucggccuggggacugcauugucuguuuuagcaagaaugauauuuauucugugagucggcagauugaaauucggggauuagaaucagcuguuauauauggcagucucccaccugguaauuauugacuuuccucgugacaagauaugaaaucuccuaucuuugcaauuuauguugagauauauauaaaaaaaugguaaacaauauugaauuaagcugcuugauguauugguaauuuguuaaacgucauauaaaauaaauaauuuucuauuucaucuuaguggaaauagaaguauuuuaauuauaguucuuguuaguugcugcuauuauuagacuguaucuuaaauguugaguuuauuauuuucuuacagaaaugucauugaaaucuggucuugaccauguccuuuuaaguuguaguccugaaaucuguguccucaggaauaaggcuaguguggugggggauuguguugcuauaugacggaguauuugaaggaauggauguaaaggauaaguggcucuuugaggauauaaagaaauaaaguuugaaacaguaaagguuuuaucauuaaaaaugggaagaacaggaggugaggguuuccaagauguacuuagcuugauguaauaaaagacugagaacacugauuuaacauaaauuguucuuguuuuagggaccaaacuugcucaagcaaaaaaguuuaaugaucccaaugacccaugcaaaaucuugguugcuacagaugcaauuggcaugggacuuaauuuguaaguaauuuguuuuuaauaagaugaauauuuggugaguuaaauggugguuuuuuuguuuuucaguuuucuaauuggcauuaaugaccaaacgcuaugauuugggagaauaaauauuauaggcuagauuugagguuugucuugccuacaccuauugagggaaauaaaaagaaaauauuaaauagugccaggacuuuucuuagggacagggucuugcucuuuuacccacgcuggagugcagugaucaaauuguagcucagugcagucuugaacuccugggcccaagugauccuccugccucagccuccagaguagcugggaccacaggugcacaccacaaagccugguuauuuucuuuuuuuuuggguagugacaaggucuuacccuguugcccaagcuagucucuaacuccuggccuccagugaucuucccaccucagccucccaaagugcuaggauuacaggcaugagccacuacacucggcccacacuaggacguuugaaugcugcccaccacuacugcuaaccuauuguacuacgucacuuuacuuucaguuucucagucagguguccgagugccuauuaugcacauggggcuaguuauuaucucuaaaugauaacaauguuaagccuaaauauuauuuauuuauguauuuauuuauuucugagacagagucucacucugugccccacgccggaguacaguggugugaucauggcucaccgcagcuucaaacuccugggcucaagcggucuuugugccucagccccccgaguacuagagcaacaggcacacaccacugaaccuagcugauguuuuuaauuuuuuguagagacuugggucuugcuauguugcccaggcugguuuugaacuccuggccucaaaacaauccuccugccucagccucccaaagugcugggauuaugggugugagccacugugccagacuuuccuuaauuuuguaaguggcagucaagguugcaagaggaccuaagcuaguauuggagugagcauuaugcaaugacccaaguauuggaggguuuuucauacagucugcaggaucacuuuuauuucuguuucaggagcauaaggagaauuauuuuuuacucccuuauaaagcccaguaucaaugaaaagggagagagagaacuagaaccaaucacaaccucucaagcccugcagauugcuggcagagcuggcagauucagcucacgguuuaaagaaggagagguuacaacaaugaaucaugaagaucucaguuuauuaaaggaaauuuugaagaggccuguggauccuauaaggguaagagguaacauguuaacuacugcuucucuguggaggagagucauucuuucccucacccaccauccagacucucaccucagacacauuucuggauacagacauaagugaaagaaaauuuugugccaugaaaacugcauuaaaaaaagcccuacuuuauugcuuuggagagccacagaguucuuugaucagagaaugguaugcaagugaagguccagauugacaaaguuuagugagccugauuugccuuuacuuccuuccggaaucuagcagcgggaaggaacagggagaaaagcaguuucuucagcugagcacacagagcuacauuaguggacugaaaaaugaccagaagccugaauauagacgaaaccuuguauugcuuggggcaaaaacagcccuaagcaauacaacuucauccagugaggagaagguuaaauuuugguuaauauuaguuaaugaguuagaauuguacauauuugaaacaaacuuucuaguaauagucaaaauuuaaaguucccuggaaaauucacuuacauggcuuaucucauuugugacacuagaugaaggggaguauagacaugagaucauacagggagaagcaugcagggagagaagcuuccaggggaaggcugugcuggaaucauuucuguaacuucucagcaguacaguuagguucgugguuggcuccugugaccucccugcuucccuccugggcaccucaugucuuggacucuucuucccucccuuaugacuaauuucucuugccucuuuucuucugucuuuuucauucacuuucucucucuguuucauacuucauuccuuauacuuuccuguggccauguccuaacgguguaauguguagcuaaagagaacucacuuccaguuuaaaaauguucucaugucuuucuagauguauauaucuauguuaguuuuauugccuugguuaaagugacuggguuuuucuuauucauuuuaauucaaugaggagaaaugagacauggaaaaugguuuuacccuggaaaacagguuuuucuuuccuuuuuuuuuuuuuuugagauaguguuucacucuguuacucaggcuucagugcuguggcaugaucacggcucacgguaaccccaaucuccugagcucaggagagccuugcaccucagccucuugagcagcugggacuucaggugcucaccaccaugcuuggcugauuuuuuaaaaauuuuuuguagagaugggaaucuccuuuuguugcccaggcugaucuugaacuacuguccucaaguaauccucccaccuuggccucccaaaguguugggauuacaggcaugagccacugcaccuggccguaaaaucuuuuuuuuuuuuuuagacggagucuugcucugucgccaggcuggagugcaguggcgcgaucucggcucacugcaagcucugccugcuggguucaagugauucucaugccucagccucccgaguagcugggauuacaggcacgcagcaccacacccagcuaauuuuugcauuuuuaguagagacgggguuucaccauguugggcaggauggucucaaucuccugaccucgugauccgcccaccuuggccucccaaagugcugggauuacaggcaugagccaccacacccagcccauaaaaucauuuuuuguacacugccagaucaucauagguuuuagaaauauaacuaaaauguaagcaaaagacuaauuucucaguggccauaaucugucauuuuuacuaaaucaucaacuuuucuaauugguaauaaaugguaaaaugauauuuuuucucuuuuacucaaauucuuggcauuuacuucauauggugagagcuuagccugaaugggacuuuaucgugcaauaacuuaagaaaauuuguccuuuuugaaaaaaaaaaaaucagcuuaugauuguuuuuucuuuuacuaaaaggcagcuggucuucauccaacugcugagcagauugaaauguuugccuaccaucucccugaugcaacacuguccaaucucauuguaaguggaaacucccuuucacaucuccccuaaaaauguugauaugucaggugauuacugguuaaccucaugagcaugaauggauagucugccuuugagaaguugcuauuuauaaaauuuauuuuacaagugaaaauuuuuucucaaaaucuuuugggacuuuagcccugaggaauuuccucucaguauuucagguggggaaggauaugagggagugauuaaagcaagccuuuauggaaguuuguucuggauuaaagagauugucuuuuauagacuugaguauguuauucauuguucauuuuaauucacuuaggcaguccaguaauuucugucuuuuuuuccccaaggauauuuuuguagacuuuucacaaguugaugggcaguauuuugucugcaauauggaugauuuuaaauuuucugcagaguugauccagcauauuccacuaagucugcgagugagguauguuuucugcacagcuccuaucaacaagaagcagccuuuuguguguucuucacuguuacagguaagccuuuaucuuuaagcuauuuugaguuccuucugguugaugcagguuccccaaacaguacuuuguuauucaaaauaaaauaauuacaagaguauucaguaauaugagagacuuuguaaaaacuuaaauagggguuaauaguagcaacaguguucaguuuucuuaaguguaaagcacugagccagggguuacugucuuguaugagcaccaugccaggguucuagccucuuuuaacucauuuggguagggaugcaaaucucugacuucugagaagcacaggauuccugggggccaggaaggacaguggacuauggagaaccauaaaucucuaccaaggccgggugcaguggcucacgccuguaaucccagcacuuugggaggccgaggcggguggaucacuugaggucaggaauucgagaccagccuggccaagcuggugaaacccugucucuacuaaaaauacaaaaauuauccgggcaugguggugggcaccuguaaucccagcuacucgggaggcugaggcaggagaaucacuuaaaccaaggaggcagagguugcagugagccaagaucgcaccauugcacuccagccugggugacagagcgagacucugucucaaaaaaaaaaaaaacaaaacucuaccaagguuuaucauaacaauacuuuuauuuaauuuaauuuuauuuauuuuauauuugaggcagggucuugcucuguugcccaggcuggagugcaauggugcaaucacagcucacugcaaccucaaccucccuggcucaagugauccugccaccucagccucccaaguagcugggacuacaggcaugugccaccaugcccagcuaauuuuugcauuuuuuguagagacagaucucucuauguuacccaggcuggucucgagcuccuggaggcaagugaucaucccaccucagccucccaaagugcugggauuacaggcaugagccaccuaguccagccuaauauuuuaauuauuaaaaauguuuuugaaaggauccaaauguccaacaagagggaaaagguuaacuacauuauggcauauccacuugauuggauauuaggaagacauugcaaugauaauuaugauuauaaugaagaaaucuacauaagugguuacacuauaacaguaagugagggaagcgguucagaacuguauguaccuuauaaacauaacauguucucucaccucccgcccuauuuccucugcuuugcaugcucuccccaccccacuaaacccaaaggccuccucuucucugaaucuuguccugacucacugagguucacugccauuuccucuguaggccugagcauucuacauaugagcuauauucuaaucaaaucuagcucuaaacuuauuuuuuaaauaacauaaauaguccagugcuguggcucaugccuguaaucccagcacuuugggaggcaggaaggauugcuuaagccuaggaguucgagaacaucuccagcaacauagcaagacucugcccuuuaaaaaaaaaauuacauaaauaauacauacauucucuuuauacaaaaugagaacauuacagauagcuuaaauguggcucccuccccaaucuuaguccucugaaauaacuacuuguguaaguuuguguguaucuuugcagacuguuuuucauugcguuugccuaugugcauguucauguggaaacacuagauuuguugugagggugcauuuccccauaaaaaauuaucuuuuuuuuuuuuuugagacagagucucacucugucgcugaggcuggaguacaguugugucaucucagcucacugcaaccucugccuccuggguucaagcgauucucgugccucagccuccugaguaucugggauuacaggcaugugccaugccuggcuaauuuuuguauauuuuguagaggcaggguuucgccauguuccccaggcuggucacgaacuccugagcucaagcaguccaccugccucagccucccaaagugcuaggauuacaggcaugagccauugugcccagcccuaucaacguuaucuuaaugaauuacucacaacuugccuuuucuuuuucucuuaauaauauguguuagagaucuuccauguccagauguuuaccuagaaaauauguuucuuagagcuggcauuugugaaaaacuuagcuagcauaagguugaaguuuauggaacagucuugaacugcuguaaacugaccugaguggaacucagucccauggccuuggcaccauucacaccauccuuuaaacagcuauucuagugaauagaagcucuuuacuaagguguagggagucucuggaacaugcaggucaacaguugcuuguuuucuuaagauaaggucucacuauguugcccaggcugcagugcaguggcacaaucauagcucacuguaaccccaaacuccugggcucaggcgauccuuccaccucagccuccugaguagcuaggacuacaggugugcgccaugaugcgugguguguuuucuuuuugagaugaagucucacucuguugcccaagcuggagugcagugguaugagcuuggcucacugcaaccuccgccucccagguucaggcgauucuccugucucagccucccgaguagcugggauuacaggugcccgccaccaugccuggcuaauuuuuuguauuuuuaguagagaugggguuucaccauguuggccaggcuggucucaaacuccugaccucaagugauccacccgccuuggccucccaaagugcagggauuacaggcaugagccaccacacccggccgcuccguguguuuucuguuuaaaaauuagaauaugaaaucuagaggcuuuuccuuuuuuccugaucuuugucauuacugaacuaugaaagagcucaaucacauuaaugacuuaggaugccccuuaggacugugauuuggaagcugugcuccauggagcuccuuuagggccagcugcuggauggauggauggauggauggauggaugggcgggcaucucucccugcucucucugcauagcuccuuacuuagcucuuuuauguauugggcuuccacuaguuguuuguggccaaaaaaaauagagccacugccuuuauaagauaacuugagaacucaugcuuggccuguccugccuagcagguaguguggucacauuucuacccuuuauggcuauccuacuuggcauuuauuaaacuuagcagaguggaccagacugaauuuaacaaaauuguggcauuauuuaacuacaauugaucuaaaacugcucuuccucucugaaguauuaaccuugcuuagguuaagcauuuagagauaauuuccccuaaucaggaaaugaaucauuugaaaucagcuugaaucuugaagcugaagauuuuauuuaaacucuugcuugaggggucuuacugugugguuguaugucuaucuucuguaguacaggugauguauaauauugccuaauucugggaugcaacaugguuuugaaagcacauuccccagcagugucuugugguucaagacagggcugugaugucucacguuaccagugaggaagcugaagcaaagaguguugacuuggccaaagccacacagcucgcaggaggcagauccaagauugacuucugaccagccuugcaccaggccaccucagaggguuucuauauaauaagggaggacagccaggugcgguggcucacgccuguaaucccagcacuuugggaggccgaggcggguggaucacaaggucgggaguuugagaccagccugaccaacaugaugaaaccccgucugcacuaaaaauacaaaaauuagcuggguguuguggcgggcgccuguaaucccagcuacucaggagguugaggcaggagaaucacuugaacccaggaggcggagguugcagugagccaagaucgugccauugcacuccagccuggguaacagagcgagacuccgucucaaaaaaauaaaaaauaagggaggacauuaacaagauagagaaacuuaagcucguauuugagguuauaggacuauuacauaugagauagaaauaggagucuucagguacugucuguccauagcuuuagaacaucacauauuccuaaauaagaguuaacagacuuaggcccuggaaaguuaguccuucuacagcuucuuuuuuuuuuuaacugcuccuuguggagcagggauacccuauagguagugugcccagaguagcccuugaacuucugcugcacauauuauuacccugguuuuagaaaaagaaggaaaucaucuuuuuuuguuuuuucuuucuccaaauggucucacugcuggagugcaguggcacgaucauggcgcacugcagccuugaccucccugggcucaguaauccuccaccucagcuuccugaggaguagauggaaucacaggcacacaccaccaugcccagcuaauucuuuguguuuuuuguauggaugggguuucuccauguugccccagcuggucucgaacuccugggcucaagugaucuacccgcuucagacucccagagugcugggauuauagacgugagccacuguaccuggccuuauaaaguauuaaauguucuuuaaaauguagaagaguauaaaggagaaaagaaaccaccugucuauugaaauacaaccacaauguuuuguuuugcuuucuuuuuuuucucuuucuaauuauagacuuaagggaauucugacacuucucugaaacccuuuuccucuuucucucucaguuugccaggcaguauagcaggaaugagccccugaccuuugcaugguuacgccgauacaucaaauggccuuuacuuccaccuaagaauauuaaagaccucauggaucuugaagcuguccacgaugucuuggaucuuuacuuguggcuaagguaccaacauuuuuccuuuaugugcucucauuuuucuaguaggacaaauuaaagguuuuaugaauuuguuuuucuauuucaaauuauggacauauuugcaagaugcucuauauuaugucuauuguccauaaaggcaauucaacugauggaaugguuucccauuccaaaaaugacuugaguucuugcaauucuaguuaagauggcuaggugagaaggaagguccacuggacuccugcuggucaaaggaugguccuuggaccaaaagcauugguaucaccugggagcuuguuagaacuaaggaguaucaggcccaugccugacuugaucagauucugcauuuuaacaagaucccugggugauucacuuguacauuaucauuugagaaguccuguucuaggccagugauucucaaaggaggggcaugucccucuccaggaguauaucagagucuauugagguauagugcugacccacccucaggaugacauauuccuccgauaugugggggcagaaaucaagguugagcaaaggcacugaagagaguuugcaaaaagaacauuuagaauuuaucaaugucaugauguaggugugccauugagaguuguccagugacugcgauaagagcuguugcuauaaugcuaaugugucuuuuucccagcuaccgauuuauggauauguuuccagaugccagccuuauucgagaucuccagaaagaacuagaugguauuauccaagauggugugcacaauaucacuaaauugauuaaaaugucugagacgcauaagcuguugaauuuggagggcuuuccaucagggagccagucacgauugucaggaaccuuaaagagccaagcuagaaggacacgcggcaccaaagcucuagggaguaaagcuacugagccacccagccccgaugcaggagagcugucccuugcuuccagauuggugcagcaaggacuccucacuccagacaugcugaaacagcuagaaaaagaguggaugacacaacaaacugaacacaacaaagaaaaaacagagucugggacucauccaaaagggacgagaagaaagaagaaggaaccugauucggacuaguuuucuguuccuguuuuuuuuuuuuuauuuaauuuugcaaauaaaaauuuauuuugaauccuuuuuccucauaugcauuuacucccuccucuaguauuguggcuaucugguacugggggauuuuugguguguguguguguuuguguguguguuuguuuguuuuuucuuuuuuugcacagaaaaaucucucuugaugacuaaacuuguuuuuuuuuuuuucaacauuuagaaaauacuaggauaucauggagguuuaau

SEQ ID NO: 16274 - RNA, 1010 nt, Homo sapiens
ccgauauuaaacauuuauauaaauccauccucacagggucaaucuggagauaaacucaccgcugcagggggcggggaaggaggugggaacacgcucauugacaacuucauuuccaugagaaugguugcuguggugauugcugcgucuucccauuggucauugccgagcguauugcgguucuccgggaggguuauauugguucccauuccacagcggccgcaacgugucgagagccguaaguaaagugucgcaaagcagaaggaaggcgggagucccgacugcaaacauugaggaaagccaggcaguagaggccgcuauggcgaacguuccgugggcagaggucugcgagaaauuccaggcggcgcucgcucugucgcggguggaacugcauaaaaauccggagaaggaaccauacaaguccaaauacagcgcccgggcgcuacuggaagaggucaaggcgcugcucggcccugcgccugaggacgaggaugagcggccugaggccgaggacggcccgggugccggugaccacgcccuggggcugccggcugaggugguggagcccgaggggcccgucgcccagcgagcggugaggcuggcagucaucgaguuccaccucggggugaaccacaucgacacggaggagcugucggcgggggaggagcaccuggugaaaugccugcggcugcugcgcagguaccggcucucgcacgacugcaucucucucugcauccaggcgcaggugagagcgagcccggccaggccggccccuguuggcaaauggcgagggauggggaggagccccugccaaggccaagggcagacguuguaaggcgcaauucguccccacguuuuuguagcucuggacugagucccaaagagcgucuguggucuucaaaaaagccagucuuauggacuuauugccuuguaacuagaucucccacagucggccguccccagacuccguguccacccucgucgcccacaccaauaucgcuugcugcugcuuc

SEQ ID NO: 16275 - RNA, 2010 nt, Homo sapiens
agcaccucacaaucaaaauuuaauguauuugucauauugaaaugcaggguuuuuugaaggaaacaugguagguaaacauuuuaguucccaacuccugaucguuaaaaugcaaaauugggccuggugugguggcucacgccuguaaucccagcacuuugggagaccaaggcggguggaucacgaggucaggaguucaagaccagccuggccuagauggugaaauccccgucucuacuaaaaauacaaaaauuagccgggcaugguggcagacgccuguaaccccagcuacuugguaggcugaggcagagaauugcuugaacccaggaggcggagguugcauugagccgagauugugccacuggacuccagccugggugacagagugagacuccaucucaaaaaaaaaaaaaaagcaaaauuguuggcaucucuaagacagagcaagacucccucucuaagagauaguagugucucccacuuaauugaauucguuuuguuuuguuugcuuugcuuugauucuugccacguaaaaucugugggucuugacccagagauuugcucagacaguuaagaaaaauaauaagauguauuuguaaauuuuuacauaaugaaaaaugagauguauuuguaaaauuuuaaaauaaccucuuuauaaauacguuuauaaauauaaagagguaggauguuuuggcuaauuagcacauucugggucauacacacacacacacaaacaggccaaacacucuagauagucaaauaaauuccccuuuuggugauucaguucaguaauggugauucaguucaguaacugccuauccucaucaaugcuuguuugugaugaugaaauaguugacaaccgggacuuuacaaaaauagcuccugaaaaaaauuaaauauuuuauugcaauauauguucauauuuuuuuuaacuuuuaugaaauaacauugugauaggugcuuuaagaaaaauauuuuuccagaagugguuuauaguauaaacuaagggcaguuuuuacauugugauguguggguggauggucauauuuaguuagguuauuaagaaaucaugaaguguucccuaacaagaaacuugcaaagcuauuuggcaggaagaaaaucauuaacuucuaguuuauuuauuuuuuuucucaugcuauacgcuuaauuaccaaguaaauucacuugcauaccauuaccuuaauucaaaggagaagccagaauguuuaucauuggugggaguaaaauauacacagauucuuuaccauggugaaauagaauaauacugaauucccaauacagaaauacuaauuucauaagcuaauauuccuaucuuuuagcugacuucuuucucucuucaggauauauuuacuauuuauuauuuaccuuugaauuuuugauuugggggauuuuuaccuauugccauccuacuaucuuaaguauccuguacaaugaaauaucuuagcaaggaaacacuuuuaaaacuucacaaauauccaauuucauucuuaacauaugggggaagcaguaaaagaaaaagcacuucaccacguagaagagaaagugaucauuuuaauuaagauaauuucaauucauuaucaacauuuaauccucugcaaacaagggaacacuuacuagcaguacuugaagacuugugaguuggaauugcauguuacuugaaagaucuaauuaagcuaaauuuuggugcacagcagguuguacaugauuucauguuuauguagcaaaaugcauugaaauguauuaguguugaaacauacauguaaagguaguuguggaaauuguuauauuuuccuugugugucauuuauuuagagcauaaagguuuuuuuuauucagccuaacugaauaaggcuaaaugaauacuguaauugaaaauauauuuuaaaucuuugucaugaguuuuuuuaaaaaaaacuauugcaaauuguaucauuccugauuacacagaacuuugugggugguuuuaaauaaauuuuauacuucuauuuugcac

SEQ ID NO: 16276 - RNA, 2992 nt, Homo sapiens
aagaacauuucaauaaaucucaauacauucuaugaaaacacacaaauuuaauuucugauggacauacugagucugacuuucugaacugcauuccagagcaauggaugacaucauuuucuaaagcuguuaagagguagcucaacauggagcauaauuugauuuggauaaauccagacuccuucagcaauuacguauugauuacauucacuugguugagugugccacacaacugguguucaauauacuuaugggcaaguuuagaagcuaugugcaauaaaauaguauuccaauacauguagacagcuacaucaaaauaaacuaugcuggggcuuaauugugaggcuaacuaggcaaagggcaugaaugaacuuuguaagcauggcuagguaguauauacaguggaaauacacuuuccuuaauuauuucaaucauccaugccuuuauaacuucuuguauaugcuuaacacuaguuccaggggaauugaaagccuauacuuuauaagcaucugauacuuguuuauuucccagugauaaaauacccuuuggguaagaaaaucaaguuucccuacaguucucaacacaaaguggccuucaucuauuuaaauucuaauuacaaucuagcauuaagaucugcucucugggccccagugauugagcucugugauuucucaggugucuuccauugcuaugagaggccacuacuauaugaacuuauuucaaaauucucuugucauaaaucucuauaaaagaucaaaacucacaguuguauuaaaucuagauaaaaaagauuuccaugcaucaaggugugaaauugaagguaguagcuauaaaucuauuaaaguuugcauacagcuacugauuuaguuggcacaugcgaaggaaaugcugugccccugucaguggaaguuucgugcaauaaaguccuaugucccagauaaaaagucaauauaauuuuuguuuuaaaaacugguucaggguuauuuucacacacgcuauugugaaauguuaucaguagaaauccacuguaauaauguuagaaaguagguuagucaugugaauuaaaucaguagcuuauuuacacaaggguaugcauucaauuaaauauguauugaguuuaugucuuaaguaaauuacuuauggaucucaucuaguugaaguucuauauuuaauaaaugaaauuaucaacaugcagacugaguaacaaagauguuggaaaguuauuuaagauguaaacauguugcaauaauuugccuacagcuaugccuuuucagauagccucacuuuccaauaagaauguauuucaauuauguuuaugaccuggucuauuugguacuuuguagaugaauuggaaacaagagguaggugagacagacaagcacaagaaaaaaaagaaauuucaacaauggcugaagagccauuagaaauggaauuucaggccagguggaguggcucaugccuaucauccuugcacuuuaggaggcugaagcaggaggaucucuuggggccaagaguuugagaccagccugggcaacauagugagacagucucuacaaaaaaaaaaaaaaaaagaagaaaaaagaaaaaagaaauggaauaucaagggcagcaugauauuuuguacgauucugcaauaggcaggaauuauucucucauuaaaauugguaaguuuguagcauauuaugaacugagugggcuauuaggaggucauguaucagugaauucaaugaucauacuaugaacaaacgcagauuuaaaacccaauuuaaguguuauaagagagguauaagaaaaggugaucauuacaguaaaacauaauagagggguagaaauaauguuagaugaccaguuuuaugagagaaaaugucauuucaaacaaauuuauuuccuugcuucaugagaaagagcauucuaaaagcaguguagccagcauacaaucacaaugcugcagaacauugaauaagcuuuuaaaaaaaaucacagggcagagaaugggaugguaaauuguuaaaaucaggaaagagaguccaacaaaguaggaauccaauuugguucccacagugggguaaucagcuuaagaaguccauucaugauguuaacuacaacaacggaauggaaacauuucaguugauacuauauauuuucaaauacuuguuuugguaaacugcaacaagcgucacaaaucccaauaguuccaaaaauuaacauugauguuucaaguuuagauuguuaagaaaccuauugagagagagaucaauuugaauuacugcauacauuaccauggauuauacugaagauaauuugcuacuucuuuuaaaaauauuucugaggguaguuuuuauucuucaaguuuacuaugucauagguggugauccaaagaaaaauaaaagugauacuuagauuuugcaggcauucaauaaguguagacucgaagaaugaguagaugaguggaugcauaaagagccauaaaacuuuauccauuaaaucuggugaagaaauaauuucuagugggagcuaaggccuaaaaucuaaaacauaaucucgcaaggguguauuccugauagucuaauacuaguaaauaucuuguugaagcagcugaagcaauaaacaaucacuuauuuauauacuuauauguauauaagaaaccuuaggcucacaaaaauauacaugucuuaaaacggaaaucuaaggcacacaaaauacuaaaacaagucaaugaauuacccuauuuuacauauucaacaagcagaaaucuacuuguacacgauggucuaucaauggacauuuuguuuuuuacaaucccuucauauuccuuuacuuggauuagucaaaagcucaaaacagauacuuugcaccagauauuauuuuaauaaguuacaaugaguuuuucuuuagagagccugcuggaacuguuugcuuuugcaccaaaauuguaaguguuagcgguugugggcuuccuauggcauuuccaagggagaagcaccauuagguuuuc

SEQ ID NO: 16277 - RNA, 3216 nt, Homo sapiens
cugagaaagccacaaacucaauuugaucuacagaacacacagcuccacauacucccuuccugagccuuuuccugggccaucuccuucacuaauuccuguaauggcccagacacaccccacucaucgcuucuuccccugcucucucuaggaguaagcaaagauguuugaaacaauagaggcaggccuauaacucuaggaagaugaagaaggguggucucagcccucuugagaaggcccccaucuucucagcucugaauaggacagagggaguucauucacucauaacauauucaagcaaccacguguuccaggcagacaaaagaggcauagccucagccuuccaggagcucaguacuuaggagaauaauuagacucgccaaggaaaaugaauagccaccuugcucucuccaaaucagggucacagacuccuccuuggaugaucagggcagugcagccuccauuggcugccaucauuuuucucugccucuaagcaauacauuaaucacuaggggacuugguuccaaaguaauuuguuugauucaauccugugacuagcaauagcaguaaggaaccuuggucaucauccagucucaacccaucacauuauaaauaaccucucugggccaaaguuauacagcuauuuuauucaacaaacacuuauugggcaguuacuguaucugugucuguacagucucuguauguugggggaggcagaggugaaggcuguuugggguggaggaucuuuaagggugaaggaauuuuaaaaccuuucauuuucacaugggugauacaugacauuguauuacauuuucaaggggauaguacauaugagaaggaacacuagcuucgaauuaggcaaauaaaaaagaaauugguaaagagcuguccuaccaugcauuucuuucuuccccagaugcugggaccaguagcugcugagaacagcgugugcagacccucaaaagaagugaaaaguuaggagacaauccccaagaaaacagaggcgauuuugugguaaauuucuaagcaauuacaaucaauuauccaguuugaauaaacucuagaucaccuaaaucauuauguuggccaggccacagcaggguguagaauuaugaaaggagauaaaaaggaagacauagaauuuauggauaaacucggccaaauuauguaucaaauaugucuuacacuuucuuuucuuuccuuuuuucuuuuuauuuuauuuuauuuuuauuuuuauuuuuuugagacacagucuugcucuguuguccagcugggagugcagugacacaaucauggcucacugcagucuugacaucccguucucaagccauccuccuaccucagccccccgcaaguagcuggaacuacaggugcaugucaccaugccuggcuaauuuuuguauuuuuuguagagaugggguuucaccauguugcccagccuggucucgaacuccugaucucaagagauccaccugccucagccucccaaagugcugggauuacagguaugagccacggugacugguccuuacagucuccuaaggcugaauuagacugcagguuuuaauucuugucuugucuaccagcucauucuuagcccuugguaggagaaucaaggccuuugaauaauucuuuuuuuuuuuuuuuuuuuugagacggagucucgcucugucgcccaggcuggagugcaguggcacaaucucggcucacuacaaccucugccucccggguuaaagugauucuccugucucagccuccugaguagcugggauuacaggcaugagccaccaggcccagcuaauuuuuguauuuuuaguguagacaggguuuuacuauguuggccaggcuggucuugaacuccugacuucaagugaugcacccauuucagccucucaaagggcugggauuacaggcaugagccacugcgcccagccuugcauaagucuuucuacaucuuuccagggaaaguaucuccuucuucccagagugcauaugcaaagaaagguggaaacucugaaaaaaggcuaaauuuucuuuucuuuuaacuauuauuuuuaaauuuuucuguagagacguggucucccuauguugcuuaggcuggucugaaacuccuggccucaugcaacccucccaccucggucucccaaagugcugggauuauaggcaugagccacugcaccuggccaaaaggcaaacucuuccaccaagcuaacauuccugagcuuuuggcaccaaaagaacuucuuuuuuagugagguauuuuuucacguuuguacucuagauuuagaucagagauuggauuuuaaaaugaaauaacaaaauauacagcaauaacugacagaaaaauauuuugcgaagaaaaagauggggaggaaaagccucucguuugggaaaaccuaugaaguguuauggggugggcgucccagcacuuugggaggccgaggcagguggaucaccugaggcuaggaguucaagaccagccuggccaacauggcaaaacccugucucuacuuaaaauacaaaaaauuagccuggcaugguggcaguugccuguaaucccagcuacucggaaggcugaggcaggagaaucucuugaacuugggagauagagguugcagggagcugagaacgugccauugcacuccagccugggcaaaaaaaaaaaaaaaaaaguguuaugggauguucaaguaaggcaaccaaccauccugccugguuugccugagacuguucugguuuuagcacugaaaguucugagcccugagaaacccuucagucccaagcaaacucagauguugguuaucaaaguccaaaggccuuuauacucuagaaaagcauuacggggaaaaacaaacaaacaaacaaacaaacaaacuugcacucugugccaauuaaaaucuuugugaagcagcugugcuugugcaaucugcuuggaacuuuucuuccauggggaagcugcacucuggauaugguugggcauuuuccugagucuuaaaagugcuuguuugcugaguuuugaauuucacguguuuuguuacucagagaguaacugagccauccaggcccugccaucugaccagaacaggagcccugaagggucugcccagccuccuguggccccuucaccaucccacccaccauccucccacaucaagcauucucguccuuugcagugcagcccacuguucccaaagagagggagaguaggagucaugacau

SEQ ID NO: 16278 - RNA, 1751 nt, Homo sapiens
gaaguuaaggcuggccuaggagauccagacuucguuuuuaugaaucagggacugcagccaauguguaauuuucucugauagaaugagacccugcaauucaagccuaucuuucagggagaguguagaaagugaugguagccaacacuguacaaggaaacugaacuggugguggugguaguagaguagcuucagccauugccaucaacacaucucacauccucagacuggcuccaguugaggccaugggauaaaauaacucuucaccagucuuuauguucauaauugugauguuucaucugcuacuuuaaaaucuccuugggaaaagagagaguaaaauaauaaaaagacuagcuagcauccaugagcacaaagacaaccaaaccaaaaaacaaagugauuuucuucauuaaaaggcuuugugcacgccgaagcauucucaaaaacaguugacaucuucuucguuugucuucgcaaacuccaacuuucuguauuuggcuuuucccucuuaaagcaacgcaaagcggcacacugcgcaggcgccuguggccagccacccccccccccccccccccggaagauucggcgcaggcgccggugccggggccgggaagugggcgggcucgcgcgcgugcucugcgguucacuuccggccagccccucccccgccucccucgcguggccaccucccccucugccuucuccuacccagucucuuccccaacucuccccaccccuggugcucuccgccccgcuugccucccguucuuccccgcccgcuccauccgggucgcugacggcugucucuggacuggacagcaguggcguccgcuuuucucuaaggaacccgguaaaguuucccaggggccggggaggggagcagcggagcagcggcacagacgccggaggugcccuggugaucgucgccacuggcugacagaggagggucccaggagccggagacgugcuucagcgaccgcgcugccuugcucucugggcaggggccgccccccgucaccuugggcuuccccuacccugaagggcuugggcgaguuguggccccagcggguucgggggcgugugacggcguuagggaggggcaggccgggcugggcggaugcaggccggcccggcauagggcgcuuucuccgcgcuuccugggggugaggggcguggggcgagggcagggcuguggcucccuggccccggggcuggaaugucucaucugccuggggaugggcuucucucagguugaggccgcgcacugccaagccucggccgccggccucugaagcuguugcgagcggccgguugcgguagucgucugcuuggcugcgagguugggugugugcagaugauuucucuuucccaguccccaugagcugaucugggugcacguucagggaaagacgggacuaaacugcuucucauuucccuaccuguugcuggcgagaggacgccucuguguuuuaaagaaaagggugguuaaaccucgcgcgcugaagucgggguauuuuccuguauuacucuuauuuuguuuuuaaauaugggaagacaaugcagaacucuugggaauuaucgaguucugauaccccaaaagaaugaaaucaaacuucuguuaaugggaugaugggucguggaaugggacaccuugggcacuugcuaacaggaacauaggaaaauuggaguugaaacuucgcaggcucuguaagaauguggaugacugcuacagaauaaggcugacuuccuguaau

SEQ ID NO: 16279 - RNA, 1751 nt, Homo sapiens
auuacaggaagucagccuuauucuguagcagucauccacauucuuacagagccugcgaaguuucaacuccaauuuuccuauguuccuguuagcaagugcccaaggugucccauuccacgacccaucaucccauuaacagaaguuugauuucauucuuuugggguaucagaacucgauaauucccaagaguucugcauugucuucccauauuuaaaaacaaaauaagaguaauacaggaaaauaccccgacuucagcgcgcgagguuuaaccacccuuuucuuuaaaacacagaggcguccucucgccagcaacagguagggaaaugagaagcaguuuagucccgucuuucccugaacgugcacccagaucagcucauggggacugggaaagagaaaucaucugcacacacccaaccucgcagccaagcagacgacuaccgcaaccggccgcucgcaacagcuucagaggccggcggccgaggcuuggcagugcgcggccucaaccugagagaagcccauccccaggcagaugagacauuccagccccggggccagggagccacagcccugcccucgccccacgccccucacccccaggaagcgcggagaaagcgcccuaugccgggccggccugcauccgcccagcccggccugccccucccuaacgccgucacacgcccccgaacccgcuggggccacaacucgcccaagcccuucaggguaggggaagcccaaggugacggggggcggccccugcccagagagcaaggcagcgcggucgcugaagcacgucuccggcuccugggacccuccucugucagccaguggcgacgaucaccagggcaccuccggcgucugugccgcugcuccgcugcuccccuccccggccccugggaaacuuuaccggguuccuuagagaaaagcggacgccacugcuguccaguccagagacagccgucagcgacccggauggagcgggcggggaagaacgggaggcaagcggggcggagagcaccagggguggggagaguuggggaagagacuggguaggagaaggcagagggggagguggccacgcgagggaggcgggggaggggcuggccggaagugaaccgcagagcacgcgcgcgagcccgcccacuucccggccccggcaccggcgccugcgccgaaucuuccggggggggggggggggggguggcuggccacaggcgccugcgcagugugccgcuuugcguugcuuuaagagggaaaagccaaauacagaaaguuggaguuugcgaagacaaacgaagaagaugucaacuguuuuugagaaugcuucggcgugcacaaagccuuuuaaugaagaaaaucacuuuguuuuuugguuugguugucuuugugcucauggaugcuagcuagucuuuuuauuauuuuacucucucuuuucccaaggagauuuuaaaguagcagaugaaacaucacaauuaugaacauaaagacuggugaagaguuauuuuaucccauggccucaacuggagccagucugaggaugugagauguguugauggcaauggcugaagcuacucuacuaccaccaccaccaguucaguuuccuuguacaguguuggcuaccaucacuuucuacacucucccugaaagauaggcuugaauugcagggucucauucuaucagagaaaauuacacauuggcugcagucccugauucauaaaaacgaagucuggaucuccuaggccagccuuaacuuc

SEQ ID NO: 16280 - RNA, 5483 nt, Homo sapiens
uuuugucuuaacacagcuacagaaagaucuagaagagguaaagguguugcuggaaaaggcuacuaggaaaagaguacgugaugcccuuacagcugaaaaauccaagauugagacagaaaucaagaacaagaugcaacagaaaucacagaagaaagcagaacuucuugauaaugaaaaaccagcugcugugguugcucccauuacaacgggcuauacggugaaaaucaguaauuaugguaugacuugcuucccuauagccaguucugccuccgagcaaccuauuccucauaguggucuaacaaauucauccccaaugaguuuugagucuguguuuuuggugguuuggagcaagacccaucaguuuuuauuuaauaaaacuuuuuuaagauauaaauaggaaaggaugcguucuagaagcuguuaacaagaguaaggugauucacuacaaaauguaacaacaaggaaggaacuuauucugaaauuguucaguauaagacacagcuuuggugguggugguggugguggugguuuuuaaucauguuuuauguuucacucugccaaccaccacaauuaacugaggagaggaauccaguuaaauucaggaaauauuuuugagcaccuaauguguaucacuauugugcuuugacuuacggauacacaacagugacuaagacccaguccuugcucauguugugguugggacauugacguauaacucguaguauaacaauguaguaauacuguuuuccuucaaugguguauacaguuuuuuguuuuggcggcagcgcaacuugaauaugaaugaugagcucucauuggagcaaggacagucuuguuuuucuuugugcuaauaaugucuagcacauaauagguaacauagcugaagaaauaauucuggaggugaggaacagggagaauuagagagauuugagugugaagggugagucguacauucagcaagucaaaaaggaggggaacagcaugagcagagaaugugaauagagaguuggaaggcaugaucuauuuugaauauuguuaauagugaaaagcauguguaugucgugcuuaagagauguacuauauaguaauauaggaaauugcaccguguacucaguugaguauaggaaacuggucugaagguguugaggauuaugguauuuuaaccaggaacauagauuuguguugagggagaaacuugucaauccggaggauggacugacugaaugggaagaaacuauuaauaaaugaaguucucuggaccccacuagggcauuuuuucaucaacacuguuucuuuuuaauuuucgaggguacauaguagguguauauauuuaugggguacaugagauguuugauauaggcaugcaaugugaaaaacgucauggaggauggggcauguuucuauucuauaggacuaagugagcaauagucagggauauguauguauauauucuugauaaacagaagaugcuuuuuugugaaguuuuuuauuuucuacaaaugugaugguauuuugugaaguauuuauauauaugucuuuuauguugacagaguucuucuaggucagagacgugcugguaguuugauaauacauacugaaauggcauuuaacagauaccaguagguuugucagauuuggaugaagaauuggagucuuuuacauucuacuuugcccuggaaaggaauuaagagagcuaggauuccauuuguuugacuacuuacagaaguagaaaugguuauggaauuaguauugauacuuagccauccagcuuaguggagaacuaccaauauuuagaugucggacaaaauuguuuccauaaaagcuguaaaugaacuaaucuuaaagaauguauuuagugaucauauuuuuauucugagggauaaaaagagcauagguuuuguauucagaaaccuggauuugaaucugaauucuaccacuuguuagaugccuagcuuuggguagaguacuuaacugcuuugaggcuccauuucucaaccuagaaaauuucuuauauuucaaauuuuuucauguuuauaugacuggauuuucauaauuuuacuuuccugacuuaugagccaugugcauuugcuguucuaaagauaguuucagaggcuuacuuacgucccaucuuuuguugucguugccaggaugggaucagucagauaaguuugugaaaaucuacauuaccuuaacuggaguucaucaaguucccacugagaaugugcaggugcauuucacagagaggugaguucucauuauaaugggaaagacagugaauuaacagucaacauugccuuaucuugagacucucuucuuugcaguuuuuaaaauucuuaaauuuagaauuaauuauccuuuacaacuacuuugaagaggugagcguuaacuggccaaaugcacacccugaaauaaagccagcagcuuuuuucccacaagaacuauggaguaaggguaccuuucauagaacuagaaagaugauguauucaccauuguguugcaggucauuugaucuuuugguaaagaaucuaaaugggaagaguuacuccaugauugugaacaaucucuugaaacccaucucuguggaaggcaguucaaaaaaagugagugugcuuuuuuugauuguaauauugugaaaccuuaccaaauugaaccuggcugauuuagaacugagaugaacuggaaugaauuuguccucuguaacagggaccaccgccuguuuugugaauguuuuauugggacauagccaggcuuauuuguucauguguuguuuguggaugcuuuugugcuacaauggcagaguuaaguggcuacagcagaccauauggcccuaaaugaaaccuaaaauauuuacuaugcggcccucgacagagaacauuugccaacuccuuuuguagaauaggcuauuguaagaauauuccauuaaaaucagggaggaaguaaacguuugaagguaguuaagagugagacuugaguuuuaugccagguuuacagcuuauuguuugugaccuuuggcagcuuaaucacucugugccucaguuucugcauuuaugcgauaguaauaauuuauuucacaaaguugaaaugauacacugaagugcaauaccauuauguaaagugcuuaaauuaaugcuaguguuagcauugugcauaauacucguauacauaaaaggaggucuuaagcacuuagccuccuuggaguuagaagcagcuauaaaaauaaggaaacugucuuuuaaaaacuacucuuuguaauuuuuacuaaaucagauagucccuguuuucugccuaaugugaauaaaugaaguuuaaugcguuagguauauagacaugacauucugccaucuguuuuuauaauacauaauuacuuaacagcuuacaggugauacucaaauauaguuggauucgcugucuuacugcacccuucugcauccgcuagucccauagguagaguaccaaaagaucccuaguauugaucauuguuuaaaagaccuguacauugcccuucuuucucacuuucaaaugccucaccuugccccauacugccuuauacgacuugguuucuugccuauccccgaccccucuuauuauauuacugucuuuuucagucacuaaaauccagccacuccuccugcuccucaaacacaccaagaugaucccaucuuggagccauucugcaugcucugccaacugccuucuccugaccuuaggcuucggcucagauuugccucagagaggccuuccuaaugaaguuccugcccccaccccccauuaacacccgcuuugucuugauagcacuuuccaggauaucaggguauucaaguuuuacuuauuuauggucuuuucacaccaugaauguucagauuuuggccuauucauacaaguauuacuggcacccaaaauaagucuauacauacuagggacuugaucaauugaauagauaauuguuuuauaaauauucaugcuuaucuccaugucuucuaagcuguauuuguuuuccugcuuuucuuccaggucaagacugauacaguucuuauauuguguagaaagaaaguggaaaacacaaggugggauuaccugacccagguugaaaaggagugcaaagaaaaagagugagucuacuuccauuuuuuuaaagaauuuuaguguauuguuugagaucauggauuuuuaauaguuugucuuuauggauaauguauuucugcuuucaacugucaaacuaccugaagagggcacguccagcaaguugcuuuuuaaggucuuuguaguuaaggguuggcucuuuagugugguucuuaacccuaggcgcaguugugcuucuauacaaauaacugugcccauucccagauacucuguuucgguaguuugagaggggcuuagguaccccuguauguuuuaaauuucucagaugcuucugaugcguaguuuucauugucacugguuuauagugaaaaagauaaaauauuuuuauccuucuuaauaaugaccuuuuaaaaauguguauucaaugauacuugcguucuaggucaguucaucuucuaaagguacugacuaaauuaauucaagacccaggcccagaucuguguaucucaggcuuaagaggagaguuuuucuaauuaaaaaauacaugagcuucaggguacauccauguguaauguuuaugauuuucccucaaguguuuuuuuucaaauuaugaggaaacaugcuuuuaaaaaaugaaaacaaguuagaaaaucaaauucuuauuuuaccugucaaaaaucacaggaggccaggugggguggcucacgccuguaauccuagcacuuugggaggcugaggcgggcggaucaccugaggucaggaguuugagaccagccuggccaacauggugaaacucugucucuacuaaaaauacaaaaauuagccgggcaugguggcaugugccuguaaucccagcuacucgggaggcugaggcagacagaauuguuugaaccugggaggcggagguugcagugaaccgagaugcgccacugcacuccagccugggcaacagagcaggacugucucaaaaaaaaaaaaaaaaaaaaaaucaugggaaaucccugugccuaaaaauagccccuaacuauuuugaugaccucuuucgugcaccaagugugugcaugcuugauacguguguguuguuuucauuaagaugaauuugugcgugccguuuugauuguaaauaucuuuggguacucugucuuccuucuuaucccucuacuuccugccaguguuaacaaccugaaugauaguaucuuccggugcuuucguuuccccauuguuguauauguuuucuuuuuaaaggaagcccuccuaugacacugaaacagauccuagugagggauugaugaauguucuaaagaaaauuuaugaagauggagacgaugauaugaagcgaaccauuaauaaagccuggguggaaucaagagagaagcaagccaaaggagacacggaauuuugag

SEQ ID NO: 16281 - RNA, 817 nt, Homo sapiens
uuuuuuuuuuuuuuugcgaaucugaucuuauuuguuacucaaaaaaucuuauuucugacuggauucagacuuagaaguggaagcucgcagagaggacagucugcgucucuucacgauuugucccuggugcuucuuagccuccuucauucucuuggccaaaaguuuagcauauucugcagccucuucuuuauuuuucuuaauaugcggcugcuucagagcaauacgccgcuguuugugcugcaggacauguggagugacaaggcgcugaaucuugggugcuuugguccuagguuucuuaccuucuuuguuuaagggcuuuuuuacaacauacuggcagacaucauuuucuuuagagagacugaaaaguuuacggauucugcuagcuguacugggccccaggugacgaggcaucauagucucagucaguccaggaauacccuucucuccuuuuuuuuacaauaaccaaguugagaacacucagauuggcauccacgaugcaaccaugaacugaucuucucuuucuuucuccaguucuccuuggucuguaauaggaaugccccuuacucaguagcaaguggacacggccaugggucaagacacccuguuucaaggggaaaccuuguuuauuguucccaccacugauuccgaccacguaacccuuccauucuucacccagagcgucaacagcaacuucuguggccauacgcuucucauaaaaaguacaaaguuugcguucaucguccacuucaaugaguuucuggcagccaguggcugggaaggagauguucagcuucaucuugaagcagcugaacaccuc

SEQ ID NO: 16282 - RNA, 3249 nt, Homo sapiens
uagaagaggaaacugaggucccagaggcugagugacuuguaucacaucacacagugaauuuacagaaaaucccagcuuaaagcccaagucucuuaacugcuggcuccuaucacuguaauaacagaaaugggaaaaagaaacaacuagagagaaaggaaggagaguggggacacaaucucccuucccccucucccaggcuguggcaggcagccaacuggagcuuucugcauauuuaauuuaaaucuuugucugcccuggcaaggacaaaguacaaucuguuuuauguaaaaagucuucccugaggaaagccucggccuccagcugcgaaacugauugauguucuucaaguccccaggaagcucugcugggauccgagguugcgguuuccaaaaaaagagucugugaaaaggaagcacugaaaacaacaacaacaaaauuuccuuuauuguguuucucucaaccugggagaauuagacuaaaacaaggagggggguguugggacaugcaaauacagacuguauuuuaaaagcagauuucagagucccagaugggagggguuugggauggcaagcugcugccagagggagacuggagucuugucuagaagcuuuauuugcauagcaagcacuuugcuuuuacuuagauugccuguuccaaucaauaaagcuacuaaaauguucugaagaugcuuuauccacacuugaggaaagacugaaagcaucaauauccaauagugucacuagugauguuuuauuuggaauguuugggaaauguucuaauagagauuaaaauccaucuuauuuuguggguuuccugauacuguauuuuggagaaccagaucugggguggcauuucuugcaaaaccaaagccaguuuugaaauccagucucagagucaucucugaauguuucuggauuguuacagccagggcaucuccugccagauuucugcuccaucccauaugacaucuacuuuaaccugaggccuuaugcacagauagcaacacugaagugcccccagaagacccaaagagggcaagaccacuacaaaaguuuugaggaugauggaaguuucaccccggaggacugguuuuucccacuggucccuggcccugccuggggcagcccguguaucaggcuggaaggagggcaugggugacagugcaagguucugccuucaccuucuggcucagcagccaaacuucagugugaagccagaacaaagcuauugccaggucagggcuaaggagcucgagccugucuugggguggagccaggacccagaaaccacugccaugagccaccagcuggcucugaucccaggaacaugugcagcugcugcacaggccagacuaguccugaagacugucacugugccagccccuccauuaggccucccggucucugcucucaucaggcucacacccaaugccccguguguacuuuggcaucugccugccuuuagauguccugggaugacugaauaaaccuucagaaaagccaugugaccugcugauucuuaucuuucuggacaucacaccuuuguucuaaaacuccuuagaggucaaaguguauagauccaaaucucugaaguuccuugguaugaugaaaaugaaggaauaaacaauuucccuuaacucuguguggucuaauuuaagggccuuucauuaguacucacaggaaaaacacaggcaccauggcagcggaaacagaaaucccuccccacaugcccugauggugggggcaaaacccaugaauggccacauucacagcuguuucuagaagugcuuccugguaucgugggcauuaagcuucaguaauaaaguuaacagcaauacagucauacuggaaaaaggucaaaaggaggaaaaccuuuauuuaaaauauuaugcuguucuuuuuacaaacuaggucaucuucuguaucaguagcuauuccucaaggcauucggucccacugacccuuuaagaacuuauuuuaaaaaaucgggcugcuucuuaccccaauuuuguuucuucccaaauguguuaggcacucuccaaccuggauacaaauuccagcauuuugacaagguguaccuaguccucuucagauucucuuaucaccagggaaaggccuguacaacugcucaguaagccuuggccguaagguaugcucccuaauacagaauaaagggcaggaugccacagugcggccagcaggcucagucccauggagagcagcccaguacggcuuaagcuguaaagacaaguaagacaaggucucugugcucaggaaacugguaaucuaggggaggccguggauguguugcuuaacaaggugauaagugcaugcuagcagugugaaccaagugccaugggaacucugaggaagcaaugauuaauuaugcaggguauggggauuaaagaucugggaauguuuuccagagagagaaacaguggagcugaaacagaugaugagcaggcuuugaucaugacaaaauuugggggacagagugcucagcaagauacauuccaggaagacgcauggugcaaaagucuuccagacacugaaagcuuuuguuacaugaaaugcuuggagcacagcaggucauccaggacaguuggaguuuacaguauaagguggagggugacacggaaagaccaaauaguuggguugggccagauggugacucucggacaaccaacuccuuggacuuuacccugaaggcaguggugaagcagaugaaggauuuuaagcaacuggcugggucaaggguuuaguuugguguaugacaagcaaaguugucuaaaagggacucugggaggucacuugggguggcuuggacaagccaaguggaacaggggcuuccccccuucucccaguggggugggcugcccuaaauuuagcuucccacagaacuggcaguuucuuucccacccuacucauaugagcuaccacucuccacaguccucaaaucuccagaacuggaaagcuggcuuucccagacaacuucucagaacaucuaacacauaacucagacugccuggugccccaguaccuauuuccauccccacugauaaguuguucugauccucucuccacauggaaagcaauaaggagguagaguccuuccccuaaaacauaacuugccauauucuaaaagauucauuuucuuggauucaugaaaggcugggagauuguagaugacucuuuugccugcugacacuugcuuuguauguuucuacaauaaagccuguuucuaaauuca

SEQ ID NO: 16283 - RNA, 6809 nt, Homo sapiens
cgugcgcagagaggagcgaagcgcgagcagucgccucgcccgcgcuugcugccggugggugccucaccuaaggggccggcgggggccguaacccgagccccaucgcagggauccgcauuugcauaauucggcuuucccccguucuuucggacucagggcccgagaugcgagucggacucccuuccgaggcgucgucuugcccauggucagcgcgggggccgcgggacccgccagagcgcaggcggagugggcuggcgcacgugguaagaacgcagcuaucuuuucuugcuuuucuuuucuuucuuucuuucuugagaaauaggacuuugcacauuuuugcuggggugggguaucuacuagggugcuaaccuugcugcgauuucuuuccauguccuuuucauccccaauuggaaaaaagcgcacagcgcgagcgagaaacuuucccaaaugugcucugggugacuuaagucagagagauggccggccgcuggauaccggcuguuuuggagggagggggagaagcagcgcuucaguggaagagcagagggagagaccgcucccggcagccucagggcccugaccgcggugcgcugggcccggcgagagcuggcgcacggcugcagcggucgaggcaggugagcggcugaagacccgccugcagcgccgcgcuuccuccacggcguggcgccguggcucccgcccgccccggcccacacuaagcuagggccgcuccgggcccggggugaaaaagggacaggacaggccugcgaggcugacccugcgcguuaucccuggccuccgcggcuuuggagcgggaaagggcucuggggcaguucgcaaccugcacaaacgaccaugaaugagucaugcaggcggcggugcgcuggacuugggcacccgggaccagccuccuguggggccccggacaggcccggcuauccauugcgggcuggggcgcacugggagguagaagcuuugcgcccagcaagccagaaccugcugcuauuuggacuuuggaaaaguuuuuaaaaauugcuuugggaacgaaacagaaggguuucuaccggggucucgcaaaguaaaacgaguggguugggggauggggauggcgucuugaaagugauuagagaugcuuucggccgucacugaggaccgcgcugggcucaccgagguguuuuuuggggagggagagaaaauauuuauucuaguacguguauucuggcucgggugcgggcagggcgcgguccuggauccugggcuaugggggucagggggauucuguggcugcagggaccgguagugaagguuaggccagugucuucauagaaccuccuguccagcgagcccggagcccgcucugccgccgggacacugcuggcaacgacggcgcgcggacgcagucaacagggagguguguaguguaaggugugugagcgggugugugaagagggcagcgggggcgggaguguguagcggaaguggagcgagugugaguguguguguaugugugucuggaggggcagggugaguguccaagcuuccaucuggacgcccccacgcagccgaccgcccagacgcgccgggaagggcgcccgcuccgcgcagcagcugaaggggggcggggagcgcgcgggcagaggaaggagggugucuccggcugaggauuucucucgaagcuccccacaguaauucugcuccuccuaggguuuacccucccagucccaaggugcccaaaauacuuaaacaaacaaacaacccaaaccuguuccguuuucgcuccuguauaaauagaacagacuuuccaaaaaagcaauacgcauucacucuuaucaccagccacuucuuuccaccaaguaauucagaaaaaagcagucagcuuccgugaaugcauguagcuuuuuuuuucuucgcugccuccuuuugcuugcgguuuugagcugccaagaaagugaguagggguuugacuguagugucucggcuccgcucgguuucuuuccgaaguuuaauuuuccggaauggcucccaaacaagggcuagggaggcggagccgccggcaccggaucuucgccuuuuuuggaaagucccagagaaccggaauuccuccccgccccgggaggcugagccgcagccuggagcagcucgcucuccugcuguggcugugacuggguccauggcgcgcccucucccccgcgaucccugcgccccggacccaggcugcagcuagggccgcgcgcccgggaccccagcgauccccgccgccugcgagcuggaagucgcgagcccggcggaguccgcgcggccgagcccguguaugcaaaucagccaugugacggcaaaagccgccuggcccagcccuguuccucaguccauauaugggcagcgacgucacggguauugaagaccugcccauaaauacuuagagcaacacuuuccgucuaacugagcgaggagcaauugauuaauagcucggcgaggggacucacugacuguuauaauaacacuacaccagcaacuccuggcuucccagcagccggaacacagacaggagagagucaguggcaaauagacauuuuucuuauuucuuaaaaaacagcaacuuguuugcuacuuuuauuucuguugauuuuuuuuucuugguguguguggugguuguuuuuaaguguggagggcaaaaggagauaccaucccaggcucaguccaaccccucuccaaaacggcuuuucugacacuccagguagcgagggaguugggucuccagguugugcgaggagcaaaugaugaccgccaaggccguagacaaaaucccaguaacucucagugguuuugugcaccagcugucugacaacaucuacccgguggaggaccucgccgccacgucggugaccaucuuucccaaugccgaacugggaggccccuuugaccagaugaacggaguggccggagguaagccgcgugucuucgcaggcccggaccugcgcggcccggaggugguggauggggugcagugggugugcgggaaucgcaggagaggauuggggcuccagguggacggugcugacugcacuggcuuugaagacuggaagugggugcaggaggaaccugcgacagcugagaccagggcgcgcgggcagaugcgccaggucgccagcaaaccggcgugcgugcgccccggcgcgcccagccccgggcgagcgcagggauggggguggaagaggcguccccccggguuucgaggcuugcguaggcccucuggccggcagcacuucgaccuccccucucccggggcaggggcaaagugacgguaaaguucggggcucucggggagagcugcgcgccuggagagccgagcggcggagaagcgccaggggaaagcgucgguagcucccuccugggcagagccgaccccgggaaaaucucggagcgcucccuucuugcggccuggaggcgcgcccccaccugcccgccgcccgcgaaguugaggggguuaguaaggcgggggcuccggccggcggaggcagcgagugggugguggaggagggcgcgcaacggcgggaagcagcccccggacugccgagggaggcccgcgggggcaccggcgacgccgguuuccuuggcgaugcuguggaaagucgucucucgcggcccccgcgccuuccucgaggccgggccacuggccuugggcugaggcggggacgcgcggcugucgggaaaggcggagaagauugggagggcacggaaaccuacggacuccuuccucuacaucccccauucgcuccagcagcccucggcugaagcgcagcgggagagggagggagaaaaaggcacaaggcgccggggauggggagcagccgggaaaucacccacccccuucucgggcucuccucucgguuuggcaccaucacggcacugacugggauaggucgauucuugggugguguuugucuuggugccucagccguggaacccccaggcaaaaaagagggagaaaagcuccgggcggaugaggcuuuuuaaaauauuguuguugcuauuauuggguguuuuuuauuggggacuagagccacagauggcuggggguggaggggaguugggaaaagcucauucugcuuuuuuggagguaguucuugaguuccauacugucaauggguugccacaguugggcuggccucuucuuacagucugugggccucaauuuccccaccuuuuggacuuugccacagcucuacagugcugagacucucggccuuggaaauggaccuaugugagcgggggugagaagggaguccuggcuguauuuucauuguuccaccuccauucugccuuuccccuccccagauggcaugaucaacauugacaugacuggagagaagaggucguuggaucucccauaucccagcagcuuugcucccgucucugcaccuagaaaccagaccuucacuuacaugggcaaguucuccauugacccucaguacccuggugccagcugcuacccagaaggcauaaucaauauugugagugcaggcaucuugcaaggggucacuuccccagcuucaaccacagccucauccagcgucaccucugccucccccaacccacuggccacaggaccccugggugugugcaccaugucccagacccagccugaccuggaccaccuguacucuccgccaccgccuccuccuccuuauucuggcugugcaggagaccucuaccaggacccuucugcguuccugucagcagccaccaccuccaccucuuccucucuggccuacccaccaccuccuuccuauccgucccccaagccagccacggacccaggucucuucccaaugaucccagacuauccuggauucuuuccaucucagugccagagagaccuacaugguacagcuggcccagaccguaagcccuuucccugcccacuggacacccugcgggugcccccuccacucacuccacucucuacaauccguaacuuuacccuggggggccccagugcuggggugaccggaccaggggccaguggaggcagcgagggaccccggcugccugguagcagcucagcagcagcagcagccgccgccgccgccgccuauaacccacaccaccugccacugcggcccauucugaggccucgcaaguaccccaacagacccagcaagacgccggugcacgagaggcccuacccgugcccagcagaaggcugcgaccggcgguucucccgcucugacgagcugacacggcacauccgaauccacacugggcauaagcccuuccagugucggaucugcaugcgcaacuucagccgcagugaccaccucaccacccauauccgcacccacaccggugagaagcccuucgccugugacuacuguggccgaaaguuugcccggagugaugagaggaagcgccacaccaagauccaccugagacagaaagagcggaaaagcagugcccccucugcaucggugccagcccccucuacagccuccugcucugggggcgugcagccuggggguacccugugcagcaguaacagcagcagucuuggcggagggccgcucgccccuugcuccucucggacccggacaccuugagaugagacucaggcugauacaccagcucccaaaggucccggaggcccuuuguccacuggagcugcacaacaaacacuaccacccuuuccugucccucucucccuuuguugggcaaagggcuuugguggagcuagcacugcccccuuuccaccuagaagcagguucuuccuaaaacuuagcccauucuagucucucuuaggugaguugacuaucaacccaaggcaaaggggaggcucagaaggaggugguguggggaccccuggccaagagggcugaggucugacccugcuuuaaaggguuguuugacuagguuuugcuaccccacuuccccuuauuuugacccaucacagguuuuugacccuggaugucagaguugaucuaagacguuuucuacaauagguugggagaugcugaucccuucaaguggggacagcaaaaagacaagcaaaacugaugugcacuuuauggcuugggacugauuugggggacauuguacagugagugaaguauagccuuuaugccacacucuguggcccuaaaauggugaaucagagcauaucuaguugucucaacccuugaagcaauauguauuauaaacucagagaacagaagugcaaugugaugggaggaacauagcaauaucugcuccuuuucgaguuguuugagaaauguaggcuauuuuuucaguguauauccacucagauuuuguguauuuuugauguacacuguucucuaaauucugaaucuuugggaaaaaauguaaagcauuuaugaucucagagguuaacuuauuuaagggggauguacauauauucucugaaacuaggaugcaugcaauuguguuggaaguguccuuggugccuugugugauguagacaauguuacaaggucugcauguaaauggguugccuuauuauggagaaaaaaaaucacucccugaguuuaguauggcuguauauuucugccuauuaauauuuggaauuuuuuuuagaaaguauauuuuuguaugcuuuguuuugugacuuaaaaguguuaccuuuguagucaaauuucagauaagaauguacauaauguuaccggagcugauuuguuuggucauuagcucuuaauaguugugaaaaaauaaaucuauucuaacgcaaaaccacuaacugaaguucagauaauggaugguuugugacuauaguguaaauaaauacuuuucaacaauau

SEQ ID NO: 16284 - RNA, 4953 nt, Homo sapiens
caccgucguaggugcgggccgcaugaauggagcgccgggcguaaggcaaagccuggcaccgucugcgcggccgcuaucugcucccggagcgugagugcgggguguggggcgugcgcgugcgcgcucagagggggcucaaggcgagcgcgccgggcaguugcgggcgcguggcugcugagguuggcggcggugccgcgcgcccgacgggccggugguugcggggccucccgccucgacccgggcugggggcagccguggcggccgccggggaccgcaaggggcggaggaaaggagggggccggucccggcacgcagaggagcagccgaccaugccccgagacaacauggccuccuugauccaacggaucgcccgccaggcuugccucaccuuccggggcagcgggggcggccgcggcgcuuccgaucgcgacgcggcuucuggcccggaggcgccgaugcagccgggcuuccccgagaaccugagcaagcugaagagccuccugacccagcuccgcgccgaggacuugaacaucgccccgcgcaaggccacacugcagccgcugccgcccaaccugccgccagucaccuacaugcacaucuacgagacggacggcuucagccugggcguguuccugcucaagagcggcacguccaucccgcugcacgaccacccgggcaugcacggcaugcucaaggugcuguacggcaccgugcgcaucagcugcauggacaagcuagacgcgggcggcgggcaacggccgcgggccuugccgcccgagcagcaguucgagccgccgcugcagccccgggagcgagaagccgugcggccgggcgugcugcguucgcgggccgaguacaccgaggccagcggccccugcauccucacaccgcaccgggacaaccugcaccagaucgacgccguggaagggccugccgccuuccuggacauccuggccccgcccuacgacccggacgauggccgggacugccacuauuaccgggugcuggagccggucaggcccaaggaggccuccagcucggccugugaccugccucgagagguguggcuccuggagaccccacaggccgaugacuucuggugcgagggagaacccuauccaggucccaaggucuucccuugaagccacuggcgcccaggagcggugggccgaagacgugcccuacccuaccacaagggcugugucucuacccccuagccugggcguuggaucuacuggaaugagcagcagccgcuuccucggcagccuugggaagcacgggcgacuggacagcagccgccgggcacgguuaugggggcggggugggcggggaggcuagauuguuuccugguacugucacugccacuggggcuuugauuuggaggaauggggcaggggacuaucugaagcgcuuccauccuaaagccauaaugaaaauaucuuccucucuuccccauucuauacaaaauacuaagugguuuucuugcucccacucccuaccccuuaguuaaauaggguuuauuuuccacucaugcccuuaugccuuuuuuucuuauaguuuuuuaacuuauugacugugcaugacccagugguuugaauuguuuuuaguucaagucauugguaaaaacuagguuuaaggagaugagcuacuguuuaaagugagcuggccugccuaauuaauuccuugugaaaacuaaaugauuuuuucaguuuggggaucauucucacaacauaacuaugcauguagaggacaagauuuauuuucuuuccucccuuugcccaguagccacaucugguuuacucaggcagcaucuacuaagaaauucagcaccugcauaucucugugacauggucacuuagagcuuaucuucccuaugaaucuccagaucugugagucgagcagauuucauguugcagauucaccuuuaaugcaaagacuguauuauccucacaugacuuuuuuucuugucuuacuguaccuuaaaaggugauagaguaauucuguauuuucuaacgggaagauucaaaggagcugaauguguuaugcuuccaaacaacugaauguaaaacacuccuagccaguuguugcauucccuauauuuauuuacuuccaauauuuuacuguaaaaguagggagaaauauuauguugauaguuguuucauauucucucaggaacuuuaauguucccgacucgggugauuccagcuguguugcuggcaguguugucucaacccucucccuaaaaugacugagcccuggguucaucuaaugugguuuuccuuaggaagagauagaaggcacagaagaucacagcuagagaauugagaauuaacuauacuacuagccauuuuagggcaccaaaacuugggauuaaacacuuccuacuucccacucccaacuccugaaaugaagucuugcuaucugugacuaguuuuauuuuugugcuuuuaauaguccgagcagucuuaccuuguuuacacauguauugacaccauuugcuucaggccauggagcacuguuucucccuuuuuacuauuuauaggauuccguuuuuucacaagacuuuuaauaaaaagaaauuguagaaauaaacacauuaaaauuugcccagcugucgucuaagcccucuugauugacuugcccaaguggcaauagaguucuaauaucuauaauaaagggagauuugcuauuauuaguggaauguugaccccguauguagagaaacaguacgugccuuugccucuuuaugcacacagagacccagggugagggaguauuuguucccaguuuuuaagauaguauaaaaaagcaaauacuuggugagugauuuaaaaauaaaaccaaaacaaaacacaaaaagauauuccacaggacaugccacuuuauuauaaaaccugacacaggcauaguaccaaguauuuccugcauuguugcuaaaauuguuuuauuguagcuccacauucugguguaguuuaaaaugccuuugggggcaguuugaagcaguucuucaugccacuuaguuugaaaauaaaauucuagauaugcaaaugauuuucuuagaaaacuucacaaaauaaaagaucuuguuuuuuuuuccauagcacaguaaugaaugugguuaucaaucacauacuuuuuuggauuauauuguagcaaaaaguugauuagcuuaccaagauuauuaauagcaauguauguguuauaauacaacuuaguacauuaaagcuacgaaaacucauccuggcuguaggauaguaauaaaggaagaauuaugacuucauuaugaaaaaaagaaguuuuaaaguuuucaauuacgagcaauuuggaagaaaaaaccuaaggugcuuuucaaaagaguaacugaaauuguugcaggccaaaacagcaauaugauaucucagauuuaguucaauaagaacagugaaacuuuugguucacuaauaaauucugaguaaauuaguggugaagacaaaauauaacuuguuuuagugagccacugaggaaagaauaugcuuauuacaaagacaaaauguggugcagaaacuaucuugcaccugugugcauaaacuguuagucgugacugacuugguguguugcuauuguguuucuauauacuccguccaauauagauaauguuuuaauaacaacugugggauaaaaguuaucuuccccuuggaaagacuaaugagcacaaugauauuaaucacuuuuauggugaauaauaaaugcaauaauugccucaugggugagaaauugucugucuaaaugcuucugaagcuuuuaaaguaucugguucugucacuggccaguuauaucaaugcagaguauuguguaccuacuuacuauuuuaugagaauugauuuuuacuaagccugauuugaauggguugcauuuacaccaacugcuauuuauuaaugaaagugguagccugcuuuuuaaguaauauguguuuuggcaacaggagaggguuuucugagcuuuuaacaccaguaacccugaacuucuuccaaaauccacaccuuuuauucccccuuuuccuugucuccuucuaggugccucaguccuggcaucucgggaggacucugccauuacucaucuguuacugauucugaaucuugugcucuagcucuacagcccagugaagaagcaauauaucuuuaauucagggcuugccucuugcuuuccaacucuaaccugagagcagugcuacuuuuguaauugcaggucuaaauaacuuaagcguauauacagaagccaaucacugaucacuuccauugcaaugaggcaucuguugucaaagaaggaaaccauuugucaagucccuuauagauauugaaucuucaaacccaaaucuggggauguuuacauuucuggauuaaaaucaguguaccuguaaucccagcacuuugggaggcugaggcaggcagaucaccugaggucaggaguucgagaccggccuggccaacauggcgaaaccccaucucuacuaaaaguacaaaaauuagucgggcaugguagugggcgccuguaaucccagcuaccuagaaggcugaggcaggagaaucgcuugaauccgggagguggagguugcaguuagccaagaucaugccacugcacuccagccugggugacaagagcaagacugcaucucaaaaaagaaaggaaaaaaaaaucaguguacuuauggaaaaugaagacauguuucaaauuguuuagagauaauucuuacuugauuauugcaagacagauagggaaaaccuuaccugcucugaugucuacaguuugauuaccaugaaagguucacaguauauacuguaagauuauguuguacuaaaaucuaguggccuucugcagauuucuaaagcccaaguaauauacacuuaaaaauaguuuauuuccuugagagugagcuuugaaacagccugaaggaaaacacaucugaagcuaaugucu

SEQ ID NO: 16285 - RNA, 2103 nt, Homo sapiens
ugacuggaguuggguauucuaugaccugcaacuugauacauacaaacugauauaaaagcaaugaacaauaucucaaguagauacuacagcuauccuggcaccucucuuccuccaacauuucaguuauaccuagauucuaaguucagaaagacugaauaacuugaccacagcuagacagcccuucaacucuaacccauucagaauauacuucauuuucuaccauuuuccuauacccauguguguuuucuuuccuacuagauuugaaacuccuucagaauagaggcuggaccuuuuaggcuucugguguuccuucccgcacugcacgguguggagagcagucucaaugacugggaagugaaugaauacaguggcauuccuucuuuauccaagccagcaagagagggaaguaagcacauugcuuaucuuaagaagguacaaguuuaccaccuucuuggucucuaaguuggaaaacagaagccuuauaauaucuuacagagauuucuucauguuacaucacuaaucauuaggaguggacagucuuugaauuuugggucuguaucaaucuuuccauuuuuaugaacaacuuagaugcaggauuaggugaaaucuuguaaugguuagcuugaaauacagcauuuuagugaagcacugcuaacuagcugaguuauagcuggcaaauauggaauaagggaacuuuguagcuuaaggucucccauggacauuuugcuuuugggggugguuggauugcuacaacuaaaaaauucccuugcaugaguuugucaauuucaggggauuuugucauucacugaaguggaacuuucaguuuaaaugugaaucucauggcuuuuaugcgucuucgcucauggccagaguggcagcuugggcaugugaauguccaccaccagcuuugcccaucucccugaucacagcacaagcuuuugcuggaucaccuccccauccaaagccugcacugcucuuucuuucucuccaagcacaagugccuuuuguggucccaagauggaacuccaguacagugcuuuguacugacaucuguggguuuuccuuaagguaacuguggguggccccuucauuuauuuucuugcuuccuuuuuguuucuguaaauucugcccuccacuuucccccgaagcacaugcuguucauguaaucugaauggccauuuagaggaaagaucagaaguuuguuguuucauuaccaagauaaaucaaaacuuuguguucgcacugcaauccgagugaguccaggaauagcuuugggauugcuaagugucuggagagcacugacuacacagacauguuuugaagcuggcuauaauaguuucuacagcuguuaacaguucguggaagaauggcagcauuauauaucagcguuuaaaaugugcaugacuugcauugcacagaagucagauugggauagaaucagauauuuuuuuucugaaacucagccaggaaagucuucaauaacuagagaaauucuuuucacugcugaaaucaacaugaaggcauuguguuauuauaauugcuuauagcucaccaugaaaguugucuuuguaugaguggauguacgggcuguacuguuuuguuuuuauuuauucugcauucuuuauucuaauguccuuuccuuuuuccugaccagaaagauuguuauugagcccuucacaaagcugaaauaaugcaguguguuaaaaaaaauguuaacaauccaaagaaguuauaaaaauuuauaaguuggcugaaugcuugggaaauuucugcauauuuuaauauaaauagguaaugcaaauauuuguucuuugcauugagaggugagucucuguauuccaaaaggcuuugcuauuuaaauuagauuuauuugauugcucugaaauaaaggcaguuuccauuuugaaugaggacuaaauaccaaagacuaaauaccaugguuguuaucaaauacaaaagacuuauuaaguuagauauguuacugcaucaugggguuaaacaauuuccagaaaacaguaagaaugucucauguuuaaaauucucaagaagguaacuugcuuaauaauuuuucuuuuugagauuuccaaguugcgaugaaaguuu

SEQ ID NO: 16286 - RNA, 100737 nt, Homo sapiens
cgcuagagccuggggucucggcaacuuccggcggcgggagcugcagagcgcaaggcgcgcccacugcgcgugcgcuucggcccggcuccuccugcgcccccggccccugcgacugggacuugguacggccgggcgguuggcguccucugcggcuccugccaggggcgggcuuuucaaaucuucccuuugaaggaguggcgacggcccggacaguucgcguuggagauggaggggccgagccugagggguccugcgcuccgccuggcggggcuucccacccagcaggugaguugcgggagggacccugccgcggaaggugagggagccgggguucuguuccucgcgcauuugcuuuguggaggagucgggaaagccucucccccgcuccucuauuucagcgguggccagaaacaaagggagggauuaggagacugcgcucuuggggcucuaaagggccuggacaucggaacccccgaguuucucaggcagcugagguccggauugggaaggcggugccgggguccaggcgcgcguuugcgggcgcaccuguccgcugcccuccccaggcuuuggacgccugucuuuuugcagguguaggugaugccggggaaaugggagccccucgauucccaagaaacccagcgaggccaguggacagcuggcuuauuacggauuuaaugggaagcacaguaauggagcgaugucuacacacaacacagaacugguuggggggaggggguucggagcggaguagaggcaaacagcaaccucugcacuuuagaaaaaguugaagguuugauacuggguucuuucucaaaucauuugaaaggaaagagggaguacacgugacauuggauagaaguuugauguuugcuuuugagccauguaaaaugcguuagaaaccuuuuuauuuuacuuuuuacuaaaccaacauuauuucuuggcagcaucaguuauuaaaauguuaccacuuuucacucuuaaccauaacuuuagggucuuaaaagaaaacucugaugucuuuaagcuggaccuucacuucuauuuuaaucucuaccuucuuuuaccuacuucagaaauagguuaagccauaugaaauugccaguuuuguaggucaaaauugguagaauauuugcaauuucauucauauggaggcaccugauaucuuuguuuaaaaaucugggauuuccuuagcagacacaaaauuauuaguuuucaauaauacugugaaaaauaaagcaagacauuaagauucauuaugcaaaagaaguccagugucuuuaucaguaauacuuaugcuguuuuaugccagcauuuucaaaaauuucaaagauuuugauguacuuuuuuucaguccuguccuguuauguacuuuggcuguccugauugcuaacaaaaucuugauuuauagugaauugccauucuauugauguucuugcaccuaucauauagguguagguguagcuguccagguguauuuauugagcugcaggcugcaagaauaggaaugguacagaagcgacaagaggauaaaaucaugaaguuuaguugcauggaaugaaaauaaauguuuaaauauacauaaagccuggguuauuuacaugugggaagauacaauacuuaauuucuuaggcaggacaaaaucaaaaugauugaaauguggaauuacuuccucaguuuggauuugaagaaaaaacacaaaauaguaguagguugcaaccuaacaggaauauugagagucagauaauuuuauacuugacuaacacugaauuuuuauuugguauuuccuuugauacaugaaugaagcugccacguaaucgagauaaggccaaagauuuugagguggucacacacuggucaaacaccucugcugaaacccuggaguccucugcgacuccucacagcauagaguauuggcuuuggagucagauucaggucaaaccaaacucuucuuguugugcaaccuugaauaaguuaucucuguuuucuaaguuucaguuuccaccguuguagcuuggguauuccgccuaucccagacagcuguuggaauuggagaaccucucuaaaguacuuaucacagcaccuagcacucaggaugugcuucagagaugacuauuguuguuauuauccuuuguccuauucaucugagugguuagggcaguccccuacuuuucuuacaaauguuuaagcuuuuggcaucuuaauaaaaauaaaauucaaaaaguaauacuaucucauugcagaaaagucaacauauacagaaacaugaauuuaagaauucggucuccaguuccauuccccagaauggccgcuguuaacaauuuccagacuuuuuucuguacauaaacaauucuuaaaauccacacaguuucuuuuagcaaaaugagaacguacuguauuuacucuuuucuucuucaccuuggucuuuguuaacauggcuuaacuauauccauuaggugaaucauaguuucugucuugauuacugcgguugucuuaccgggaguucaacuucagguuuuuuuagucaguuuuuaauaccaacaauaaagccauuuucuuugcacuuccuucaugcuaggcuagcucuuaaaaccuaguagguuucuguuuccuacuuaaccuaaauuucuguuuuuaagguaugcuccuauuucauucauagccuuguccauauauuuuuaucagccugacuuuaacuacuuauagcgucaggacagugacacaggcuucuguuugacuugauuagaggcaagcccuuacucagaaaauuggaaaagaaauaagaguaugauggccuuaccucauucucugcuguuccuggagacuggcauucaaacaauccuaaaaggaaugguuacagagagaccagcuuuugucuuugguccuaaucagccuugacucuaccuggccaagccauuauggcugagggagcgacacugaugauuuuccauucccuacucaucuucuuugagguuaauaaacaucacuauugaaugcccaaucgguacccuuauuacaugaucauuauucuugcuggggauagcacuagacaugaacccuuaccccugaugcauuguauacccuuaguaacuaaagacaacucuaaagaguuuugguuccauaaacccuuccuugcuagagcuagcacugcuuaaccagagaggcuuuuucugcauguaaaauguagauguguacuaaaagaaguugcaugggaaauacaaaacuggcuaaaacaguagccuuaagaaaaaaaaaaaaaccaacagcucagaauacauugaaaaccauauguacacuuaacaauucauccugcuuauguuagccuucugggauccacuuaacugacauuugccugagaccugccucagcgagggagguaagauuauaguuuacuguguauguuaauuuggcuggauuaugggucaguaaacuauuucuauaaaggggcaaacaguaaguauuuucagcuuugcaggccacucagucucuguugaaguugcucaacucugcccuuguagcuuaaaggagccauagacaauaugaaugagugugucugugcuccaguguaacuuuauuuacaaaaccaggucccagccaggccauaguuuucugacccuugcucuaaaggaaaaaaucuuaauaguaguaucuguuagauacaccucauuuccuuaauaaauaguacuuuaaucuuacaucaucuucaaacuuuuuacacguacauuuuuuuuuuaauccugacuuuacauuuucuuucucuacuauuucccaagcuucuauaguuuuauggagucuucauuauaagugauggugagaagauacucuucauuuaugugauagaaacacaaacugauuccuuaauguggcuguagccaccugcugguucuuuaagguuguugcaaguuucaagauugcuguggaauuucaaauaguccagcugugcuucucuacccuagcugaccauugaaucaccagaggaacuguaaaaaaaaaaaaaaaugcucaagccccaccuccagagagccugauugguuugggguaggucacagguuuagguacuucuauaaggcccuuccucucugccucagaugauucuaauaugcagccagcuuugagaaccacugugcuaguucaacugccuguuucauuguaucauuuaaaacuaaaguugaauuuaguggcaccagaugguauuuguuuauauuugaguugugggguaaagcuauucaucccagcuuuagguugcucccuaugugcacuccccaauauagucagucugccagaguuuauuucuauagacauaugggucacauagauaauucuuauaauuaauugcuaauuacauugaagaagaauuuacuuuggggcuaguaagucauaaaaagaugaaauggaguuguugaaauucagucauguguaaugaaggaaaaccagcaaaugacuacauuuauauaguacaccaguuuugaguuacaacacuauaugagaagguuuuuauguggugauuacaugauguaauuacagaagguaauuaaacagcuguuuucuguguguaaauaguacaguugauugauuuggauagucaaguuaaaucaucuacuguaguuugucuuuugggguagucuucaaaaacuauuagcucuccuaacuuucaucuuuucuuuuugaaaagguuguauagaccuuuugguauuagauuucauuuacauuuuuaaauuuacauuuugauccauucagaagguaaauuauagucuuuauuuuuuugccauagaaacuaggauggucacuuuauguuuuagaaauagacauaccagaaacauuacauguuugugauauaauaaagaguaccuuugauuuauaauuuuuauaaagucauugugaauuaaaucagaacuguacauucaguuuguagaauuuuaauguugcgugugaaacuuauauguagaaucaggccauuaaaagauaauuauauggaauaaaagacuuucagcaauaaaauacuuaguaguuucauggugaacccuaaaacuaaaauaaaugguauguccagaauuguauucuaaagcucuguuccagauagcuaaggcuucugacauuuucaguguacagcgcuuucacucucuugcuucugagauuguauuuacacugccuacuguuacaaauagccuguuuccucccugcuacuaaaccuuggcuccuuuacucaguaucugcuuuuuucagaauguuuuucuugguuaauucacugucaucaaccacacugccaucucuuaauacaauguauauaauauauaugugugauauauuguucacauuaguuauuguauguuuucuaaggcugcuauaacaaaugaccaagacugaguggcugaaaacaagagaaauuuauucucaaacuuauggaggccagacgucugaaaucaaggaauuggcagggucaugcuccucugcaggcccuaggaaagaauuccuuucuugccuuuuccagcuucugauuguugccaucaauccuugguauuuuuuuggcuuauagacauauuagucucugucuucacaugucauucucucuguaugugacugugucuucaugggaccuuucuuuaaggacacuagucauuagauuuaggacccacucuaauccaguauguucucauuuuaccuaauuacaucugcaaaacccuguauccaaauaaggcuacauucugagguucuggauggacauaaauuuuggagggaugcuauuaaacuucguauaguuauaagaacacauaauguuucucaccuuuguuuauguucguuuauuccguuucuuuagauuguaaagacuuccuaaugaagcaagaaguuuagaauugcaaagagcauuuuaaaauagcuauuuuuacacuacauauauuaaaacuuuguugcuuucucaauaugguauacaauuaugauaccuauuuucgaucuauuauggguuaagauguaauuuuggguuuuugcuauauuuucaagaugcauuuuuuuuuuaggacugcaacauucaagaaaaaauagacuuagaaauucgaaugcgagaaggaauauggaaacuccuuucucugagcacucagaaagaucaaguuuuacaugcaguuaagaaucucauggugugcaaugcucgacuaauggccuauacaucggagcuacagaaauuagaagaacagauugcaaaucagacuggaagaugguuaguaacauaguuuaccuguggcuuuuaauguacuuaaauauguaaauuuaaaacacaguauaauuuaagcuuaaguaccaaugucaaaucaccaaacuguuuuaaaaaacaaauacacugaaguagcagcugacaucauaaacaguuugccgacacagcucagagugaacuuaggcagcagcuuuuauugggcuguuguguucaauauguaauuauaaaaugaaaauuauccagaagcaaugacugagggagcauuuuaagaagaaaguaccaauauugauagaaauguagaguaagaaaauuaauugcuuagaaauaugcuaauauaaagguacuagcugugagacauggaaacucaaguauagaaauugagaugagugagcagcaaaauuauaaagagauaaaaccuuaugaauggaaaggaacuuaaaaaucugcuagcccaucucuugauauggugaacauaagucccagagaggcaaaaaaccucaaggacauucaugcaacaagugauggaagcuaaugagauuuaagauuugcuaaguauuaauaacuucugcucauguguucugucaucucaugcuguucuuuuagauuagaucuaugauuuguauaugaaauuuauauccuaacuuuuuacaaugccaaaucuuacuugaaccuaagaauugguucaauuuagaggcuggauuuugguguauuuuaaauaaaaacagucuuacauuccccuuuguugauucacagcucugacacaagggaagaguuucuuguuagacaauagugacuguugggcucagcauagcaucauuaaauucuugaaaaguaaguuaaaaacaccagucagagucugagauuucuguaaaaguaaaauuuugaugaggauguaauguaauagagaccuggauacaaaguagccaaccuuauuagcuauauugccaugggauagcuuuuauuuauuuauuuauuuuuuaaagacagagucucgcucugucacccaggcuggagugcaguggugugaucucagcucacugcaaccucugccucccggguucaagcgauucuccugccucagccucccgaguaacugggacuauaggcgugugccaccacacccagcugauuuuuuuuuuguauuuguauuuuuaguagagaugggguuucaccauguuagccaggaugguuucaaucuccugaccucgugauuuggccaccucggccucccagagcgcugggauuacaggcaugagccacugugcccugccgggauagcuauuuuaaucuccuugugccucaguuccuuccuuacagugggcaugauaauauuuacauuuugaaaauugagauuuuauauauacaaaaaccuaauguaaugccuuuuacauacuuaguacucaacaaaugucaguuuucauucuuauaugccuccagcauuauacaaugaaauuguuccauuagcauaauguaggaaaauguuuuucagauaggcauacauugguuuaagugagugcuucucaaaguugguaacuuguagcacugagaguacaugaugcaaagucauagaauaaauauggcaugucuucuuagagcaugaauuuuuaagauuaagcaugagaaguuuagaauaguggaguauuuggagguucugcuuucuuauuccuggggauaggggauauauguucccucucagccuuuuuauuaggauauuuugucaagaggggcaguuucaauggaaaaguuugagaagcccugauuuuagaaaguaugggacuaaacauuauauuaugucaucuaucacaauaucuggaauauuauuuuugggaccauaucugccuccauauuuaaugcucuuuaaauauuuauaaugaguuaugaauugacuguuucuuaaauucggcaguguggcuuuucugaaguugcugauguauaaaaacuauuaaauaagccuaaugccuguucaauuuauauagcagugauggggaaaaauuaggaucccuaacuggaaauguguaugauuuucaguuucuuuacuaauuaucugugauagaugagaauaucuuugucauuauacacacacacacacacacacauauauuuguucaucauucauguaaaaacaguguuucccuuaauuauugcuggaauuuaaaaaaaucuuguauagucuauauguauucuuuguuuauagcuucauuuuguaugugaagauauaaccugaggugacugaucagauauaacuagaaauuauaauugcuuuguuauuacacaaaaaugacuugaagauuaaugauuuaguuccuugaagaaaguuauguaaauuaugcagauauacugaauaucuaccgcuugcagaacacuuauuaagcccugugcuagggugucuauguuaaaagaacagaauuugucaaaauaugacaauauuguauauucagcaaauauuuugccuuuagagacuuagcagucuguaccuuaguuugguuaguccuuaagguggaaaaaugcucaguuuuauauugcugccagaguuaaaacaaauagcauuuuaaugagaacacuagucuaccuucucuaaauuuuaugauaagaugucaaaaaauaaguauagacacuaaaucuagacuuuuucaaagaagaauccaauaagugugaaaugguggaauugacgaauaucuaauagaacaauuggguuuggaucuucuagauugugaaggauggauagaguccagguaggugagcaggaggaaggcagcauuccgagaaaaauuacaaaagaggccgggugaagugguucacaccuguaaucucaacaguuugagaggccaagguggucagauugcuugagcucaggaguucgagaucagcuuaggcaacauggcaaaaaccugucucuacaaaaaagacaaaaauuagccaggcaugguggcaugugccuguacucccagcuacucaagagacugaggcgggaggauugcucaagcuugggauaucaaggcuggagugagcugugauugcaccacagcacuccagccagcgcaaaagagugagauucugucucaaaaagaaauagcaaaagaaaaauuuacuuugaaaaauaaauaugaauuauucaggagcagggaaaagaucuguuguguugagucugaagaucaaggcaaagaugaaaaggaaggaggaagcaagauucaagaaagccuggaaugcuacagaguucuuugguauuaauuaacagccuuuccaggugccaggcauuguguaagauguucacaaauaucacauuaaaaauggagaaagauauuguauuaguucauuuucacacuguuaauacagauauacccgagacugaguauuaagaaaaagagguuuaaugcacucacgguucacaugacuggggaggccucauagucauggcagaaggcgaaggagaagcaaagucaucucuuacaugucagcaggcaagagaucaugugcaggggaacugcccuuuauaaaaccaucagaucuugggagacuuacucacuaucaugagaacagugcaggaaaaaccugccccuaugauucaguuaccuccugauggucccucccaugacacauggggauuaugggagcugcaauucaagaugagauuuggguggggagacagccaaaccauaucagauauaaaccucuuuuaaaggcuguaacucuuuaaggauacacagugccuuuguggcuaggucaugaauccaggugacuuaaaaacccauguaccuccaucucccacuccguccaaaaaagaaccugugcuuuuuuuuaacuauugcuccaagcugccauggugagcuauuacagggcuuuauauauauauuugcuuacccgugaaaauaucuuuuauguuacauauacacauguauauuucuucaucauucauauaaaaacauuguuucucuuaauuauugaauucuggaauuaaaaaaaucuugaauauucuauauccuguuauguuuuaucauuuuauuuuaagcaaggaagaaguaugauaaaaacaaguauuuggggaagguuauuuggcagcaggguauuaaaaagaugagaguaaauaauugaaauaaccaguuuuuagggaaaauauuuaagaauaggcagacauagaaaugaucauauaaagaaguaagcuuuuauuagagaaaugaggaaaucaaaacuguguguggauuucuuuagggcuuuucuaauagaucuucacucaaagugcucucuguacauaaucauucugcaagaaguuuuaaguuauuucucaauccagugaaauuauuuaagaagucaaauaaucuuacuucauucuaaagccuuuuaaaacucggguuccaggaaagaauuaaguccuaauguccuaagaaguucauuguaugcauugacuuaacugcugcauauagaauagugcuacuuuuguaccacccuuggaagaauucaaucaaugguuacucugcuuuagaugaggaaccacaguuaagaaaucacuaauaucauuuguuguuuuuuuaaaaccacacaauccugagaauauuggcaacugguuaaauguucuauuaccauacuguuccaauaauauaacaaaaacuuuuuucuaaguuguguuuggguaugaaauaccuaguacauugccuguucuuuaugcuugaacaagccaaaauacccaggcuucuguacaguucccaauggagucaggauguaaaaaccuuucuggauuggguaggcaguaggucguuaggaugaggugcauagguugcuuacugccucaauuuagagguaucguggcuugguuauagcagucuguuaauuugcuggacuuuugacuaguaaacuaucauuguaccuuuuuuucugcaugcuguggcuggauauggcuacuuaaaagaugguuuauuucagucuacuuucaaaaaauagcuauugguuuccauuuacugaaauaggcauuccagaauccuuguggucugaucccaaacuccuugcacucuuaucuuucaauuucugcuuuacaaauuuauugcagccaaaugcuugauugguaucccgaaaauaguucuuggauuuucacaucuccaguguguuugcuuacacugaagugccauaucuuucauucucacuugauaaaacccacuuguucugggacaccacaccugccucaaaguuuccuugauaauuguauucagaaaauaauuauuccuuuauguccaugguaaggacccaaaaaaugacuauuuaccuccuuuuacuucuaguaccauccaaaucaugaauaccucacuauaacauacuaaauucuaauagagcuauuuauaagcaacauaucuuuucauaaauuauaagcuuuuggaaacagggacaaugucugauucuucuuaucagugaaauagaauugauaucaccauuaauuucacaggauuacugugaggauuuggugccuggagcuuagaggcaacucauagcugagguaacucuugguucucuccuucuuucuaccuuauaucccgcagaacaccaacaguguuguguacuuacuuaagaacaauuuaauguaugcuucauaaauaaaguuuugccuuguauccccuuaauguguaugaugagcaaauagggcuuagaauuuaauaggaguuaauuauauaccaguuacuuuuuuuuuugucaccuucuuuuauguucuuagguucuuacugucauuuguuggucuaagugucuguucaucauguuccagauugucauuuauuccuaacuauguuugcuuuuuaaucaacuuuuuauuaugaaauuuacauacguaaaaauuacaagaauaguacaaucaacaucauguauauucucccccuagguuguccaguuaauagcuugcuauauauauucacuucaucuacucuaccauuuuuucuauacacacacagacacacacacgcauacacaaauacacauacuagcauguguauacaugcacacauuuuucuuuuuuguuguugaaccauuuaaaaauaaguugcagacaacauggcacacacaccacaauaauuuggcauggaucuuuuaaaaauaacauucuucuacauaaucaaaauauuauauacaaaauauuaguaauuccauaauaaucuaauaucccguccauauucaauuuuaccaaguugucagaagaaaacuguuuaucuuuuuuucccccaaaccagaauucagucaagaucuaugcaguacauuugguuauaacuccaguuucuuuuaauuacucugccuauuucuaaaaaccccuugucauuuauacuuagaagagccucggcaaggaaugguggcucacgccuguaaucccaagacuuugggaggcugaggugggaggauggcuguagcccaggaguucaagaccagccugggcaacauaauaagaccucguuucuacaaaaaaauacagaaagauuuagccaggugugauggugugugccuaugaucucagcuacacaagaggcugaggcaggaggaucacuugcauccagaagcuugagauugcagugagcgacaaucaugccacugcacuccagccugggcgucagaguaagacccugucucaaaaaaaaaaaaaagagucuagauuuuaaaaauauagccuuuaaaguauccugcauucugcauuugccugguuguuucccugaaguaucauugaaccuuuucucauauucuguguuuuugccauagauggacauugagucuaaaggcuuuaucagacucaaguuaaacauuuuuuucuaggugaggcuggggaccauuauaugcucccaauugaugcaauaugauaucuggucuuaccaccagguaaugcugaguuuaaacccuugcuuuagauggcaguugccagcuuucuucuucaugauaaaaugguuuucccuuugcaguucauaaauaaucugugggguguuggaauugggugacuauucuguuauccaaugagcuuuaacuuaauggcuuuaucauccauuuaugauucuucccuaaaucaauuacauuuauaaugggguuuguaaaacugugauuaucuaauucuaguauuccuucuacacuuauuggcugauacucuucuauaaagaaggacaauccucucuuuagucucuccauuccuggauuuuuauucaauguuuuauuaucauuuauagucacuaagaaucucuugcuuccugacacaaaaagacgauccauucuugcuuuauauuuucccugccccaugccuagagucagccauuucucugacaccuggcucccuuuacuggugaaucauauuuugaaugccaaaccugggcacuagguaugcucacgguuccugggguaucacugcuucuaggcuuuuucaguggacauagugaugaaagagaugaaaaaaucaugaguuuauaucaauauuuauagguuuuugauuacaguaccaauauuauuacugacaauaaaccuacuuaggcaaguucaagauuuccuuacaauucuuuuuuaacauacagaaauuaugaaaauuuuccaacauacagaaaaguugaaagaauuauacagugaauacccauauaccuaccacuaagguucuacaguuaauauuuguuuuaucccucuguccaguccauuuuauuucauuuuuauuuuuuaauuuuuuuagagacagggucucacugugucucccaggcuagagugcagugacacaaugauagcuugccguagccucaaacuucuggguucaagugaucuuccugccucagccucccaaguaccuaggacuacagguucaugccaacacacccagcuaacuuauuuauuuuuugucucucagcuugcuuauuuuuuuauuuuguagaaacagggucuugcuaucuugcccaggcugaucuugaacuccuggccucaagcaguccucccaccucagccucccaaaacacugggauuacaggcgugagccaccauguucagccuaaucuauuuuauuucuuuaugacacaauuuaaaauaaguucuuugcaguucuuuguguguguauacguauauauacacauauauguacaucccuguggauauagguggagaguacucaaaaauuacuugaaauaauuguauuacuuuguucucacaaugcuauaaaggaccaccugagauuggguaauuuaagaagaaaagagguuuaauugacucacaguucugcaugcuauacaggaagcauggcuuggaggccugaggaaacuuacagucauggcaaaagggugaagggaaagcaagcauuuccuucacauggcgacggaagagcgagcgaacuaauggggaaaugcuacacacuuuuaaacaaccagaucucuugagaacucacuaucaugagaauagcaagggggaaauccgcccccaugauucaaucaccucccaccaggucucucccccagcacuggggauuacaauucaacaugagauuugggugggacacagagccaaaccauaucaaugaacuuuuucuuauggucuuguuauuaaaucauaaacagacuuauuuguuucuguuugcuuuuuuucucuuugaauuaauuacuuuuuuggauagauaguguuucuguguccuccuucccaguuuccaauuaguagcucuugucacgguucccaccccaagaaucagccacuauucugacuuuuuuuuccacuguagguuaauuuugccuguucuggaacuuaguauaaauagaacuauacaguggagguuucuuucuuucagcauaaugcuuuugagauucaucauguaucaauuauuuuuuuuccacuguaucacuuuuuccaguguugauucuuuucaaauuucuguauaguuuuggucacaugccagucacuucagguagauguuuuuaaaauaguuuuucuauauuuuuuauuguuuucugugggaagauuucuccagcaugagcuacucugccauuaccaaaagaggaauuuuaauugauuaaaauugcauuuuaaucaaauaaauuuuuauuuuuucuacuuuauggaacauguugagguuuucuuuaugacuuaauauggucuguuuucaugacugucacauuggcuuuugaaguuacauuucuuuuuauaaggguguaaaguuagccaaaggaguucgaaagaucuguguuaaugacuguguuagguuuucuguaaccuuccuuauuuuuugacccauugaacugucuuguacugaaacagauagguuaagauuuuuuauuauuaaagcuugucuucauccuuguaucuucuguacauugugcuuuaggaagaugcucuguaacauuugguacauucgguacuugcgauauauucauuguuagcugcagccuuuugcauuauaaaguguccuucuguuguugucucagguaauguuuuugaaccugaauuuugccugguaacaaaaucacauccucuguuuucuuauuuguauuuguuucauacaucuuuguccaucuccuuauuuuuagccuuucugacucaccuuugaagacuuguuucuuguguucauccuagaguuggguuuuauauuacaagccaaucuggaaauccuuuuaaugggaaaauuaagacauuuuauauuuacugauauaacugauauaucugguuucagccacuguaauauucuuuuauauuauguuaacuguguguauuauaauuagucuuuuacuauguggucuguuuucuuaaauuuuggaagcauuuuauaagucauaguaguuacuauaauuuuauauaaaaaaacuuuauauaccgauaacuauauaaugcccuuaguucuuauaaguuuuuuuauguauuucccuuagcuccacgagccaacuaaaccucuucuuaauuuaccuagccuuagguauuccuuuauagcaaugcaagaauggccuaacucaggcuucugcuauuuugauuuuuugcuuuuaguaauaucauuuuuuuccagcuacuaucuaugucaagaucaaugagcuuauuguauuuccccuacuccacuuuuuuuuucaaguuguguuauuucuacuuugguggaauggauaauauuuacauaauaaucuuauagucauaucuucaccuuuguuuuagucuuugauaugcaauuaaauagguauaauuuucacuucuuguucuuccguuguacuuuccaaaaucauccuuuuggaagaaguucaucagcuagaagauucuuccacaugaguacgguuuccuucacuuucuugcauguuuaagguguuuuucuuuaguguuucuacuuuuagggugacuuugcuaguuauaaauuccuuagccaacacauucuuuccuugaguuuugugaagacuuugcuccauuguauuguuauuaagaaaucuaaucuuucauuuucuuuccuuuguaaaugaguuugacuuuuugccuggagacugaaaguacuuuucuuuaucuuaaagucugauuauuuuacuggaauguguguaaggcugaccauuuggcacauuuuggggcucuuuugauauguagauuguucuuuuuuauuuucagaacaucuuucugaauuauauaaaaauauuauuucuaucucauuguuuuguuuuuccuguuuaagaauucugauuacauauacguuggcucuucuuugccuguccucugugucuaucacuuucugaucuuuuuuaauacuuuauuucauuuuuguucuuuugguucuuuucauucccauuuacuaugucucuuuguguacuuuugcuucuauauauuuaucauuggacaccuuauauuuuaauguucauuucagaaaugauuuuauuuuuccaguuucucuccuuguucuuuccucucauucucuccucucuuugcauaucugccuauuguuuauucuuuacuagucucaaauuuuggauuuuagauuccugguuucuuucauauuugcaauaauuuguauaaaugcacuuaauucauuuuggaguauuguguuaugguuuuuguuacuuuauauuuuuuggagguggaguugguagaggauuuuaaucaaaugaagaguuuugauuaucuacuuuuauuuauaguaguuuucuauggguaauuggaguccauuuuugucccuaaugaaauauguaggauuuuucugagccaagugauuagaagucaggugggagguuacuagaagggaucacaggacaccuuacccuugaggggguauguuccaucauccuuccuggauuccugaaaccacagauaauacuaagcccuaugcacacuauguuuuuuccuauacauacaccccuaugauaaaguuuaauuuguaaauuaggcacaguaagagaugaacaacaauaacuaauaauaaaauagaacaauuauaacaauauacuguaauaaaagcuaugcaaauguguucccucuuucaaaauauuuacccuuuuugugaugaugugaggugauaaauugcuuuugugaugaguuuaaaugagaugaaugucauaggcauugugguauagcauuaggcuacuguggaccuugagcacaagcacugugauaccuugagaguuacucugauaaucuagauggcagcuaagugacuaaugagcaggugauguguacagcauggauacacuggacaaagggaugauucacaucccacagggcagugugagguuucauuacacuacucagaauggugugcaguuuaaaacuuaugaauuguuaggccaggcacaguggcucaugacuauaaucccagcccuuugggaggccgagguggguggaucacuugaauccaggaguucgagaccagcuugggcaacaucguauaacacugucucuaccaaauaacauaaacauuagcugggcaugguggcaugugccuguagucccagcuacucaggaagcugagguggcaggauugcuucaacccaggaggcggagguugcagugagccgagaucaugccacugcacuucagccugggcaacagagugagacccuuccucaaaaauaaauaaaaauaauaaaacuuaugaauuauuuauuucuggaauuuuucauuuaauauuuucagacugcaguuuacucuggacaacugaaaccauggaaagcaaaaccauggcuaagaagagaauacuguauuugguuucuuaguucaagaauguuuuuuauuauuggaacugugaagaguaguuuccuuaauaaaugaugucuuuugggaugcugguugguuaauuuucuguucuuugauacuaauguuugaaacuaguguuucuuggaauauuaaacuucgucuacuuucuuccuucuuuuucuucguagccaaggcuccaaaggacaccucacucauucuuguguaucuuacaggacuuaacuuuugaaucaaaguacuuuuggagcccuuucuuuuaccucuccuggaaccagugcucugguauccacuaggucuuagacccauucacacuucuucuaggggaaaucccaaguugauauugcuuguguuuugcaaugcccaccucauucuuauaugcaaggcuucuacaagcugguuuugacgguuucagauguuaguuuccccauuuacgguaaauuaaaauuuguagaagucucuguuuucuagcuaugcuguugguguggacuguaggucauuuuauuugcuuuccuuguugaucugaaggcuuuuguagaaugugugaaaauaaucugauuuagauggcuacuacuguuuuacaggaacugguaagucauucccugaucacuuuaacaaaugguuuagugccucuucuaugugagccccaaccuaaauacugaggccaaaaauauaaauacucagaaaguaauccuuguauuuguguaacauuuugaagaaugacauaggauacauuuaaaauauuaauucauuuaguaucucugugagauagugaaucuuuuugccacuuuacagauaaagaugcugagguuaaaagauuaauagcaacccacuuauguaauuaguuaauaaugaguaaaauccaauucuaagacuuuagaaucccuaucuacugccuguuccaucaaaaugaacguauccuuacuucauuucauuuaacagucccuaaacauucauugaguucuuuagaauguacugagcugaauaccaagcacuggugauagagcacugaacaaaguagacgccccacccccacccccacgcacaaaaaaaguacacacggagcuuauauuucagcaauauccuccaucugugcccuucccacugcccccaccaccccccaaccccgcaaccccugcucaacccaguucauucuucuugaccuacuucugaaaugcuuuauuuggcuuuguaaaaacaauacuaaucagugucauuuauagcacugaauuaugugugucauucaacauaauugugauuuuuaauauugccaaaauaauuuugugagcuuuguaugauuauuauccuacucucucauccuccaguguuuuuguucauugcucagguacuguaucucaaaaaagaaaacguauagguuggaagugaaaauuguguacucuuaguucuauaauaaaacuuguauuuaaagacauuaccgauuuuauuuuuaagauauuuaugaagcuauaaauuuuauagcauaguuuuaggauggguuaaaauuucaugcuaaacguuugaguguuuuaauuuuuacuuauuuguaucagagguaaaggauuuuauaaccugcuuucaaauaauagacucccauuuagaauuauuuuaguacuucguuaagaaaauguaaaaugcuuucaucauugggcuauuucucauuauaacuuguuaauuuuggcaaagaaaugcuguuuuaaauucccgcuuggaacaauauaagguaggauaaucuguauuuacucagucaauuuuaauacaaauuuuugagcaacaauguggcagauuggcacccucuuuuggucauuuuauuuaccuacaggcagaaauauaaguaauaaaaauuaaguuugucuuuuauauguuuaucucugucuuuuaaauuagcauuuacaaaucucagccaaaauaauucucuagacuggguucauauggauaagguccacuauuaucuagcugugcuuuguuuugguaauuuugugguuauuugcuauuuccucaggcuggcucucuaauucuagcauucagaauuagaauuaauauugcagauuuuugaacaaguauuuauauuaagcaaacuguuagcuacaguagcacauuauuagacagauaguguuuaacaauuucauugucaauuuggauuaauuagaaaaacaucacauuuuaguacccuaaauagcaguuuuguuauuugaauugaaaguaauucaagcuucagaaaauugaggcugaauuacuucaguuuuucuccucucauuuuuuaaaagacagacuuaauucucuaagauuauaugguuaauugaauuuauauuauaguuugacaauauuuguguauacuaaguuugcuuaccaguccuggaaaugccuaugcaaauaauuuauaauugcaggggagaaagcuauacucugccagguaguugaguaguuuggaagggggaaauuuuucuugguaaauauucagcaaguuugcuuuugguaguucuaguauuucagaauuucauucgccugccaaagccucaaauuuaauccaauuuaauaauaccuaauggaucucaacuuuagaauaaucugugaccuauuccauaauacuuaaguuauucacuauauuugagcuuccuuguacuuuuucacugaaauaaguauuuuaagaauuuauauuaugcauugcucauauaggcauuuucagaaauauuacuuucaaaugccaaccaauuauguuuguauuguauuucuugcacaaguuugaagaaauugagauuuguguuugauuucuagugggccuuucaauauauuauuucaccaaaauagauaauaaacuguucaauugaacuguugaauugaacuuuuuauucugugaggaaguaauaagcaagauaaucuucucugacauuacaaacuaauauaaaauguugaacuucacucuuuuuaaaauuuaugauucaaugaaacuuuauuuugaaauaaacaaugaguauuuguauguuucacugagugaauucccuaguuuuaauaccagauauggccauaaaguaauuagguagaauucugagaauauauggcuuuaaauauacugcauuauuuuagucauaccuaauguauaauucuauaaauacuauguaaauaucucauauaaacguaugaacuuuacaucaguaaauuauuuuagcucauucaaaauauaugucaccuauauauuuaugaguuucauccaguaaaggggcaaaaaagcaggaugauauauuuguuuucaaauuuggaugcauuauaaugaauauauuggcagucuuuuuaacagaccuacugaaagcaguguguugcugucauccucuuccaaaaauuacuuagauaaagucccauuucaaacucccaucagucuuucuccagaagccuucuuagaaucaaacaauauccaaauggaaaauuuccaucuuaucacuuauuugaaguaacaaauuaaauuagcugguaguuaauuagcugaccaaauuaaauaggaaugaaaaauacaaagaauacucuuagaaauauugcccuguaaauggaaugcuaaucucuaaaugcaguuuauuaggaaaauaggauauuagggaaauagucaaagauuggauuguuucuaucuuuuuaaaguuuucaugguaauaaaauauuccaacuucagauuuggaagugucuuauauccccagaauuuccuuugaaucguaauauuuaggauauuagggaaauagucaaagauuggauuguuucuaucuucuuaaaguuuucaugguaauaaaauauuccaacuucagauuuggaagugucuuauauccccagaauuuccuuugaaucguaauauuuuucucucuaaauuuuauucugucuacagagcuacucuguuucucaucuuaguuuguuaauuuauuauuuuaacauacacuuaguucuuuggaaucuuggggaaauuaaauaugauauuaaauaugauuauacagcagaggguacuuuuuuggauauuuaucagauucuauaaggauaagauacuccuggacaguaaauugcaugauugggaaguucauuaacuuuuccaggccacuguaucugauaaguuagaaauguaauauaugaaauugugaucuaagguauuauacuucuggggacauggacaaauauuguacaucuuguuuacagauauaaaugaucacaaaagucuuucauuguaaaguaaccaguauacagucaucaaggaauauaaaguuuauaugaaaaaucgggaguggcuccagauauuucuuuuaacuugcuaacuugacuaaacaucuuaaaguuugagucaaauaguuuacauuaacuggaagucauuauuauucacggauaugcauuugcuuuuaauauuuugacauuugugaaacacuguuaaaauaauugcuuauuagaaaagaucuuuuuuccauaaguuuuuuuguuuugacagugaugugaaauuugaaaguaaagaacgaacagcauguaaaggaaagauugccauaucagguaugcuauaaaugaaucuuuuauauugcugaauaaauucuauaacguaacuacaugguggauuuuguuuuaugcccugucuccauucucuucauuuuguuuuucauaccucuaucagaauauuuguucuaaaacacuguuuuuagcauuauaugcuacauugauauagaacuuuagaguuuaagaaaacuguuucauauguuacauacucuacaguuuucucccuagugcagucuuguaaaauagguagaguaauuguuauuuucuacagacucagaggcuaagugacugagcuaggccaaacccaagucuuuugacucuguuccuuuccugcucagaagcuauaauaauguuuuuaauguuuugucuaggucagaaguuccaugagguuuugguaccauguuuauuuuggucaucacuuuacacccagaagcuagcauggugcuuggcucauaguaauugcucagugacucuuggauggauggcugcucuucauugccuguaguguaaagaccaaacauuuuucuccagucuuccauuuugacccaauuuuuuuucuagucauaucuucuauuacuccuaaacauaagcugucgccuuuagcagacauuucucuccuuguccuggcaacauaacccaugcuucugacacccaauuagcuugugaaauaacuacauucucuuaaauaucuguuuguuuaucuauauauaauauaaucucuguuaccguuccaacuagaaaggauguuuccuuucucucaauuccuaaugcaguuaggagacccuucaccacuagauggcacuuaugcugugcagucucaguuucuccaaaguguucaggaagcuaaagacaauggcuuggagaugccacagauugaaaugaauacauggcugacucguguguacacuagucagauaaugcacuuuuacaaauauuuucuuaucaguacauuuuugaaacaauaguauauaccuccauugguccuuaaguaaucacuagguuauuggcuaaaagucuuguacuagagagccugcugcuacauuugagguacugucaccuaaggaacuguuucuaguaauauuuuucuggauaaacaaaauuaucacacaggacgguagaccuacauuuuacaaaguacguaaauggccaaaaucugaagaauugcauucagcuaagcaaaauauucuucagaaaauaacuggaauauguaaaaauuuguugcuuguuuuauaguuauuuauauuuguuuuuaucuuuauaauacaaaacaaaacauguuuuauccuuguauucuuuugcuaucaaacauguauuuuuaugugguauuguucauuaugugcaauaaauuuuuugugaauaaauuacuauagaucuuugagauuuuauaaaaacuaaacauauccuucauuucuugcuucuaauauagugucacucaguauauaaaugacauauguuaaguugcuguuaaacacucaaaugccaugauagucaacaucuauugucauuucauaacaguuuauugauuguagcaauucauaauauuagaaauaacuguacauuuagaaggaggcucaaguaaaaguauuuaaaauaaaauaaaaaacuauuuccugcccacaauuacucaaguguaaaaauugaacuuauuucugcauguguuucuucuuuccaaaagauaauuuuaaauuaaggaacggaaacucugagaaaaucggauacuuacguaaugucuuuucaucuuugccuagacuuaauuauaucuuguauguguuuguaaaaacaaaauaaaaaaugaauucaccuuuauaaauccauuuuuucuugauauugggaugaaaaugugaccuuuguuuugguaaagaugaauauuugcaacaaagugucauaauguuuugagauuacauugauagccagaaaauaccuggguuuucuguuuccagcuacaucacucccuggccaggucuuuaugaaacuaaaucacaaauuuauuauuucugcugaacaucaaauauuuaccauauguaaauguaguauuuaccguaauuauauugugguaauuagcuuagucaccgacuacuaauuuaaugaauaaaccaaaucaguucaccaaguaccuuaguuuucacuuuugaaaaugauagacagacuucugggacuugauagcaucaagucagcugucuuauuaugacucucccaguuuaccauuaaaauggcaaugaagacauaaaacaagacaaaaguuagaguacuguaaacugaaacugagccauuugcaagaaucuggaaggaaguucuaucauuggaagcugaauucagaaauagaguugauggguuacaaauccauugcuaucugaagagcacaagacuaccuggaaaaucgguauccagcuucuccucuuguggagcugauaucuacccuccucucuucggcaugggauagaagaaggcugacccacagguuguggguguacagcaaaggaagucaggauccaugucccucccaugauaguguaaauaguuaaugcucuguuaauccuaacagagcaagaacagcugugaauaaguacaguugugaaaugaaaugagucagcagcuguggucaagcaagaagaaguggacuuuuuggcaggauaucagccaagucauaauuacaaaacaauaaagcauucucauaaaaaucaaaaacaaaauuacaaugucuguuaugccaauauaauuuaacaauuuuagaaguucuagcuaaaauaauaagaauaaaagaugaaacuauugaaaauaaauucauaggugggaauugagcaaugagaacacauggacacaggaaggggaacaucacacacuggggacuguugugggguggggggaggggggagggauagcauuaggagauauaucuaaugcuaaaugaugaguuaaugggugcagcauaccagcauggcacauguauacauauguaacaaaccugcacgucgugcacauguacccuaaaacuuaaaguauaauaauaauaaaauuuaaaaaguaaauaaauagauaaauugaauacuguuugaagauaauagauuguaggcccagcacaguggcucaugccuguaaucccagcacacugagaggccaaagcaggcagaucacuugaggucaggaguucgagaccaaccuggccuacauggugaaccccuugucucuacugaaaaucaaaaaauuagccgggugugguggugcaugcccguaaacccagcuacuccagaggcugaggcaggagaaucacuugaaccccgggggcaggggugguaggggaggauggagguugcagugagaucgcacgauugcacuccagccugggugguagagcaagacgcugucucaaaaaaaaaaagguaauagauuguagacuuacaaaacuuaagagaauuuacugcaacacuauuugaaugaauaaagaauucaguaaaaguggcuggauucaagauaaauauacaaaaagugguaguuuaucuuaaaaucaacaauaacuaauuagaaaauauaauagcaaaaagauacccuuuacaagaaaaccuccaaaaaacaaaaauauuaauuauucaagaauaaccuuaauaaaaauguaaagacaaauuauuaugcuauucuguguaaagauagaauauuauaaaguuaucaguucccaaauuaauuuggauaauggaauacuaauaaaacacuugggaaagggaaauuuugacaaaauuuguucuaaaauuuauauaaagaaauuagcaaguaagaguaagguguuuucaaaaaagaaauauaucuaacaaauuaguaaguauauuauaaagguacaauaguuaacaguaguauaguguugccaggcaugguggcucaugccuguaaucccagcacuuggggaggccaaggagggcagauugcuugagcccagaaguugaagaacagccuagcaaacauagugaacucugucucuacaaaaaaaaaaaaaaaaguauaauaauuaggcagccaggcacaguggcucacgccuguaaucccagcacuuugggaggccuaggcaggcggaucacgaggucaggagaucaagaccauccuggcuaacacgguaaaaccccaucucuccuaaaaauagaaaaaaauuagccaggcgugguggcacaugccuguagucccagcuacucgggaggcugaggcuggagaaucacuuaaacccaggaggcggagguugcagugagcugagauugugccacugcacuccagccugggcaacagauggcacacaccuguaaucucagcuacaugggaggcuuaggugggagguuugcuugagcccuagaguucaaggcugcagugagccaugauggcaccacugcacuccagccugagcaacagagcaagacccugucaaaaaacaaaaaaaagaaaaauaguaugguguugguauuuagcuagacaguaauuaauaaaugauucaaauucauaaaaguauagccaaggaacagacauuuacucagaauggcauauaugauaaagaugucauaauuaaucaguaaggaagaaacagauauauauggaguuagaacaguuauuuuuauaagaagaauauauuuuuaccucacaaaaauuugacagauuaacuuuuuaaaaguacaaacuauaaacaaugucuagaaaaugugcuguuaaauaauaacacuuuauuuuagcuauaguagucagaauuauuauggaaugcagagguucaggucacuguaaagaauaaaacuuaccaaaauuauuacuugucauuucuuuuucccuucuuuauagauauucgaauaccacuaauguggaaagacucugaucacuucagcaauaaagaacguauguaugauuuuaauuuguaauugaaauguuuucuuuaguauguaguguaucugauuauugagaaaaaagacugcuuccuugcugaaauaaauugaugucauuugaaagaauaagcagcaucuugaacuguuuucugauuuuuaauauaaauauguugcagucacuugauacuaauuaauauagugcauauguaguguacuuuuaguuguugauaggaaccagugcuaggacaguaaguaccggguucagagugggaacgggggaagggaaauauggaacaaaagaaaauguuuagcgaauaaagguaaagccaacauuucuuguauuugaccagaaucuggaagauuuuucugccuuauuucauuacuucagguuauuuaacaggaugaaauagggaaagauuuuuagcuugaucugauuuuuuuuccuucaauauuuuaugguuuuauacagucuuuacaaauccguguauugcuuaggucauggaaauuaaccucgaaugauuucuagcuauuagaggcaaagcaggaaagauaugauaauacuuuaucuuucuugucuauugugauagcuuuguuccuuguacuuuaaaaacugaaucauauuaagcacaauuaguuuuauaugaagaauuuaaaaucagguuaguauuuauuauucaauuaggaaauauaauuuacuuuacaaaggaauacaugugggaauuaaguaaagcuuucugauuacuaaagagaguaaguuuuucugaagagcuacauuuucucaauaaugaggauuuagccuuuuaaucaccuaauacuuuuuaaaacaucaccaaaucaaaaggcccagcagcuauguuuuuuguguucucaugucuauuuuauuguuuuguuuuuuuuuuucuugugguuuccucccuugcuguuaguuugguggaaaauauuuugcugucguuaaugugccuacucuuaaccucuucuaauaaaaaacaucuuuuucuuaaauagacuuggaaaccaaaaugacagcgguaguaguagugugugugugcacgcuugcaugcccgcgcauguguguauauaaaguuuacuauuaauuaaagcuuaagaaguuuaauaggaauaaaauuuaugaguuuggugguuucuuuaggcugcugagaggccuguauauuuaacuuuauuuuuugcuuccuuguuuaauuguguucuaguugaguaagguauuccuauauacugggagaacagucacuguaagacuuaaggguuacaguauacaauguaugaaaagaaucuauuaauaauauuuaaccuaauauuuauuuucaaguagauuuuaacaaugauuuauuacauggauuguugcuuaauauguuguuauuuuuccuccaggaucacgacgcuaugccauuuuuuguuuauucaaaaugggagcuaauguguuugauacugauguggugaauguggauaaaacaaucacagauauauguuuugaaaauguaaccauauuguaaguauuuuuuaaucuucagagaauaaaaauaauuuaaaauucuucuuuuuuaaaagaaaguucuuauuauugguucuuuggauucauuuuauguuuaaauguuuaagugaucuuuaaauguuuaauaugauuuuaaaaaucauuuuguucagaagaaguccauuucucuaucugcaguuuucugaugugaaauaaaaauggaaaucuuguaauuacuauuagcaguaaauauuugacuuauuagauaugacccauuuuuaaauuguuaauaaauauaguucaguuauuaacaaagcuaugcauacaacagaauauccuguaauguuauuugauauagagagaauuuaagcauaaaacaggauuuuuaucucauguaggauauuugguugcagaaauacuaaaauaguauagcaacuuuauuuacaagauaguccugaaguacaugcuauauaggaagagcacuuugaaauuuugggguguucuuuuucuuauggugcacuucuuucauguacuucaaagcaauaaaaaaaaaugggugaucucagggcuguuuuuauugucccugcucuuuuacaggcucauuuuauuguggucauaauacagaacaagaaggaacuccuuggguagccauagaaaucauuuuuaacuaacauaguuuuuccugcccuccuucaaagguucuaugugccuaaaucagugugggauuuguauuuuagacuuuuaaagacacgaucuuuagaucuaaauguuaauagcuacuaacuauuaauauaaaaauccaugugcaugguuuuugccauuuucagcuauggagcuagacaggugagauuuuagaggccuaguuuugccacucacauaacauuaaaaaaaccuauaguaaaccauauuuuguagcuucugguccagugucucauaguaauaguauagccuggaaaaauaaaaugcauuguucugaguuauaaguaguaauucaggccuucuuacaagcuguauugaaccaaaggaauuuauuuaggauccaaaacauauccccaaaugcuuauauaauugaggcuaaaaaaauuacuuuuuucuugguuaucugaauacauuuauuuccauuaucaacuauugcuagugaacuuuuuuuucugccaaaauuaccaguugaugggcccuuuucuucacaucauuuugcuauuguuuguuuugaucauggagacaaaaaucagacuuuuuuuuccagggaaagaacaauagaaguuacugaggaagacaacacaugauuuauaauuuuuugagaauucuguaaauauuuuaaauuguacuaaaaauaacugcugacaaauguucuacauguugaaaaaugugcuuuuuguuaugaugauuguuuuuaauaaguauucaauauuuaugaaucucugguuuuucucuaaauauugacauuuguuagucauuaccaggaauacugcauguuuaaaaguugccaaauaauaaacuauaaaaauagcuggaaguuauuccugggauuuuuucaaacuauagauuggccauuuauaucuuuaaaagucugugcuccauuuuuuaaaucucugaaacugauggaucuuccaucugcaaguaacaucugcugcugauggaccucuuuugcagucuuaaguauauuuuauuguuaguaacaccaccacagucuuuaaugcuaaagguaguucaaagguaguucguugugucugaaaaaggguaaagccaaucuuaacauuugcuaaaauugcagaauuuugcguauuuauuugauaaauauauaucuaauaccuccuacauuccaggccaauacuagauuaagaacacaaagaucacccagacagcacccauucucaaggaguucaugcuuugaaguacauuuuuccccuguauaaccagauaguaaaauguuauuuauaguuauuagguacaaaagugggggagggucaggggacacagugacgagugcacuauaagugacucuuuauaaagaagaaaugaaaacuaaagguuuagcagauuuuuuuuggaagaacagucauuucagaaaauuacacauauaaauaccuuaaaaauguauuaaaggaaugacaaggagaaauaguauuggcaacaaaaugaccaggguauuuuaugcuuucuuuaacaugccuauguauauauugguuaaauugaguuaagauugcccuaguuuugaagcugauaucugugaaaguugcgguaacucucucaggccauuuagaugcuaaauaaacacugagagauucugucucauuaacauacauuaacauaaacuuauuccaaauucuuauuuuuuuucccauaaaccuugcacuuauugaggagauuuugcaaucuucucuuggcuccccugcagucuuuuauuuauuuuaaaaagaaauuuuauuguguauauuugagguuuauaacacgauguuacaggauacauauaaauaguaaaauguuacuauaaucaaacagauuaacaucuaucaucucacauaguuacuuuuugugacaaaagcagcuaaaaucuauuuaacaaaaaucucuaacaugauuugauuaacauucaccucauguuuuuacaguacauuauaucucuaaacuuauucauccuacauaucugcuauuuuguguccuuugaccuauaucuccccauuuccucucccccaguccuugcccaugguaaccacuguuuuuuucucuauuucuaugguuuugagcucuuuuuuuuuuaauauuccacauauaauugagaacacacaauauuuucauuucuaugcuuggcuuauuuaacuuaauauccuccaaguucauccguguuguagcaaauggcaagaucuccuuuuuuaaggcagaaugguuguccguuguguguguguauacacacguagcuuauuuucuuuaucuguuuuaccauugauggacauaccuuggcgauugugaauaaugcugcauucuuauaguuucuucaauaucuuggcuauugugaauaaugcugcaaugaacaggggagugcagauaacuucacaagguaaugauuuuacuccuuccaguauaaacccagaagaaggacugcuggaucauguaguaguuucccuuuuaauuucuuuaggaaccucuauacugcuuuccauaaugacuccgccagcaguguacuaggguucccuuuucuccauacccucgucaacaauuuaucucaugccuuuuugauaauagccauccuuaugggugugaaguaguaucucauagugguuuuaauuugcauuuuccugauguuaaaugcugauuuuaaauguuacauaaacauaaaagaaugguauaauuuuauuuucuacugaguuaaauuuccaacauuaugaaugcccuuguuuuuaguaaugaagcagggccagacuuucagauaaagguggaaguguauaguugcuguacagaagaaucuucuauaaccaacacaccaaaaaagcuagcuaagaaacucaagacaucuauaaguaaagcuacaggaaagaaaauaaguucagugcuucaagaagaggaugaugaaaugugcuugcuccucagcucugcuguuuuguaaguuuuuaauacuguauuuauggugacauaauuauacauuugugauauuuuaaaguauuauaugugaaguguauguuuacuuuauaaauggaaaaacaucaggaaacaaaaacaaaacuuaguuguuugacauuuacucaacugagguauccuuaauacccuccuuuaaagguaggaaguugggugagaguguuuuuagugauuuggaauucuaauacaaguugaauaucccuuaucugaaagccuucagaccagaaguguuuuagauuuggacuuuuucagauuuuggaauauuuguauauacauaauuagauaccuuagggauggcacccaggacuaaacauuacauuaauuuuuauauacauacauguauacacacacacacacacacacacaccuuauacauauagccugaagguaauuuuccaugauauuuuuaauaauuuuguucauaaaacaaaguuuugacugaguuuugacuucaaacaucacaugaagucagguguagaauuuuccacuuguggugucauauaggcauucaaaaaguuucagauuuuggagcauuucagauuuucagagcagagaugcucagcuuguaucuaccaaaaaaaugaaauguuguuggaaaggaacuauguauaugucaaaguauuucuuuacauauuaaucuacuaauuaaauugcuguauguaugucaugcuuuauucuuauagaaaauauuuuaucucuuuuuaacaaaaccacauuaucauuaucauacuuaacuaaauaaaaaauaagucauuaauauccagucuguauucauauugcccaauucuggaaaaaauacuguuuugauuuguucaaaucggaauccaaacaaggucuacaauauuacauuaaagugagucuuuuaaguuucuuuuagccuacuacaauuuccuguccucuuuuuuucuugucauuauuuauugaagagacuaggucuuguagaauuuuccauauuuugaauuuaguugauugcaucuuuguggucuuuuuuuacauuuuuuucuggcccuuguauuuccuauaaccucgcaguuagaucuagaggacugauuagauucaguucucuuuuaggggaauaauauucauauuauuagauguacuuccuacuagcuucuaguaggaggcuuugucccacuuucaguaauguuaaaauugaugauguuaaaauguuagguguugccagccuaacccauccaauauaaaguucucuaucagucuuuuaucuaugguuuuuaacagccaaggauaaucauuuauuauuucauuauggauuauaauuuggugacuuuguauaucuguccugcauucuuuucuuccaaacuggaauucuugcaaagaacguguccuuguaaacucucuggauacaacuacaauaacauugguggaggaaacagaagaaaaaaaugccugauucuuccguuuacuagauuuuagaauauuaaguugaaacccuagcaaucauggaggugaucaguguuguuuuauuugaacucuugaauuuucuuuucuuuucuuuuucuuuuucuuuuuuuuuuuuuaagacaagucuggaucuguugcccagucuggagugcaguggagcucucagcucccugcagccucagccuccugaguagcuaggacuacuggcacaugcuaccaugccugguggcuaauuuuuguauuuuucuuguagagauaggguuucaccacauugcucaggcugaucucaaccucaugggcucaagcaauccgcuugccucagcuucccaaagugcugggauuacagguaugaggccaccacacccagccuugaauuuuuauaauguuuguguuucaaucugccauucucuuugaugcccaaguuguucaucuuugaucagugggaaaccguuaagcugacuucuacauccuuugacacaaccuaaucuuugauagcuuuuuugcuuucugacacaguaagauguuccccuuucaccuuguauuuuucugccaagacuuggaaacaccauuucuccaaggagcgugguuuccuucagauaccuucuuuaaacauuguauuuguuucuucacaaauaguuuuauguugauguuucuuuggaacacuguugaucaagcugcauuccuagaauuucuuugcauguuucgucgaguuggcucuucagcaugucaguaauuuuacuguaauuauaaaaagcaaaauauuuuagguauagauccuagaaaugccagucaucagaauuuaaugaaauuacucuuuucaugugauauauauuacaugcaaaauauacuuuggcacucuagcauagugucuuucaaucucuuuggauugaugcucaugcuaaaaaaauacauuuuacaucgugacugagugcacaguuauguaagcagauagauuuuaugaaguaauucuuaacccuuacuauuuacaauauaauuaucaggcauuuucuuauucuuuugcuuucaguuuuuuuuaaugcuguuuguaaaucauuaaauugauuucaugacccgugaaucagucccagucuacauucugaaaaacagucauagaagaugucuuuccaauguaaaugucauuuaaaaggaggcaagagaccuuuaauuuucuucucuuagaucuaagaccaucuuuaaaacuuuucugcauuaauauuauaucaaggauuugcuggaagguacuuuaauucagucauaaggugguggaauuaauucuuuuuaaugauuagauaaacaauucuauuuccagguuuaagcagguuuuagugcagaaagagaucuuagagauaauuacccaguucaauaaguuuuacauuuuuuaaguagcaaagcuccuauuuuaaaaaugacaggaccaguagugucuuuuauccaacuacacuauaugguagaaaaguuacauuuuccccucacuuucucauaugaaaggcaaagauguucauacacaaucacuucuuuuuagaaagcuuuucagaaacauuuuuggaguuucaugcaccuuuacagcauguaaaaacaaugaaugugcuucuuaaacaguuuaaaacuucauuguuuguccaugaauacucaauuuuuaauuucuguaauuuauuacuucugugacccaagagagauuaauuuacucugaguuuuuguuuuuccuucuguaauaauaauacauaauaauaucucaacuccauaggauaauuacgagauuuaauaagauaauucauggauuugguuuauaaaggaagcauuuuguaguaagcucuguuaccauuaugguuacuauuuuuacuguucccagaccagugcuuuuucuagggcuuuuuuuuuuaaacucaugcuaaaacuucacaguuuagaaacuugacauaggauuauaaaauguagccacauuuuuucauuuaaacuacauuuauaauuuuauaggaggucauuuaaaugauguuagaaacuauauuuaaggcugggggcaguggcucauaccuguaaucccaacauuuugggaggccgaggcaggcaaauugcuugagcccaggaguucgugaccagccugggcaccauggugaaaccccuucucuacuaaaaauacaaaaacccagccccagcuguagucccaacuacccaggaggcugaaguaggaggaucaccugagccugggagguugaggcuaaagugagcugugaucaugccacugcacuccagccuggaugacagagugagacccugucucaaaaaaaaaaaaaaaaagaaagaaagaaauuauauuuaaucuauauuucuuuuugaagccuagaggaauuuuugagaauaaauuauugugcauuaaguucuuuuuaauagacagccauauagaucuuggagugucuguuuuccuguucagaauuuuucauucuauuugguuuauucugaguucaaacacgaauuuucuuuauaaacauuucccccuugaaucuugcgugccauuuguuuauuugauaccauuaaagugggucaaaagauacaauaaaaccuuuuacaacauuucacaaaucauguccuuguaauaccagcauucuguugacacuguagugugaacccagagucuacuagguuaacucauagcccgggacuacucuuaccugaugcuuccuuaacugaccacuucagcaccaugguaggaguuuaaaaaucaggaugcauaaggggaucaauuuuguauauuuaagugaucuaggucaaugcgaagauuucuaauacagcuuuuagucuuuaaccaaaauggacacauauaaaaugauaaaauuuucccuaguaauaugauaugugaccaaauauagccguucuuccugacaagagugcauuuuuuagacuaccauuuaagccauuuuuuuuuaauaacauuccccuuccuccaaaaaaauguuguaacaauugcccuauuugauagaaaaaaaaauguagcugauuaaacuuuugggaacucaaaauuaggguuggcuaaaaggaaugagugugauguuuuagaaagaaaauguuauccugacaagaauguuuuaaaagugaggucacuguugguuuuggaagcacuggcauuguaguuagucauguuuuaaaaaugaagcaacuugaaauaucauaaaguauuguuugaucugaaagaagacagugaacauuuuugguaauuuuuaguaagcucccugauaagauucaucuauucauuuuauuguggaauuuagcuuacuaaaauuccuuuagccagauuuucccagugcaucuaauagcugaauuaacuauuuuauguuccuugauaacuauuuaguacauuauucuuuaaauauacaucauuuuaagcaaucaucgugugaaaacugguaaaauucagcaugauuauuuacuugacaaaagauguauuguuucuuaaaaauaagccacuaauacuacauuuuauaauacuacauuuuaaauaugauuaaaguuauaaaacaugcauccaaacacuuguucagaauacauggauuauuuauguuuugaggaacgagacuguuaaagauuuggugaugugacagaugauacaguuuguaaacauaacuaagaaguuacucaacuauuauauauaauuaauuaaaucauuguagaaaugauuauucagcaauuaugucauuugguaaauucaaagguuaauaggucccugcacucaaaauucuuccaguuuaguaaaauguagucauuauuuguuuuaaaggaaaaaguaucuuaaacuauuuauuaaugaguuauaaagccaauauaauacacuggggcucagugaguuauaaagccaauacgauacacuggggcucucuuuccaguauaccucuugcaagcuacaggcaagucaguuacauucucugaacaucaguuucuucaucugaaaauguggaacaaaauaucugcccugccuaccucgagcaguuuuuuugaaccuuaaaaaagauguugcuugucaaagugccuuaaacugcacauagagaugaaguaugacaaugcuuugcaugcaguugauuccuaggggugguuuucauccuguuaccacuuaaccacauuaaucauuugguuagaaaaauaauaggcccagugcaguugcucaugccuguaaucucagcacuuugggaggccgagguggguggaucaccugaagucaggaguuugagaccagccuggccaacauggugaaacucugucucuacuaaaaaaaaauacaaaaaauuaaccaggcgugguggugagcgccuguaauccuagcuacuugggaggcugaggcaggagaaucgcuugaacgcaggaggcagagguugcagugagcugagauugagccauugcacaccaaccugggcaacaagagagagacuccgucucaaaauacaaaaagaaaaagaaaaaaagaaaaauaauagaaacuuggaaauagaaccuagaaggaaaaaguuacucguaguuucuaaaccaaauaauuuuuaucauuucaagcugauauuuuacuuucagguuuuuaaaugucuagcuuugggggauauuuagacaauaauuauacugcacauucaacuuucuucagaauuuauuacagagucuuuacauaauuauuuugauggccacauuaucuguuagugggcuauaucauaguuuaacuguuuuuagaggaggcuaucaauaauuuuuuucauauuguuaugugucauucauuggaaauagagguaaauaucuuacauauuaaccuuaaaguaguuaaaagaugucuuagucacaaucauuucuuaaggcccaagaaaaaaauuuaaacauauaguuugguuaucacauaauuuuagucaauucugccacacaaauugccuucuaaacaugccaucucuccagugcacccaguacagaugcaaugaauaacauaguuucuuccugugcacacuaauaguguuuaacauucuacaguauauugaaaugacucuuccuaaagugaagacuacucaaauguuuuuaguggccaauaagaauaaauuacagugucaguccuaaaaauaaaacccaaaagugucuucauugucuuuauuucuguauccuaccauuucagauauuuuucuugauagacuuaacauacguguguuaagaauaauacaaguauuagcccaucuaauaccuugaccucucaguuucaugaccuugcaccaguaaucuuguccucuuucaauucaaccaucuaccccgugauuguauucuagaucuugucauuacuaguaauugcauguccucuguaaucuuuguaguagguaucccacucucuccaccauaucccacauuuccagguucuucccuucaguacucugacuccaacuuagcuuagaauacauaauuuacuguuuuauccuuuccuagcaucucucuucuuuugucauacuugccuuggaaaaacuccaaccuugguuaacuccuacuuuuaguuccuuugcacucguacucaugaggaauagaugaagaagcaagagaaaaacaguuauacuuccuggucucacuugagauacauaaucccuaaccuuaaguggguucccaguaugaccgagcaauucuacuguuucuauagucuucuacuuuaccucucuucaagguaaguauuucacauguucuccucucuaacugccaauauccucucucugccccucauucauagcugauaacuuuguuucauaugucauugguauuacugaaguaauuggaagagaaaaauauccuccauccaccaaaucugccagccuacccacaucugccucaguguuugcuguuuccuuucuugugaacuaccuucaccucaucuaaggccugucuacuugugcgcuagagcccacuucucaguuacucacaguaggcuccugcauguuuccuccccaccuauccuacaucaccaacuuuaguacggcaucauuucuguauacuuauaaacaugcugaaauaccuucaauuucauaacuauccuucauggaaaauaauuuuuuauuucauaacuauccuucauggaaaauaauuuuuuauauuccuaucuacuuccucuucugccauucucuauugaaccauuucaguuggcuuaccucauguuaccuccaucccauccuacagaaacuagucucgucaaggucaacagugaucuaauguugccacauuugauugucaguuauuggaguuccucuuccuggaccuuuugguauuaacacaauugaucacucuccuugaaauacuauuuuuauauggcgucuagaauaccacuuucuugauuuuucuuccaccucaguaaccauuuauucauugcuugucuccuuuguucauugcucuucauuuaauggagugcuugugucccaguauuugguccuuggacuucaccuaacuaacuuucauuaaauuucauguauauacugauaacucccaaauuuauaucuccaauaccuauuucucuucuaacuccagacucauauauccaguugccuggaugcaucuagauacugaaaacaaucucaaauaaugcaccuagauaucaaaaacagucuuaaacuuauuugccccaaacugaauucuuaccuccuuuaucuguuucucagucagccucauuucaguucauaacaauuccauuuuucuaguugcuuggaccagaagccuuggagaugucuuuaauucucucccugcuuucacauccugucuuugcacugaaacuuagagaauauaucaggaaucucaaccauuucucaccaccccaccaccaccguucuauuccaggccugcaacagcucuugccuggucaguugcaguagccuuuuaguuggugucuucauuuuucacuccuggccucuguagucuguucuccacacagcagccagaggaaucauuuaauuuugauacaagucagaucauagcacaugacucugcucggaaccuaccauuugcugcacaucucacuccaaauccaguguuccuuaccgugccccaccaggacugugguauugucugucugucugcccccuacuuaccuuuuggacaucucaaaucacucugccucccucacuauacuccagucacagugaccuccuuguuugucaaacacaccuagcauguacucaccuuagccuuuauauguauuguccucugccugaaauacucuuccuucuguucuucuuguggcuccuuucuuccuuucaggucuucacucaaguguuacuuuugcagauaggccuucuucuccuuuggccaucugaaauagcacucuccccugaccuuaaucccuucaccaugcuuuacuuagcuucaugggcuugauacaauuauauauuuuucuaucuauuuuucuuccuguauaagagaggaaaaauagauaaauauauaaauguauguuuacauauuuauacauucuccuccccuauuucguugauuguugucguuuuaacaccuggaacagugccuggcaaaugaaggcaccccacuuauugucgauaaucuuuucuugaaaauaacauauucugcccuaaagugcucacagugagucuacuucccauuauuuuaagugggaaacguuauaauguguuaucaauuuaaaacccccuucuaguuauuuuuuugagacagucucauucugucacucaggcuggagugcaguggcacgaucuuggcucacugcagccuccgccucccggguucaagcaauucuccugccucacccucccaaaguucuggcauuauaggcgugagccaccaugcccagccuacuuugauucuuucuccacaguuuucuuuaauacuucaacuuuuuggggauucauuaugugaacaauagggaaaaauaagagcuuauugugaaaggcacuguagaaacuuguucagaauaaaugaauaauagcagagaauggccacuugucccucucuuaguucuagcagcaguuaagauuuguugauauauagugaacuuuugaaaagccuaagugugagucugacauuauaccaauucagaauguaacucgaaaauguacucaugcauuguuuuguuuaaaauguuauguugaaauuuggagacagaaacauaaauuuuccuauauaaacauugaccagaaacacuggguauagagaguuaucuuuggucuguaaugacuauauaguaaaagccaagaggcauucuccaagggaguaguauucuaugaaguaugcuauuauuuauugaagugcaugcauacauugcauacuuacuaaguguaugcauauguauuuuuguaauagagacuuuauuaaggauuuaguaagaaacaaaggagguuuaugaaacauaacaccuagcauaauuaauauaaauucccaucagacaucacugucuucuauaucucucuuugucucucucuuuuaauauacucguugauguuuugagauuuuacugauuuggaaaaaaaauaaaaucaagaaaaucaugaaaaaaauuaggauugcuagcauagaaaauacaguuguugccgggcgcaguggcucacaccuguaaucccagcacuuugggaggccaaggcagguggaucaugaggucaggagaucgagaccauuccuggcuaacacggugaaaccccgucucuacuaaaaauacgaaaaauaagcugggcaugguggcgggcgccuguagucccagcuacucgggaggcugagggaggagaauggcaugaacccggaaggcggagcuugcagugagucgagauugugccacugcacuccagccugggugacagagugagacuccgucucaaaaaaaaaaaaaaagaaaagaaaauacaguuguuacugaacauaaauucacuuuuuaucaccacgaagugccaggauaugaaauucaucacgagaaauucuagguauuuugguaagagugcuauuuuaacguaaguaccacaaagggaacuauaaugaaaaaaauggaaugaguguaaugaagucauccauguucucacacuauagauaaaacccucaaaucucugauguagauaaccagaagaaggagauucauucugugaaaaauaaaaaaaguuggaugcuaaagugguaaggacagauuugaaucaguaaugugcuauuacaauaagaagagucacacaugaauugcacucaacuuugauuuguguagagacaacuggucauuuuaaaggaaagugaggaaacugggagagguugagugaggcucagaguuagcuaagugaaaaguuccagauagugggaaggggggauugguccauguggaacccaccugggugcucuagcugguauuuaucaaaauuagucuccuaccuucucacagagacugaaagacugaaaggcccuguuuucagcucuugguuggaacaaacaauaaauuauuuugucagccucgaguuuucucaagcaggcacuuuaagaagacaucuuagggaugcagguuagagcugcuagaaacaaugcuaguguuuguucagguccuuagaggccaagguugaggccuaguugaguaaaggacucagaggaucauggcuagaguuuggucaaaaagacagccuuugucccugggaaauuaauauaaaucagacccuaucauuccacuuuuuaucaacuuuccuauuacacuuagaauuaaauccacuccucuuccagggcucacagagccuccaggugagcucaucacucccuguauuuccagccuugcguugcaccaugcuugcugcuugcuugcugugcacuagccacacugguuuuccuucagcccucccuuugcagauacucacucugcuuggaauguuuuccugcauucuuugcuuggcuagauucuuuuaugacuggauaacuguuaacuccucagaaaguccuuccccaguucaccuaccuaccacagguccucaguuuucucaucuccuuuguuucuuucauagaaaaaguugcauuccaacuugcaaaugcugguauuugguuuauuccucugccuacuuuuuuuuucauucugccugcaucagaauguaaugcuggaucuuguuuaccauugaaugcccaucaccuagcauuggacuuggcacauuuuaaguguucaguaaauauuuauuaaaugaacggggacccuucagagaaacauuugugugaauuaaaacaaauaauuugcagauuuuuauugacaaaguauagagauaaacuugcuaaguuaauaacuugcaucguugaaaaaugucaucuauuauaucuaaauuuuuucuuuuuuguaguaaagcauucuugaauauacauucagaggcauuaaguacauucauguuguacaagcaucaccacccuccaucuccagaaguuuuucaucuucucaagcugaaauucuguaccuauugaacacuaauuccuccuucuauccuccuggcagccaccauucuagauuccaucucuaugaauuucacuacucuagguaccucuuauaagugaaaucauauauaguguuuguccuuuuaugacuggcuuauuucacuuagcauaaugucuucaagauucauccaugucguaguaugucagaauuuucuucuuuuuuaaggcugaauaauauuccauuaugcauauguauguguauauauacacacacacacacaccuaccccacauuuuguugauuccuucaucccuggauagacacuuggguuucuucuaccuuuaggcuauugucaauaaugcugcugugaacuuagguguacaaauaucugagucucugcucucaguucuuuuggguauauaucagaguagaauugcuggaucaguaauuuuauuucuuauuuuuugaggaaccaccaaaauguuuuccacagaggugguaucauuuuacauuccgaccagcaauguacaaagguuuuaguuucuccacauaccagcuaacauguguuacuguuuuuuuguuuguuuuacuaaucuuaaugagugugaacugauaucucauugugguuuugauuuacauuuccccaaugacugaugauacugagcaucuuuuuauguuuuguugaccauuugucaacaaaagagaaauagacauuucucucuuuggagaaauguaaugugucagaauguaaugcuggaucuuguccucucuuuggagaaaugucuauucacguccuuugcuuaucuuuaaaucagguuguuuauuauuuguuguugaacauacaaauauuuuguguaguaguagaaauacaaaaauacuuaaaacaugucuucuuucuuacuauuagugguguaaaguauaauuugcuagcucacacuacccuaaccuuggaaagugcugaggauaguuucaagacccauaaucugucuauuaauggaaaugguaaguacaguauauauuuuacuuauuacauauauucugucuauauuucuaauuauaguauguuccccucaaguggauaucggcuuaaauaauggagacaugagugauucuguugguucuuuaaaauauaucugucccucuuccccaaaggagaaaaguuuauuuuccuuucucuacacugagauuugcuugcaaggcuuagugggaaaagaagggucucagguaugcucaauccuuguuuuugacuuggaauuuaugacuuuaccacucuucuagcuggaaauuaaagaccugacuuauuuuuaaauuugaaaucaaggaagccagcuuuucuguuaguaggaagcagagaauguaagaaagagaaaggguuaaauuaucuuaacuuuuuucucuuuggauggcggugguauuuagaguuuaccuuuuucucuuuggauggcagugguaguuauaguuuauccaaaauaaagauacaggaaacugaagaagggguuuaggucauuaggaagauuuguaaaacuuagcaugagcacuugcuacucucccagguuauuuuacuugugaugaaaaaauauggagcagugcugguaaggcaguuuggaaguaugauuuggguuauuuacuuuuguucauuuucuccaagcaaaauaaauaaaaauaugugguaaaguccuaauuauacuuacuguuguaaggauuguggcucuguacugauaagauugauaauguuauaccaauuuuuuuuguuucacaaugagaaauuauguuaaaaauagggaaaaguucaugaaauguaaauauguaguuuaaaaaauaauuaugaggcuaggugugguggcucaugccuguaaucccaguucuuugggaggacgagaugggaggaucacaugagcccaggaguuugagaccugccuggguaacauagugagacccuaucucuacaaaaauaaaaaaaaaaaguagcuggccauggucgugcaugcauguaaucccagcuacucaggauacugagguaggaggaucgccugaccccagaaguucaaggcugcagugagguaugauuguaccauuguucgccagccugggcuacagagugagacccugucucaagaaauagaacaugucaagaaauagaacguuacuaccccuccuuucccucaguuacccuagcuguacauaugucuccauuuaucucuuagacugauuuaauuauucuuaauaguuacaggguucuucagcuuuucuauuucuugggucaguuucaauaaguuauguuuuuauagauaucuaccuauuugaucuaaacuuugagauuuauaggcauuaaauuuucuauaauguccuuauaucuauugaauuucugcagccucuguagcauuguucccucuuuuccauucugauauuugcuuucuguaccaucucuguuuuuuaauucucauucuuguaauagauuagucaguuuuauucacccguguguuccauauuugcuaauuauuuguuaggaguaaugauuguagucuauauacuucauauuacuacaagagguaugauaaaaucuccuucugugauuguggauuuuucgacccauaguuauaucuauuuuuacuguauauaauuugaaccuuuguuauuugaugcauguguuuaaauuguguauuuucuucuuuuaccucaaacuguacuuauuuuuauguuacaaacaugccucuucaaacagcauuauauuggauuuuaauuuuucucuaauuugacaaucuuuuuuuuaccgaagcuuuuaguccuuucguauuuaauaucaaauagcuguguauuuagguuuaaaucuaugauaaccuguguuuucuguuugucucaccuauuccgugguuauuuuuucuugccuuuuaaggcaauuuuuccuuguuugaauuaagguuauacauccuuuuucucauuuuuuagaauuuaccccuaaaaauuucauuaaucauacuuauuaaaaacuaaacuuaaaagauaguuuugugcuuuucucagacaaugcaaggacuuuagaacaauuaaacucuuuucccuaaccuaugugcuauuguuauauauuguaauucuuuuuuuuuuuaguacuuauuuagauuuaauauuuauuuagauuuaccuacauguuucugugcacuacuuguaucuuaugccuugcaucugggauacuuuucccucugcuugaauuauaagccuuagaauuucuuuuagugaguuaugcugauaucagacuucuuguucuuuuuguuuaucugaagauggcuuuauuuugccucauuauugaagauauuucuuaauucugcaguuuuaauuuuuucuuguugaauauugaacauauaauuccaacauuuuuggcuuuuauuauuuuacuauaaauguuguaaaucauuugccaguaugucaccacuaugaguguaaucuuuuuauuuauuuuugccuuugguuuucuaaaauuuuaccaugguauaauuagguguagaguuuauuuaugcugcuugggguuucuugagcuucuuuacauuguugauauguuucaucaguuuggacaaaaucucuccuaccuguuugaaacugccucugcuguuguguagcuuuuguucuuuuugcaugccuguuaaaccuauguuagucuuuuucauuguauccuucguguuucuuacucuuuaugauguacuuuucaacuaacuuacagauuuuuagaacauaagcuauucauaaaucugagauugccuauauaaagaaauuugcuuucaaacuucuaaauuuacaaaucacaaaguugauuucagauguauuacugaaauacaugcuuuuacagaauuuucauuucauuugcugccuguuuuaggaaagauaacuuuuguuuauuuguguuugcauuuuggaauuguauguauuaugcucgugcauuuauuuuucccagauuaagccccuuauuucuaaaauauagcagcuuuaaaauguauuaaugaaaaagauuugaauagucucagaacauuguuguguacuauucuauaguagaaucuuggguagguaaauuuaaaacuuuuugguuuuacuacaaaccuuugcugccuugcauguauauauuaacuauuuuuacaaaaaaaauucugggguaauuaaaacuuuuuggugaauaauaguuacggccaguagcuagcgauuuuguaggcacuaccaacagggcacagccaaaacuuuaaaaaucauuuuuaugugauccagugugaacuaagggccauauguuugguuuuuauuuauacucugaugucuagaauaaauuauuuaaugcuuuccuccauauagauagguaguacacagguagguaucuucauuaaaggacuaucuuaauguuuuuugaaguaacuuuuuuaaacaaugucaaacuuacagaaaaguugcaaguugaaugucaagauuuuuuuuuuuuaauuagagauggguaucgguauauuaccuagucuggccucaaacuccugggugcaagcacuccucccaccuuggccucuggaguagcugggacuacaggcagacaccaccacacucagcuuaaaugucaagaucuuuuuuuucucaaaaaaauuaugacagcaaguugcuuacaugauagucuguaccccaaaauguauuaauacauauuuccuacuaucaggacauucagcuacaucaucaucacucuugaagucaagaaaugaauacuaauacauuaccaccauauaauccucagaguccauucaagauguugcccauugucacaauaauguucuuuauggcagagggauacaaugcagaaucauacauuucauuuaauuaucaugcuuuuuaauuguccuucaaucugggcuacuucuucauucauugggcucuaauguucgaugucaggcuccucuucccaggcauaucucuuuuacccugcuugcucaagacagagucccaaaucuaggcugcgccccagugucaucacccucucaggcccuucaggugcugauaccuccugcaggcagccccugcuacucaccauucucauucugccugucuccaucauccauuucuagcacaccacagcuccuucuccaguccuggcacagauguucauguugggggcucuaucuaauggcuuaugacugaauuguucagcaaaagaaggggaggaggaagggccaaaaauguugaugaaguuaucuuaaguucucugaaauaauguuuuuuguuuuuguuuugcuuuguuuuugagauggagucuugcuuuguugcccaggcugaagugcaguggugcagucugaguucacugcaaccuccgccuccugggcucaagcgauucuucggccucagccucccaagcagcugggacuacaagcaugcaccaccaugcccagcuaauuuuuguauuuuuaguagagacaggguuucaccauauuggccaggcugaucucaaacuccugaccucaagugauccgccugccucggccucgcaaagugaaauaauguuuuauucagaggaucacuuuucuaauuauuauaaugaaaaucagaacaaaaaguagaauuugacaaacauaaauuacuuuauuagaauguuuuuauauuaaaugagaucacuuauauucucugaacaacuuucauugaauaauuaaaaucaaacaagagacuaaacaguucauuuuuauucaggugauagcaugcuauaaacugucaguuuaauauuauccuguccuuucuauucucauauuugauuuucucacuuaauauggcacugguauuuggguaggaugaaucuuuacaugaaacuaauucuaaaauauguucuguacaaagcaaaacaaaauuguaaaaagagaaaaaucaaaauguaugaugaccuuaaauaaacuuauauuuauaacuugauuuuuuuuuuucuuucuccuuuaaauagaggagucuucauuuuggcuuccccuguauggcaacaugugcugccgacuaguugcccagccagcuuguauggcugaggaugcauuugcaggauuucuuaaucagcagguuagaggacuuuaaauauccuacaacaauuguagcucuacuuuaaaucuuaauauacaggcaguuguuucaccuucugauauugagaaguauuuuuuaagucuuuuuuuaaaugucaguuuucuaaauguuaucagauauaaacuguagggggugcggggugaaaagaaugacaagguagggagggaucuacugcgauguugauggcuaaggcgcuaccucuccaugcuccucugcuucauuaauagcagcaacaggauaaucagcaacagagggcuccguguggaaacugaugagggcugcucaacaccuuucacauaaaggucuuucuggcagacagcguuuggcacgguuuaggacucugagcuuccaaagcugccugccucugugccaccuacugcugauuuauuuauaaccauaguuauuuauauucaguaaauaauuaauugugaacuucaaugaaucaauagcuuuuucuaaaagauuccauuaggaggaaagaaaauuugcauucuuaaaggguaguugacauuuuccgaugcucugagaacaguaagggaaaauaauauuuugaacauacagaauuguuuuuauaauuuuccugagucauuugaugaauugcuauagaauucuaagcacuaauuuuuaaucgacuagcuuuucuaaaacaccauugaucuaugguuuuauguguguaaaaguuaggugguaaucguugccuccauuucacuuaaugccuuuaagaauuccaaacuuuucuucucugauauuaacauacucuuggauuuggggcaauuaaccuuuuguauaucaaauuaauggauaauuccaucacauuuuaaaaauucuaaauaacuaauuuaaccuugauaaguauuuugauguauuuaaagugauaauaacuuaaaauugauagucucuugauuuuuuuuuuuuuuuuuucagcaaaugguagaaggucugauuaguuggagaagguuguauuguguuuugcgaggagguaaacucuauuguuuuuacaguccagaggaaauugaagcuaaaguggaaccagcuuugguaguacccauuaacaagguaaaggaaaugcuauuuugagaaaaaaauauacaucuuaggaaguuuguuuuugucugugcaguuuacauuguuguugucuuauaaauaaaagagaaguacugguaaaaacagguuacuucauaaauaugauuuaaucuguuucuguuuuucuauuagagcuuaucuguuauaagaaaauguauauuuccuaagaaaacauaguaauggacaucuauaccaguaaauagguuuuaaggcagagaauguaacuccacauuagcaguauauuuaaauuuuuuaugaauuuacuuaagagauuaaacauaaauuguuagcucauguuauuauagugaugcuguuucuaguuagcauucaaaugaagccauaaaaagacauucuugacuauacuuucugauuucuuaugggauugauaggcaauuguccagucuucugacagaacagaaaagccugacaguccauuuagaauaguugagugcuuauacugcauuuaaaaaguaguaccacacuaccuagaaaauuugucaaguauauauauacugguuuguuacaaaggagacuauugaaaucuagcuacaauuuuuucaucuagaauccuauaggaaaacuucaauauaaggcaaacuuaguuucuucuaccucacggucuuaaauuuagcuuugucuguuauucaagucuaguguugauuagaggauuuuucuuuccucauuuuuuagagcauuccuacucuaaaauaauugcauuucuaaaccaaaauaucaugguuuuugccugugggcugccccuaauuguuucuaguuguucuacuuugcuugucuuugguguaguugaagugugugauaaaacaugagccaucacauuuguucuccuugucuuugaaauuauccuuuaaagaagaauguaaaguuguacguccuuuuauauaauaguuguauuccugaaaacgcguggguaccagucuacugaucuauaaagacuugaguuuaguuucaugaucuuuuccaauaauaacauuuuugucuguuucuauuccacuuuuagaaauuacacugcuuuuuacuuacagaaagucuuuuagugagaccuuuuauuauauaaauucaccuaauuuaacuguuuuguuuaaacuguuuuguuuugacaaaucaaggacauaauacaucaguauuauaaugaaucuauuuuggcuuagaaaauuaaguuuuugaaauauauaauuuuauuaaugaaaaauugacaugcuuuuuucauuacuugccaacuuuuuauuuuguuugguuuaugcaguguuguauuuccugucgcuuuuucauacuuuagucuuuugaaaauuucagauggaaaaauugaaacagaauaaugaacaccuguauaccauucaucuagacuuuucagcuguuguuaacauuuugccacauuugcuuucuuucuaguuaaaauuuuuuucugaaccauuuuaaaaucaguugcaaacaacguaacauuucuucucugaauauguuagcauauuucuccuaaaaccaaggacacuuuuucauaaccauaauauuauugucaugcucaaaauguuuauuguugauacaauauuaucuaauauacagaagaaauugcucuaauuguccccaaaauaucauuucuaauuuuuauuuagugucugauccaggaccucaucaaggauccuauagugcaucuggucagcauuuccuuugauuccuuucaucuaaauugugcccuucaccuccugccuuuauuuauuuaugccuuucauuacauugacauuuuuuaaaaguccaggccaguuuucuucuuagaaucucuccaaaucuauauguaacuaauuauuucacuagauucagcuuaaauaauuuugguaaaaguucuguguauaugauuaugucuacuuuggcuuuuacuaaauagcugaggaguaaaaaugaaauccuacuaauuuuuuucuuauauuuuauaccauagaauauucagucauaaaauaaaauguaaucuaaacaaaugauauuuuugaagucauuaguuuuauuugaagacagucucgaaggaauucaacucgccauaucucaguccuuuaagguaggcaaagcagggaugacagcccuguuuuacagguauauuauuucuuuuacaagugaagaaauagucucagagaucagauagaacuuuccaaacuaguaaggaaaauuauauggcucacccuuuuccuaaugaguaggaaaaaauagauaaaaauucauggacuguuuuugcuauuuccucauaggcguacugcuagaccagauuuggaaggcaaaauuagacuuuuuccucucuucauaucacuguaaaucaauuuugaaaguuaaaaaguagcuauaaaaugagguucugagcaugaaaccacagcagacuuauaggcgauggcuuaggcauguguguggaaacuuuacgauuuaaauuuaagagaacauuuauaauaaaacuguguuauuguagucagugugucuguauuuucagucugaugacaaggaucuaauuccagaaaaguggugacaauguuuauauggccugacugaauugaccuauuuuaauugauuuacuuuuccuugugguaauaaaggcugauggccaggugacuaaugagauuuuguagucaaucaguggcauuguaagaugacugaagucagcagacuugcaaauuccaguguuucuuccacaauuggccauuacauaucacaggaaaauuauuaauuuaguaauuuguauagauuuagccuuauacuugaagacaaugugagcuacauuugaccuugaggacuggugacuuaauuaucucuuccguuguacauaacuucugucuaaaguacaaaagagcauuuuaaaauuagacauaaaauaagaguuaagguuggaaagauauauuuauuauuauuauagaauauaaauaaauauaauuuaauuguuaaucucaaagaugaaacuggugacaaaguauucuguuuuccuucuuugcaauauugccaucuuaauuuucuccaguguugguuuccuguguuuuucucuuuagaagccuuuuucucuuuguaguucuucuacuucaggcuuccuuugaauuuuuccauucaccugaaaacuucccucuuaauagugaauucacugaucuccuuauugaaaaaaucaagcacuaucccagucaagaaauauauuuguuacuuccuaaaacaugacuguuauauaauuauuuuuccuuuuaaaguaauuuuuguuuuuucuuaacuuacaaaaugauucaaauguacagaaaaguugaaacaaaaaaaaccauacugauggcccauauacauaccaccuagacucagcaguuaacauuuugucauauuuacauuaucucuuugauuaaaucuauauuuuuugaugacccauuugaacauaagacuuugauaucaugauacuucauuccugaauacuucaacauguaacuccuauuaauaaaaauagggaccuuucauauauauacauaaucauaauaccauuaucacagcuaagaaaauuaaaaauaacucuuaugucaccuaauauucaguccauauucagauuucccauuuucccaaaauggccuuuuagcucaggucuucaguccaggauuauucagggauuaugcauccucgacaauucuucuaauuuguaaaugaggucuagaggcuugauuguauuuauguaaaauauuuuuauuagaauauuuuauggucgaucagacaaguacguuauagagccucccguuaggaggcucaugaugucagguugucgccacuacuggugaugcccucucuccaacauaaucuucccucuuuacuauuagcaaguagucagugaggagacacuuuggcacugugugacuguguuuguuuucuaacaaucuuucacauaaugguuuuagccaccugugauugucuuugccuaaaucacuuauuacacggaagauucugggugauuuucucauacuacuuuccuucuacauauguccuuccuuuuggcauucuuuuuguaaagaaguuuuucuuaucaacuagggaugaauuacagucucuugugaaaaggcaggauaaauacuugguaucuuaauugccaauuuucaggguaagaaguuggugucauguauugguauagcauugguauugguaauauauauuggaguugauauuacucccuccagggguagcagaugaguguuaucuuccucccugcccuaccuucacugucucauauagugauaaauuaauagguuuuuaucuauucaguguuuuaaauuacuugguuuuuaaaucuaauguagauauuuugauuguuuuucuuaccuugcagauuuguaagggagacaugcuauuagcguuuucuuuuugguuuuuuguuuguuuguuuguuugagacagggucuggcccugucucucaggcuggagugcaauggugccaucacagcucacugcagccuccaccucccagacacaagggauccucccaccuuaaccucccuaguagcugggacuacagguacgugccaccacaccuggcuaauuuuuguauuuuuuguagagacaggguuucaccauguuacccaggcuggucucaaacuccucggcucaagcaauucugccugccucagccucccaaagugcugggauugcaaguaugagccaccauacccagucucuuaguauauucuuuuuuuuuccuauuuauuuauuuauuuauuuauuuuugagacagagucuuacucuguugcccaggcuggauugcaguggugccaucuuggcucacugcaaccuccaccucccagguuccagcuauucuccugccucagccuccugaguagcugggauuauaggcaccuaccaccaugcccggcuaauuuuugaaguuuucgcugugcccuguugguagugccuacaaaacagcuagcuacuggccauaacuauuauuuaccuaaaaguuuuaauuaccccauauauauauauuuuuuuuuuaaguagagauggaguuucaccauguugcccaggguggucucgaacaauguauucuuaaauaaacaaaggauaaaaaccaguuugguauuuucugauacagcagguaaggaucaaguaaaacuuuuaagaauaguguuccucggcugggugcgguagcucacgccuguaaucccagcacuuugggaggucagcacgggcggaucaggagaucaggagaucaagaccauccuggauaacagggugaaaccucaucucuacuaaaaacacaaaaaauuagccaggcaugggggcacacgccuguagucccaguuacucgggaggcuaaguaaggcaggauaauugcuugaacuugggagguggagguugcagugagccgagauugugccacugcacuccagccugggugacagagugagacuccaucucaagaaaaaagaauaguguuucucuuuuaguuuuuaguauauuucuaauggucucuaagaucuuuaagcuuaauaauguuaaacauuaaauacaaaucagaguuuuuugucuuuugauugucuuucuucuuuucucaugaaaauaauuuuccuuaaugcuacuuaaaaauuauuugaaaacauaaauuucacaauugcuaagguauauaaauaauaguucuguuauuuagaucacaggaucuguucucaagcuauaauucuuguccuucuaaauggcauuucuuguaaggcuaaguuaguucauuaauuuucauagggagccaucuguggaaauagucacauuaagggaagaaaagccuaagagcuauuccccucccauugucaauccaaauuugaaagggugauuuacuucaaagugauugcuucaaauucagaaaacuucacaagaauguucuugagcaagacauucucaauaacagguacuuaacugaauuuccuacacauuauagaaagcauuuuguuaacuaaagcuuuauccauugucaauauggugaggggugugacgguuaaaaaaaagugugagucuuugagaucaagccuuuucuuguuuuaaauauuauauacaucauucauuuuaauaaaaucuguacuaaacaagucaauaacacuauuuaguguaguagacuuuggauaaauuguuuugaaaauacuuuuaacuauuauauuuaucauagaaccuagaaagcaaaauuauuaugaagcacaugggauuuuaauccaauuauauuaguuuccuuaauaucuaaucauaucaacuauucagauuuuuaaaaguaaauauagcaaaaauaauuuuucaaacauuuuccuguaggaguuuacaucugauuuaauuaauauaaauuuaaaauaauuauauuaaacugauacuaaucauaccucaugguugguuuaacuuacagcuaugcauuacauauuucaaacauuccuugucguauacaugaagauauccuuuuuugucauuagaguauauauaaagucuaaagcuuguuuuuagcaccaacauuuugucuucauugcugauuaacaggacuucagacgaagcacuuuucaaauaacucauuuaucuuuacagcauguuuguaaggaagaugugagauaucugcauuacagccaagaaagaggcauuaauaauagacugacuuugguuuuuguguuuguauuuuauuuuuuaauuauuuucuuuggaaaaaaauucaagguaauuuauacauagaauaguauaaaugaacccauguguacucucacacauugcccccacauuagauauauuuugaagcaaauccuagagaccauaucauuuuacuuguaaauauuccaauugucacacuuaagaaaauuuaugguuuuauauauaaguugucauauguagauauaauuauauguaguuaauauaucguuaaaaauccaggcagucuuuaagaucccuagucucaauuuuuguaaguuuuugaguuaggauccaaauaagggccacauauuaugguugauugauuaggucuuuuaagucucuuuagaaaaaggaaugcucauacauuguugguggggguguaaauuaguucagccauugugaaagacaguguguugauuccucaaagaccuaaagacagauaccauucgacccagcaaucccauuacuggguauauacccaaaagaauauaaaucauucuauuauaaagacacaugcacacauauuuucauugcagcaccauucacaguagcaaagacauggaaucaaccuaaaugcccaucaguggugggcuggaucaagaaaaugugguacacauacaccauggaaugcucugcagccauaaaaaugaacuagaucauguccuuugcaaggacauagauggagcuggaggacauuauccuuagcaaacuaacacaggaacagaaaaccaaauaccacauuuucucacuuauaagugagagcuaaaugaugagaacacauggacauauagaggguaacaacacacucugaggccuaucggagaguguggagggugggaagagggagaucaggaaaaauaacuaauaguuacuaggcuuaauaccugggugauuaaguaaucuuuacaguagacccccaugacacaaguuuaccuauguaacaaaccugcacuuguaccccugaacuuaaaaguuuaacaauaauaauaauaauaaugaauauguuggcuuaugcucacucacaccucuaacuccccacuucaaacacacacacacacacaccauagacaauuuauuugcugaagaaauugaucuuuuauccugcaggguuuuuccauagucuggauuuuucuaguugcauaccuggguugccauuuuucuuuucuucuucuuuuuuuuugagauggaguuucgcucguguugcccaggcuggagagcaguggagcaaucucggcuuauugcaaccucugccucccaaguuuaagcgauucuccugccucagccucccggguagcugggauuacaggcaugcgccaccacgcccagcuaauuuuguauuuuuaguagagauggguuucuccgcguugguuaggcuggucucgaacucccgaccucaagugauccaccugccucuuccucccaaagugcugggauuacuggcaugagccaccgcacccagccugccuuuuuucuuauauuuuuggaucauauucagauuuguugguugguuaguaagaauacauuuuaggaagggucauauacuuucaucaagaagcauaucauauaucuaggucuuccacucaucuuaacaaccacugaugagcauuguuuuagauccuuuauuucauuaaggauuacaaacugguaguauuuuuacauucguuauagcuggaaugccucuacuucaucagcuauuugguuacccugaaguacaauucuuauagggaagacaggaaaagugcuugggguuuuuuuuguuuuuuuguuuguuuguuugcuuguuuguuuuuucccauuuauaugucaguuaccaaaacaaugagaugguuuccuaccaucuuucacaggugaccaaugaguucauuuuuaaauaucguuuugaauuuuuggauuuaaauacaugucaugugucuguccauugccauugcuauucuagucaauguucuaaucaauguccaauguuugacuaguagaagccccuucgaguugacucuugaauccuuuugacauaacccuaggaaucuuagauuucugauaggacaagauguuccagaaucaucuuauacauuuccuggcccaggcugagagucagccauuuauuugaaaagcucugauguuuuuaguaaagaguauuuagagaccauaaucugggugcauuuuuuauggucguauagucaaaaguaacauauauaauuuauaaaucuaguccugaucuaguaauuuuccacguauauggaaaugaagaggaggaaguacaguuuuaauucaaaauaauaauuuuuaaaaaccuaaaugaaacuuuccugugacuuuagaguuuauauuuuauuacaaaauugacuucccaguuuauguuuuuauugacuucacuuggcauucucuagguaacaacaccaucucauggagugaaaaauugcagacugacgaaaagcaaauccagcuacagauuaaaauuacacagugaauaaucucaaaucuauuuacaaaucaagaaaaguugacuauaaaaccuccuagguaauugaaguuuugagauuagcaaaaacaauacaggaaacgcugggcuuaauagaauaauucucacagaacauguuuccucauaaagaauuggauuggagauuauuucuaggaucugggucuaucaauacaaaacuuuuuaaucauuauuugaguuguucuuuuccuguuucauuuguuuauucuuuaaauauuuuuuagccauuuacugaguacuaggcaauauuuuagguggcagaaauaugggggggaggcagggaauuaccaaguuccuuguuuucauacccuaagaggagucacuuauauaaacacauaagcccauaaauaacaguccuaaaauucaccuuaguguuuucuaaucacuuccuuuuuugagaauugaagacgugagaacuauuguugauauuuuuccacagugaaaaaacagcuugcaugaacuuucugacacucuaagaaacuuuacuuguauuaaucacuuuuucuucaacacgcauuuuuuugauuaaaaguuuuccauuaaauuauuuuggaugauaacauauagaaguuaauucaaauucugcauuucauuugcaccuuucagaaaccucugauguuuuaaaaauguagugauauuuauggcuaccagaauuaauggaguauauacaguaguauuuauauauuuuugcauuauauucucuuagaaggauauaaaugauugaguucaucagauuuucuauguagugguuucauaugaaaugauaccuugguaaaaauauccaaauucaucuauaaaaaucaaauuucccuuauuuaaagauugaauccacuuuaauccuuuauacaaaaaguagucagaaauguuuauuaaaauggaauugguggagggaagcacaauuucaguaacaagaauacuuuuuauuuuauuuuauuuuguaacacaauagaggguuuuuccccuacuaugauuuaaccuucaauuagucugauaagaguagcauaucaaagauucuuccuagagcuuaagucauucucugcuugugauuauaagcuuuauauuuacaguggaugauuaggugcaucguugagcuccaaggauaccauuuagggcaaaauuuguuacauaauaaaaauaauuacuuaaaagaacuaauucacaaaguuuauuaccaagacauagaaguguaaaaagacucuauuaugauaaaauuaagauacugggcguauagucaaaaguaacauauauaauguauaauuuuauacucuauuaugauaaaauuaagauuacaguccucuaaagacacucacauuccuagauuucuacugugacaggauagacugucucuaagaugguuaaugauuguuauauuuugugauacucuaaagguucaaaguuauguugcugcuuuauacaacauacauuuuuccccugcgguguuugaauaagaauuuauuccuucagaagggaauuccuuguguaguauauaugguguucaccugccuguauuuauccauuuuucagggaauggauagcuuuucuuccuaacccugcuacuucuguaaugacuacauaauauccauauuguauguauauguggguuuuggugugugacuguauagccucucuucacacuuuacucagugaagaauuucuuucuauucuuaaucagccuuuauuacuaccagccaaaauauuauugucacacauuacaguaggcuuaaccaugauucucuugaaccacuauguacagugcaguagccacuauccuggagugacuguuagacacuuacaauauggcugguccagaucgagaugugcuguaaguguaaaauacaaacuggauuuugaaggcuuaguaugaaagccuucaacauauuucagauaugcugaguuacaugaaauacaucguuaaauuaauuucaggaguuucuuuuuacuuauugugguuuuuagaaaauuuucaauuacauauguggcucacauuguacuuauacuggacagcauugcccuagaauaguguaagugagucauuaucuaggcaucaaaucucuaucuuuguguaauagauaguucuaguacagacuuuaucccccaauauuccuuggucaaagccacauguaguugccagcuuaccauguggcauggcugugccugugugugacuugggaauagacuucucagaaucuucuaaguauagaaucaauaagugucaucauaauagcauucuaguaucacucagaaaaaagguuuagacuaucagcgugaaugaaaccauuguccuugugguaguguuguacuuagcacuuuaaaaauaauuuaaacauuuuaaagauuauauuauuuuauggaucuuuagcuaugaacuuuguaaaugaacguuacguacaaaauaaauguuaaugaggaaaaccuguuuugcuacaguaaacacuaaguuacgguuuuacugcuuuaacugauagcacuagauauuaugcaugaauauuagaauaagaaagauacuuuacugauucuucuguuuuauuaauuugaaauaugguuaacauguaauccacauuacagcuaugacaugcuguacuuguuuuauuggaaauuuuaagauguauauaaaagacaguaaacuuccacuuaaacugagauggaucaaaacagggguuauguuuuaaucucauguaauuuagcauaagugcuauauauagcauaauuuaagacauuauucaguauuuuauauaaagcauucuuuuuuaaaaaccuagauuggaguuugaauauaaaaaauucucaaaauuacauguuuuaaauuucaaaugaucagcaauaagauuaugguuacaucagguauaaauaugguagcuaagcaauaaaacauuuguuugaucauuacagaaauuuucucaugcaaaaccccaauuuuuuucuuaauuuuuaggaaaccagaauccgggcaauggauaaggaugccaagaaaagaauccauaauuucucugucaucaauccuguuccuggacaagcuauaacucagauuuuugcaguugacaauagagaagaucuucagaaguggauggaagccuucuggcagcauuucuuugaucuuaguaaauagauauuuggauuuuuuuaguuguguauuuauguagccuaaaaggaugugcacagcaaucuuaaaauuguaaucuuagaguuuguagcaaaaauuuuuuauguucuugaaagaaugguaguauaucaucaaugcacugaugcuucuuucugucaaucucuuuccagugccugacuauuguauaguauacguuuggauucuagcaucucuaccuccuacuuuuugaagcucccucuggucacuaaaacaaccagaccauauucucucaaaauguuaggauuuaacuguugaaggcaauguguuugauccaagggauaagaagccauuugaggaacaaaaaacuuuuccaggauaaugaugauccuaaaauauugaaacauucaggagucucacuuuguagccuucccuuaacuccagauucguuaucaucuucuuggacaucauccagacagguuucuuuuuaaaccacacacauaggauuuucucaucucaauaauacaguccaaugacauggacauaaaaacaauguaugguaauguaauagggcucuaguguauaaaauauaugagguucuaauauuucucgaggaauuuuaucaacaggaaaauacugaaaucguaacaguucuuuguguuuacugacaauaagucaaacagcauauuaucauuauauugaaaauguagaauguugauaaugucuguuucugaucaaacaaagccuacugauagauacuaccaguauuuugucuacugaauccuauuccauagaaaguugagacauuuccaaaaaaggaaaauuauuucugcaacucauggaaauaauccuagggacagacauuuuaggaauucuguuuucuggagcacuaugaggaagaguuaauacuugcagcccucaaguuagaaguuggguaagaggcaagaaagggaucuaaauuuauggauuauuucccguauaacagauuauuucauuuauuucucauaacacuccugcgagguagaaauuauuucccuuugcucugaagaugagaaaacuuaggccugaagagguuucuguuucacagcaucgaacuagaggguucccuccauggccuucuuguauuguuuaggacuuguuuuccuuaaguaucaucccuagacacucaauaaauguucaaauauucauuucaugcuuaucagcguguaccacauuuauuuaguuaaaauuuucaggccaggcacgguggcucacgccuguaaucccagcacucugggaggccgaggcaggcggaucaccugaagucaggaguuugagaccagccugaccaacaugguaaaaccccguaucuacuaaaaauacaaaaauuagccaggcgugauggcacgugccuguagucccagcuacuugggaggcugaggcaggagaauugcuugaagccaggagguggagguugcagugagccaagaucucaccuguauacuccaaccugggcgauagagcaagacucuugucuuuaaaaaaaaaaaaaaaaaauucagcagaucucagguguauaacuuaaaagacaagaacuuccuugcuuuugcuaaucauagcuaaaacuuuaaccauuuuacuaaauguucugucuuagagaauccgucuuauaaaugacuaucuuauuuuuagaaaugauuuugguauuuuuauuuguuuuauuuuuauuuuuauuuuuugagauggaguuucgcucuucuugcccaggcuggagugcaauggcgcaaucuuggcucaccgcaaccucugccucccggguucaagugauucuccugccucagucucccuaguagcugggauuacaggcaugugccaccacgcccaacuaauauuguauuuuuaguagagacgggauuucuccauguuggucaggcuggucucaaacuccagaccucaggugauccgcccaccucagccccccaaagugcugggauuacaggugugagccaccgcacccagcuauuguauaauuguuaugugcauaaaaacaggaggagagguaaaugaaggugauaauaccagaaucuuguagucuagauaucaacuacuauuagaugaucaucucaugcuuucauucucuagauuaugugaaauaauuuaucaugcugaaauggagauuugaaagaauaagaaccucaugacauuuuuguacugucaacauaauaaggaagugaugacaacuugguucucgggucugguuacauuuuugguauuuaaugcuuuuuugcauaaaaacugccaaccuauguaauuuuuaaaguacaaauucuauuacauuuauacuucaaaauucagaauucauuguguauggauauaugaagcaaagauggagguauuuauaccauacuaaaaauuugacuuguacuuuaaaauuuuaacuuuccuagugacaggugcaaccucuugugauccugguugaaguaugguauguagaacaaaguacaggauagguauucagggcagaauaaaguaagagaaauuuaauauugagagcaaauuucaauuauuugacucuauuuaagaauagaaaaccaggaaggugagauaauuagaacucaggaggaaacacuuacggaaguagaucuguuuagcccagggaagaauagccucggguggauguuggugggcaagggggauguaauagcuauuuuuaacauuugugaguuaacagucauguaaaagaggagugacccauguucuggauggucaauaggaguggagcagagaaugguaggucaaagauagagaaaauuaagguagauuuggaacauuaaauuuuuaaaaaauauuuaacaauauaaauauugaguuacauuaggagcuuagcauaaaaaauuauuuugacugggaacacuauaacaguaaaugguauuuuaggaaacaucuucaauauauaaauuguuaugugaacaaaacauacccauuuaauauuucauauugcgcccuuguuuucauguuagcauauuggcuaucauguauagcuaugcauagagauuuauuugcuggcaaaauaaauguuucagucguaaagucuugacccaugaacacguuuauaccucugacuuuaguaacacgugaaauaauguggcauuauauuccaguuuucauuguaacucauauucugcuacuaguuuaacaaugaaaugcuuucauuuaucgauauagaggaaauacuguacuuuauaauaguuuuucuaagaaugugacagaaaagugugccaguuugaaguguuucauuauuuuuccauuagauauggguuuuuuuccugccccuaagaagaaaaaaacuggcucuuauauauuuaucuauaaaaggaaguguggggaggaauaaguuaucagaucucagauccuacuagauguacauucuagagaucaaccuuugaagccuuguacucaagaauuuauucccuuuaucaguugcuguguggcuuauuuugaaauuuuuaucauauucugugcuuagcaucauaauaaaacauacugaaaggcuuuuuuuauguuucuuaacuaauggugguggauuuuuaauuuaugcauauauuaucauauuacuaugagaguauauucaacuacaaacaacaaaaaugaguaauuuuacuaaacaugaaguguccuuaguuuuuaagucacagaaaauaaucaaguuggguaugaaauacggauauacaacauaaguguauuacauuuacuuuucuauugguauaagauaggcuauaagaaggugaaccucaguaacuaacucuuauaaaauuaauauacagauacguaggaacuagcauaguugcuauccagcaugcaggugcacaauaaguaugaaaagauuaaauuuuuagacaucacucaggagaaaucuaaaaaauuuaagauuaaaauagugugaaacauaauuaaaauaaaaauuaauguccacacucaaauuuuaacuuaauaguugaaagauuuuauucaagacuauuuuuuucuuauuccaaaugccuuuauuuaauguguccuuccuaaaacaaauuagacucagaauuuuauugggugauaugacuuuauaauaauagguuuuuauauaccuuuuaaaaccuaaaagaaaauacaguguuuuucuagaguuaaaugauuuugaaaagcaugauaaucaucuuaaagggacaguuguuaaauaaauaauuuuuauuucuuaaucaaaauuuucauaguuaaaaccauuuuugaaaaccucacuccuuuauguuuuuuucuauuuccuucuagguaacuauauuucaguugauuguuuaaccuuucaacaucuugaauacuuaauguuuacuauucaaaagaagaaaacccuucccaaacuuuugcaauaaauagaaauuuuaaaguaguuauuaaccauuuagugaaauaggauaguauuuaauagccuagagauuuuagccuaaugucuuugcauagaaguacuucuuuuucuuuuuucuuuuuuuuuuuuuuuuuuuuuuuugagacggagucucucucuguugcccagucuggagugcaguggugcaaucucggcucauuguaaccucugccucccaaguucaagugauccuccugccucagccucccaaguagcggggacuacagccaccugccaccauacccagcuaauuuuuguauuuuuaguagagaagggguuuccccauguuggccaggcuggucaagacuccugaccucaggugaucugcccaccuaggccuuccaacuugcugggauuacaggcaugagccaccgugcccggccaaacuuuauuuuuuaaauagauuacuuuuauguucagaacuggacuuugaaauuauggauaguauuagguuuuucugcaagccucccuuaacgcagugcuuuauguauaaauucacugauuuuuauucaaagcaaaaauguauugcuaucuauuaaaaaugaaauauauaucuucacauuuauguuuuaaacuagucuaccuuuuuucugucugucuuaggccaauggaagcacuguugugaagaacuuaugaaaauugagauuaugucaccacggaaaccaccuuuguucuugacaaaagaggcaaccucagucuaccaugauaugaguaagugggguuugucuuuucuaagcugcaggauaacaaaaacaacauuguccauacugaagcagcuuauucuauugacauuaaaaugcuaaaauuuucagggcacaaucaaaauaaaugaaaaaagacugauuauagacuaaggaacucauguuuaauagaugaauuaauacaaaauaaugaauacacguuuuuucauagucugaaugcuuaagaucagacaaaaaauuuaaggcuuaaaaugaguaaaggugcacugaaaauaaauauuagcugaguagcugaugaaaauucugaaaauaaacauuugcacauucuaaaauguaaucauguucaguaauuuuuuuucuguauuuuauuaaauuuguuuccaaguaguguugauagaugcauacuaaugaauggaagcuuucaucucuagccagaaaaaagaaauugguuaaguuuaauacuuuggaaaauuuuaaauuucuagacccacuaauauucaauuucccacaccuugaaggguguuuauuuuugugcuguugccucaguaaauaauguugugaacaagugcaagucagucuaaauucuguuuaauuugccacuaauguaccuguacuuacauucacuuuaaaaugucagguuaaaaaugauacauuuggguucacacauuuuaaaauaccaguaauuuauuuaauagagauuuaucucuguucuuuuauuuuugccaaggaaaguuucacccaccacccuuauuaccaaagugguaugagggcuuuacucuguuuuccuggguuuuugguuuuaagcauuuucccuuuuaacagagacuuugcuggucuacaggaaagaauacucauccaaaugcagucauccuaauauauaucuagcuuuuguaaaaaaggaaaucucuuaccuagcagucagaauaagguuuuaaauccaggaaauguuaucucauaaauacuuaaucuauagaauuuuuuagaaaacucauauaacuccacuucuuugaaagauggauuuugcuaauuuauauaggaauauauuuauacauguguauguauuauguaaauuauauguauguuauauauguuuuauauacuauguauuauguguauguuuacauauauaauguaugauuagugcagcgcaugaucuuuuuaguucugauggugugguuauuuuuacaagugaacguuuuccuuaucauagucuuugaugaccauuguauauagcauacuaguuuggaaaagaacuuauuuagauaaaguacauacugcuuuugaauuuuuucauguuuuuuuuucuuaaaauuauuauaggcauugauucaccuaugaaacuugaaaguuuaacggauauaauacaaaaaaaaauugaagagacaaaugggcaguuccuuauuggucagcaugaagaauccuuaccaccuccuugggccacacucuuugaugguaaccaucaaauggucauccagaaaaagguacuguauccugcaagugagccauuacaugaugaaaaagggaaaaagagacaagcuccccuuccuccuucugauaaacuuccauucagcuuaaaaucacagaguaacacagaucaauugguuaaggacaacuggggaaaaacaaguguaucucagacaucgucuuuggauaccaaacuaucaacucuaaugcaucacuuacagaaaccaauggcugcuccucgaaaacuucugccugccaggagaaauagauuaagugauggugagcacacagacacuaaaaccaauuuugaagccaagccagugccagcuccaaggcagaaauccaucaaagacauucuggacccuagaucauggcugcaggcacaaguauagaaaacucuuaaugauaaaacauuuaacaaaaucuauaacugugaagcuuaauucagaggcauuauagaauaauguguaauuauauagguaaauauagugauuuauaccaauaauuaauaagcuauuagguauagaaaaacauuuuauaaugaagaaguggauuucucuuuuacuccugauuugcagaauguaagugauuucuccagcagugugcaagaggcaguuucuagacaauauccuaauuguuggaaggguuaauuuauuccugaauuaguaccaggcagugaauaagcccuaggcagaauaaagcauuaaaauuucuuuuggggagagacugucuaguaauuuaaaauguguuaaauaugaaccauauucucauugugagaauuuuaauacuaauggaauguuucaaagguuuuauucaaaccacaaauuauagaauccacccaagaaaauuuucuuagcauucuggaauucucaucuaaugguucacuggcucucaucuauuguuuaacucacuaguuuauaggccugaccuuuuaaauuccugggauaaauuuuagaauauuaaauucuucaucuuuaaagggaauuuguaaugugcuauucaaacuuguuuccuugaugagcccugaaauacuguugacauuaacuuucauaaaugaagcauaacacuuacuaguuuagagaaaugguagaugaaaugcucuuuacauucaauuuucuguguguggugcuaauuuccauugugacuuuggaauuuagggaagugaguagcugaucaacaccuuaaaauucauuuaauacuuauuuaaaaagaagaugagagauucaaaaauaucagaaaaguuggccaugguaaauaauuuucagaauucuuuuuuaaaauuuuaauuagauuuccuuuuccuaguaagaguugaugucugcuagugguauuuuucauuaaaugucauauucuuacaacagugacauuggaaucauuuccauaggagguaauuuccauagcaacuaaucauagugacccaaacaggauuauaaagucaagugaggaauaaauagcagaaaaauaccuuaaaggaacaaaaaauccauuuuuuauaauaaugcuuuuuguaaacaagagcagaacaguuuuaaaaaucuaauuagaauuuccaaauaaaacaguuuccauaaggugucagcaacagcacuaaaaaucucaaaucacacugaacccuaaaugucauugcaagaaauaaaaauuuaagaauuaaauugcugcccuguguauaaucucuugagaucuuuuuaaagcuagcaagaacucuauuuggaucagaacuacauuauuacaaaacaaaaugaacacuugaccaaaaaaccacauuaauuuaaauggagccuuucauuauuuucagauagcggggucuuuuccauuuauagagaaugauguaacugccaggacacuuuuguguuugcccaggacuccuaguaagaauugaaucuugagggaguaaugauaacaaaagguuucuugugacugguaacaucaggacagacagaguuuuuggugagaagaaaguacuauaugccugcuugauagcauguagagaucaucacauguauggaaaccuuaaaaaguaaacuuauuuuuucuaacuagaaggcucucauaaguuucuguuaugauugccauuucaauaaaugacauuaaaaaucuaaaggauauuauuguuugaauuuuuggguuauuuuuuaaaacuucauugcuguuuuugacagcauuugugacugucauugccacuaaauuauugagcuagaagaugcugcagggaaaauuguuuugaagcuggcaucuaagcauucuuuuuuuuuuccuaguugaugccuuccuuuauuacaaaucaguauuaaaacuuccagauuauauucuugucauuuuuccucaugcagauaacagcaggaaggacuuaagguguauaagaaaaagaaaguauucauacagaaauuaccuagcaguugugcccucagaguagaacuuugaaacaggacugaagcccuuuuuaccuagaaccauuuaaaagccugagcaaggaccaccacccccuccccaccaaauuauucggucucuuucuggggggcccagcuuacuguauguuacaagucuuugaaaugggucuggugucuucagcuccugaaaugcuaauuuaccccuuaccuaaggaguguaguuauaauacagaguugguuuccuuccuuccuuccuuccuuccuuccuuccuuccuuccuuccuuccuuccuuccuuccuuccuucauucccucuguccgucucuccuucccuccuucccuccuuccuuccuuuuugucuuuguuucuuucucuggcccccuguccucucucucugucucauccccuuuucccacuuuccuucugucucuccuuccucccuuccuuuacaguuuaaaaaaaaaaucuaaaaauaguuaagcacugugucaaagaguguuucaaaagaauuguuuguuuucucauuucuuaaaccagaaguuuaugacaaauaaauaugccauguaauaugaaagcugcuucagcuuuuuaugagcuuucacauuccuuguuuguccuuuuaauuuguuucuugauauaugaagacuauaaacuugaaacaaagaguuagcugucagcucuugauaauauaauuggggaaacagaauagauauuuuaugauaugauaauucugaugaucuaaagauaaugucuuagacaauuaccuuuacauuucaagcucugggauauaaauuacguagucagcauuaagauaguauuauuuuuaauugcuacuaagugguaacuuuuguauuuuaauaucuugcaagggcaaagaaggcauuuuuaaaauucuaaaugcacaccuccuaagguaaauagucuuucaaaaauaucaggcgugccaacucuugcugaguuuuguuaaauccuccuuaacugucugcagugcccccugacuucuuuuaaauggaugugaauauauguggaaaacuaaauccauuuauuauaaaugccuuaucuuuacccuuugggaucuuacuaaaugcauuuuaccugcuacuauuuauuaaaaauggaagcugucuugaauuagagauaccucacguaagguagguuaagcagucaaguauuucuuuaggcuuauguucagcaccucagcccccuacugagaaguuaauuaauucaguccaaaaugaaauuauagggcaguuuggugcaauuuauguuaaaugccauuugaauguaaucaccuguguuaccacgaaugaggcacaacuauacuacauggacagaguacugcauugcaccaugagcaagaacugcucugcaagaaaaauaucugucccuguggucugaauuuaucaaaacucauuuucuuguuaaagagugaauuauugaauaguaauuaaacuuuaacugaugaccauuuauauucuaguagccaucuucacuguuagucuuaaauuauaauguaaaguugacauuuuccccuuacauuucaaaggcaucacuauuuuuaaauguuuacauauguuuacauguuugugugcaacugcuucauugcuauuaauaguuaaaugaaaucugcauauucuggaucauagauguucuuaguuaacucugggaaagauguuaccuuuggguuuuuaaaagacaagucaucauuugaaaauauauuaggguguguugauuuucugacaugcuuguguaauuggcuuuguuuauaauuuuuauuuuuuaauaugggucagacuuuuggauuaaaaaguauuauaucauggacauacauuuuuuaaaguaccaaagguauuugguaagcgagcccaagucauguaauugaaacuucuguacauuaaaagaacugauucaugaagacguuuucuaacuuuuucucuuuaagugcuccucuagacuagacugauugaaguagacagugugguggaaucaguuuaaucagaaaaagacauaccaaguagcuggugcuaauuauuauaagacuaacauucugauaagccaugguauaauuaacauuauuaaaauguuuacauauaauccuucuuaaaguauacucuuuuaaaaauccauugacauaaccuuacuuuuaguuuagugauccagaauuuccccagagcuuaagccacugcaguaaauuagguacguaggauauucagucgcuacuagccacaaggagucuccuuauuuuaauguaccucccucaguacuuuauuccugcagagcgccucagagugggggagagaaaugagcaauccuggcucaguuggauuauuucagcauuuuauuucuaaaucuguagugugaucagaaauauuuaaaauuaaaaaaauacuuuacagagagaggccuacuaaucaaugugcuuagagaaacaaacuaccuuuacauucaauuaacaacaaaaaaaguuacagaaauuuuaacaaacauuuuucuuuaucugaguaugggagaaaauacuaaugcugacacguuuaauaauuagaaaagaucauuccagaucuuauggaaaauuguguuuuaaauuccagcaguuugcucuugagacaugguaaucucuuaauguaacuacuaaaggagagguagauugaaaagaucuuguauauacauaauuaugucagaugguucaagauaucaaaauaaauuguuuuguugaaaaugaauacuuuuuggugucuugcuuaaaaauauuuuuauauuuuguuuaucuacucaaaauuaugaauggaugcauuuuuguagaacuuaaucuuaauaaacauuuaacugaauuaguuguagcaauuuuauaauuuuauauuaacagggagaauaguaguaagaggaauuauucacuuaccucaaauauuaaaauguguguuuuauguauauaaaauauaauacuauagauauaacauacauacauacauacucauacacauaguguguuagauucuucagguauuuucaguuaguuuuaaaaaauucuuuuaaaauaugcuuccaauggagcagaauaaaaauuucaaauccccuuccauaguuuacagaaaccauuacaacccagcuccaaccugccaugcccuacuagguacuucacucucaguuccugugcuuguaggacuagcuguuggcuaggggucacucuuagcuccuagaaacugugcuccggcccuugcuaguagccccuucggucuucaaagucagcaacagugcaucaagccucccucaugcuucaaaucucugacuauuucagcugcucccaauugaagaaagugcuuugcuuuuaaagggcucauaugauuaaaugaggaaugcccaccacgauaauuucccuuuugaguaauuccaggucagcugauucggaaaucacuuuugcaugcaauguaaugaugggugugauaucucaucgucuucauggguaaagagccauugaauuagagccacuggagugcuauuuuagcaggcuacccaccacaucuuaucagauuuuucaagggcagaaagcauguuuuauugacauuuaacccugucauaguauacuguaaugagagugaguacagcuuauuggguaauauguguaagauacuauacuguguuaaauauuuuauauaaauuaaucauuaccauauucucucaguagccccccuuaacacacacaagaguggaagacuugcucugggucauauacugcaugguaguugacuacggacucuggaguuagacuuggguuaaauucuagcucugucaugacuuagcuauaugauuuggggcuuuuuuuuuuuaaccucauuuggguuuuuuauuuuaauguuuaagauaaaaaaaaaccuuauaauauaguuguguuuauuaaauaagguaaugcauguaacacauagucuaggaccuaauacuuaaguuccugccuuguuucuauagguugacauauaguauguaacacguguaugaagagggaagaggauacagcugauagagacccaacacacacacaguaacuuagucacuuauaaccccucuccuauuuucauuucuugcuugaugugaacauguuaggcucacagugcauaaaaguuuaggaaauaccuaaaaguguauccaaauacuuauuguucauugucucuugaacucuauauuuggcacuauuggggcuuauaaauuaaaagacagccuauucuuaagcucacgugaauuccggugaguagaaccaaucauuagagacuauggagaugaagcaugguuugaccugccucccauauaucuaacauaaaucugucuggauacaagcaaucccuaccugccacugggaaacuuagguuauaaagauuaaaaaauacauaaaacacugugggcaguaugaaagaguaaucaguauuacacaauuuagcaucucauuuuaagugcugugaaagaucugugacggauugaguuaaggcugggcacgguggcucaugccuauaaucccaguacuuugggaagccaaggcaggcagauugcuggagcccaggaguucaagagcagcuugggcaauguagugaaaccuugucucuacaaaaaauaauaauaauuaaaacauagccaugugugguggcacaugccugcagucccagcuacuugggaagcugaggugggaggauaacuuguaacuugagccgagaguuccagcugcgaugaacugugaucgagucacuguacuccagccugggcagagugagacccugccucaaaaaacuaacgaguuaagaagugcaaaaguauauacuaugaauaucuugcaaagauauaaggauuaauaauaauaggguuuucaaaucuagaagggaugaguaaaauagaagauaauucauccaauggguuccuggaggaguuucauuuugcagcauucaaagggagguuaguagucauagaaguggaaaggaaugaauggauaaggcaguuggcugggcagaaauggaaugagcguauugugaaguaaauuguagguaaaacaaguaggcaugauugaagcaaauguggcaguaggugagagaugggauaugcuggaccacauaaaggaccuugaaugcuaguucaagaaaguaagacggguuaagcuggaauaguuggcaucagaacuagagcugacggaguuaggagaaugagcacucagccccuggcuaccauuaacuagccacguugucuuggacaagguauuuacucaccuguucaacuuccuuauuaacauuaaacaggugaguaaauacuuuguucuagacaacauggcuaguuaacaacugggauggcuacugguguuugucucaaauugaucuagacagcccuaagucccugaguugaugccuuuggagguggcaaccaguagggugaugccaggcgagggagucucuggaucucuccuaauucggccaaagcagcucuaaguuuaucuguuuuauguuuuaaccccaugagguaguauuuuaacaauccccauuuuacagauuaguaauuggaggcacaaaacaauuaaguaacuugcucacagucucccaguaaguggagacaggauuugaaccuaaucaguuauugaagaaagugcucucauccucaguauaccaacagccucugauaaacgugaaauagcaaaaaagcauugagaccaagguuugccagacuagccuccaaacucuuuuuuccccaauaauguggucacuugauguauuccuuugcauuaaagcccuaaaugaaaauccauuuccuucgcaauuagauccagccuauauuauucugugcauaaugcuuggcccuggguugaaggaacauuugagcauauguaaaccuagauagacuccacugucaggcugcagaaagcacuaaaaaaaauaugaaugagaggaaaagauaaauucuauccagagacaucugggacaacuagaagaagugguauuugaaccagaccuugaaguaugaguugguuuucauuaauuacauuucuuuagguagaaggcaacagaaacuaacuuaagcugaaaaugaagaaaaaaaaaaaggugggugaauuuauuuauuuuaagaaaaaaaaaaaaucucuguugcccagccuggacuacaguggcgugaucuuggcucacugcaaccuccccuucaagccagguucaagccauucuccucccucagccucccgaguagcugggacaacaggcaugugccuccaugcccagcuaauuuuuguauuuuuaguagagaugggguuucaccauguuagccaggcuggucuugaacuccugaccucaggugaucugcccgccucagccuuccaaagugcugggauuacagacguuugccacugcaccuggugggugaauuuauugauaggcuauuggaaucacucagaagacugaagaaugccuaggaaagguugacaggaaaacucagggguccucagcaacaucaagauugaaagaauacagucuguuccucuccuagcuuguuagaauggccuuucagagucaugaguuggacauucaaaaugaaucacagaacauaauugccuagaacuaugaucucaaccaggggugauuuuuuuugcccacuacaaaacauuugacuaugucugaggacauuuuuuaucguugcaacuaggggcagaaguugcugcuuguguuuggugggaagagagcagggaugcugcuaaacauccuguaauacacaggacaagauccccacaacaaauaauuaucuagcccaaagcauugguaaugccagaguugacaaacccuggcuuggaauaccaaauaauuaccaucuaaaauaacaaguguaguuaaaaaaaaaaaaaaaaaaguaggaaauauggccgggcgcaguggcucacgccuguaaucccagcacuuugggaggccgacgugggcggaucacaaggucaggagaucgagaucauccuggcuagcauggugaaucccccgucucuacuaaaaauacaaaaaauuagccaggcgugguggcaagcgccuguagucccagcuacucaggaggcugaggcaagagaauggugugaacccgggaggcggagcuugcagugagccaagaucgcgucacugcacuccagccugggcgacagagggagacucagucucaaaaaaauaaaaaaauuuaaaaaauuuaaauauauauauagaaaauauagugggaaugaaaagaaaggaaagcucuuaggagacauuugggaaggauuuuuggaggaaguaacaguugaacugggucucgaaagacguaagauugauugggcuccgcggauaugggaaaaagcauucugagcagcaggaacagaaugagcaaaggggugagagcaggauggugauuuagaauacguucacgaacucucugacacucuucccuucaaagguggagcuuaguucuccuccuauugauugugggcuggacuuagugauucauuucuaacucagagaauauaauggaagugauacucugugacacaugaggcuaggucauaagaagauagcacacccuugcuguuucccucucuuggaucacucacuuagggggaagacaguagcuauacucagacagucccgggagagauccauguggaaagaaacugaggccucucaccaauaaccagccccaacuuacuagugagacaccuugacagcagacccucaagucuaggcaugacugcgaccuucugagaaauuccaagccagaaacgcauggcuaagccgcuccuaaauucuugaccuguaguaacugauaauaggaaaaugaaugcauauuguuuuaaccacuaaguuuugggguuguuuccauuguaauugauaccuuaaaaagcaugaaaauauagggucuaccuaaaaacuugaaacuguuucauuuguauaugguuagggauuacugagaaauaagguuaauaaggcagauguggucagaucauggauggccuugaaugucagucuaaaguuugcuuuuuuucugguaugcugaagaaauuugccauaugggcuuuaguggauucagaucacaucucugacagauucucucugaguaguuggggcagggauagcuacagauaguauuggggagcauccucauaaauuguaucuagaagaagaaaagcagccuguaaaugccaccacuacacguuaaguucaccgagggcacaggccaguuuuuuaggcaugcuuugucaauauaaguaugcugagagaaucacaccucaccugacuugauuuaaaaauuucuaaaaaggaaaaaaaagugguucacauauauccaggucacuaaugugacacuauugacuugauuuuucuugccuagcagcucuuuugcaaggggagggugacacauuaaauugcauccaccugugacaucuuaaggugacugaauguguguaauucucuucaguacacaaaaggaaaggagaggccugagggcucugaagggugacacagaggggugaacagauugaagggaggaaacuuuaggggcuucaggcaaaccucauuuacauguguccaaggacuuugaauggagucccugauuucugcuucccucugaggacuauucaacugaacuuuuucccuauguuuuuucuuuuuuuuuuuuuugugauuugugaugccaaaaguguuccuuaaauagucacuuacaagaacaaagcugccgucaucucugaaucagucacucaaagguuaucugggaaaucagaauagugugccugguauacuucaacaucuuuguuguauuaggcagcaaagcagcccaagaaauuaaguuuaguaaaacuuuggaauaauuuggagauaauaauuccacuuuagaccgauuucaacccagaucaauuacuaaaauaaaaugcuuaggguggagaacccagaaagcuuuggacuaaaugaaccacaagucuuaucaacaccagugaaaauaguauguuuaauuuuuuugccauaaacuuccugggacgcaaucaauaacuuguacuauuaauaaaauauuuugggaaaaauguacucaaccaacuuauugcuaguccucaucauauacaggacucugcuaguugccugggcaucugaggauggaggaugaaauuaguuggauuuauucauaggguuuaguuccagugucagaaaaaaaaaauguuuuucugaccaguaaccagcaguaaaauaaccauuguacaaugucauacuuuuagcagcagaauuguauuuccaaacaauaguuuauguagacuuuuaauacauaagacagagccaaguggaacuacuugagagcgggaagggguugaggagcacuuggccucccaccaugccucuaccccacccccaccccagcacucugagaagcuucucuauaggacacacgucuucugucaaggggcagaaagcuacuuuccuuauugcuuuaaucuccuuuucauuccgcuacugcguucugucuuccuccgugguugaaaagucuccauauuugucaucuucaaaacgagauaagguucccucaucaaucuuauuuuuaguaaaucaccaguuuaacucaccuuucuuuagcaaaaccuaacuacauauacagaaaggaaacuuuuuuggaacuucucacucucugaaugcauuaaguagaaacauuagcugaauuguaaaaaaugccccuaauguaaaacaaaacaagaugaaaugaaagcauauacguuaagaauaugcaagacugagagcuccagggcaggggagccaaggcauggagcaaacaaaggcaaaggcacgauagcccagcucccucccacggcccacaccauacagucuccagccauugcagugcugaaagcacacuguccuggguucaaauccuagccuugcuacuuucaccgacuggccuuuggcaguucaacuuaacucuucuaaggcccaggcccuguaaaaugguaaucauaggaccacugcaagaauucaauaagagguuauauauaaaaccguaaaauuccaagaaaacagcaaauaaucaauacauguuagcuacuguggcuauuacuauuaucccaaccccagagguuguucugggcacaagaagcaccugauauacuguuuuggagacuccccaaauugggguggcugcaaggugaggagucagcagucacauguaacugugccaugaauucagaugucagguuaaccgggucucuuccuaaaggaaccaaaccaagaauuuuuuccuuugaugucucaccaugauuugaaacugagucaaugucuuugcuaaaagcaaucuuuuuuuuuugagacggagucuugcucuguugccaggcuggagugcaguggcacgaucuccauucacuacugcaaccuccaccucccggguucaagcgguucuccugccucagccuccugaguagcugggauuacaggugcccgccaccacacccagcuaauuuuuguauuuuuaguagagacgggguuucaccaacuuggccaggcuggucucgaacuccugaccucaugaucugcccacuucggccacccaaagcacugggauuacaggccugagccaccgugcccagccugccaaaagcaaucuuugaaucaaagcuggaagaacugaugcaaucaauauuccuuaguuugggacugacuuggugccugaguaccagucaacuuggaggaucugccauacaaauuaugaggguuuuuuuuuuuuuaacuguggagguccuauuuuugauagauuauagaaauaaggagugacaagucaagcugucaugagaggagagucaucuaaaguuaguacugaaaacagaaauuuggcuggcaaauuaguuagaaaagggaggcagaacaaugggaaaauuuuuugcaagauuuccugggaguuggggauggugaugauggcaggggcccuggagugaccgcuuaccaauuagugguuuaccuguuaacuuuggcagauguuuuaccagugaaugguaagauuucuaauugagcuucaggcaagacugucuagugaaaacuauacuucuauuuacucuucaguaacuaacaaggccuguuuuuuucuuuacuuaguucuuauuugagaucuugguuaagaaauuauaaaauauaaauagaauauuagcgacuuggguuauuugguuguugagaaaggguucucuagagaaaauauaauuucauaacugcaguacuuauucaauuagacuaggaaggcuccucagagguaaucuacuucaaccucuuucuguaggcggaagccaugcucccaaccaaucauauucaugaauauccagccucuguuugacauuauucuuuaagguuguuugcuuuuagaauuuucagcccauuucuuguaaguuccaguucuaagaaaggcuuuuuuacauauuaagacaacucauuuuuccugaaacuugcaaucuuuuccacugacugccuuuugugauucugauugguggugacuuucugguuuucucuuuaccucugugggugacuaaaggugauuuuuuuuguuuuucagaauaauaguaaucaacuacauaaucuccagaaacugccagcaacuuccaaauuccucuucacauagcuucucaaauacuucauuagaaccagugugaaaaauuuaaaauacaaugugacauuucucuaguagaauguaagcuucaugagggaaaagacaacgcgucuccuuccuguauuccuagcacccaguacggcaccugacacauaauagugaccuuagaagaauauuuaagagucauugaguaaacauuuuguagagcuguccauguuuauuuuccauucaguguuuaccaggugucugcuauuuggacagucacuucauuguucauuaguacaugacuuugguaaauauaucuccugugaagagaaauauuauaacuacuauggcauucaacacugguauuucaguuacucaacuaauccacccacugauggagugaaccuugaauuaaaugcuuugaagaauaaagugaaucuugauaaaaaucaaaggcugaagaaaucuuguuugacagaaggcaugaacaaaaaugcuaaaauuaauacuguuuguggagaaacacucauuccaccgcagacuaaauggaguucaugaguaucaaaaugccuaugugaucaaaaggcagaaacagcuucuuuuuacuaggucuguuaauauuccaggacucauaauauugugccuacaugagcaccuguguuugugguaacucaaaguauuugaacaccuuaucucauccaaccucaaauuuccugugagguauuuaagcaccgagagcucuugguacuguuuucaagaugaagcagaugaauuagagaggcuguucacacaccaaauuucacagaagccuauggaggaaaugacggggagacuuaccaguuaacacccaguugcagaaaucaaugucagagcuugaaaggaccuuauaaaccccugauccaauguggacuuuccuaguaagacuucuguuugcagugacuugguucauuucaccaaccacaagaauuuuaaguaauuuuuaaucauaaaaguaacauagaacauaguaauacauauauacguacauacaugauacagaaagguaucaaaaaacaaaaacauauauuacuuccuccucuaacauuccagugccaguuuccaaagauuccuauuacccagagguaaccacuguuaauaauuuuuaauguauauuuccaaaaauuuuuuaugcauuuagaaaugugugcaugugggugaugggugcaccaaaaucucagaaaucaccacuaaagaacuuacucauguaaccaaacaccauguggucccccaaaaaccuauugaaauaaauaaauaauaacauaauaaagacuuaauaaaaaguaaaauaaaaauguguacauguauacauacacgcaaugacaguugguccucaaauaacaucauuccauucagugucauuucauuauacuguugauuggaaaaaaauugauuucugcccggggccccugucuguguggaguucccauguucuccccaugucuguguggguuuucucuggguauucugguuuccucccacaucccaaagaugugcaugucaggugaauuggugugucuacauugucccagccugugugggugugugugugaggugcccccugcuaggguauggcguccuggccaggguggcuuccgcuuugcacccugagcugcugggguggacucuggccacccucaacccucaucuggaauaauuggguaauaauuaucuuguuuuuauuaaucuuucuuaaaaguauauauaguucgcauuuauuucaguguuuaauauuagaaguguuuuacucuuuagaaguuuggugauguuuuugugaccagaaauaugccauaggaacuuagcucuuguuuauaucaauuagccugcaguaauuugguuccauuguguguuuccuuaaagcugaaguuuccaaguaccuacugaugacguuaagugaggacuuaacuuguguguugcagcuccuauuaaauugcugcacuuggaagcauaguagucauuucaaacuuuaaaaagaucuucugcuauucuguuccaauucugaccuucucacaguuuuauucaucuaguaaacaccaacucgauccuuccaguugcucaggucaaaaccuuuaagucaucuuugguuccucucuauccaaaacaccaucuaucuaauucaccagcaaaucuuauugaguauauguuaaaaauaucuccagaauccaaccacuuaucaccaucuccauugcuuccacccuaacucaagccacuagcaucuguugccugaauuauuacaauagccuucuaacuggucucccuacuacuacauagcuuucuacugucuauacucaggauagcagacagaaggauccugugaaaacacaagucaggucguauaccuuccaugcgcaaaaaacauucaaaugcuccccaguuaauucagaguaaaagcugaaguaaaagacuguccacagucugcugaccccauuaccuauaugacuuaaucuccugcuacucuagagaaacuucacucucuuuguuccacauauacuggcuuuugcgcuguccugaacaugccuggcaugcucuugccucagggccuugcacuugcuguuuccucuuccuggaaugcucuuacaccaacuaucaucacuucauucaagucuuuuuuuuuuuuuuuuuuuuuuuuuuugagacgaagucucacucuuucgcccaggccagacugcuguggcgguauccccacucacugcaagcuccgccucccagguucucgccauucuuuugccucagccucccaaguagcugggauuacaggcgcccaccaccgugcccggcugauuuuuuguauuuuuaguagagacgggguuucaccguguuagccaggauggucucgaucuccugaccucgugauccgcccuccucagccucccaaagugcugggauuacaggcgugagccaccacgcccggccucaagucuuaauuuaaauguaacuuucucaaucaguccuucucuagccccucuuaaaauugcaacuccauccccaaacucacucuguauucccuuuccugcuuuuguuuucuccuuaaaauucauuuuuacucauuugucuuuuuaguugucugucucucuaagguagauuauguuucuaaagaugacuacaacauuaacuuucaucccacauguuguuuucuaaugugacauugucauucuccaucaagaaauggagccuauuuugcccucacuugaaucugggcuucugccuuccauccuuggggugccuccucuuggaaguucacagccauauuagaagaacaaaugcccugagaccaccaugcuguaagggggcccaaacuagccaggugaagaagaggccauguaccaaagcucuggacaugugacuaaagccuucuggaaccgucugugccaacaucacccaucagcugaagggagucaaggaagagauccagucaauacuagauggaacagaagaacugccaagcugagcccugaauuccugacucauagaauugugaugaaauaaagguuguuguuugaggacacuauguuuuggaauaguucguuaagcagcaauagauucuugaaauauuccuauacuauaaugcaagcuccacgaggauaaagauuuuuuaucguuuuuguuuuauuuuuuugccugcugcaucccuggugccugcuguagugcucagaacgagguaggugcuugguaaacaucuguugaaugaaugaauauaugaaugaaagagagagagaacauaaugaagagaacauuacuaguggauccauguuucuuuccagugccaugaaaaaauaggauauggaaccuaacuauggcaguaauaagagaaauuaguggccaugggcaugcugccuugcagggccagcuucccaggcuggccaggaugcagagaacauuuggcaauauaucucaggaaaaccaguuucacagacauugucuucaaaccuuuucuuuuugagacauuaaaucaaccuuuuaauaagccaaaucauuguccuuuuaaguauaaaguaacacaggcgcaugguaaaauuuuauacaacacagaaaguuguagaaggaaaagaguuucauuuuacccugauguuaacaguuccuuugguaguaguuagaaaaugucuaggcaugauugaggccuuaagauucauucuauuuuguucucucuuuuuucacucuacauaguaucuuaaagagaguuuccuaaaggcaucuacaacaacaauuagcuuuuacuuauugaaugcuuacuauagcuacucuuguuagucuguguaguguuacuauacacuacacaggccaggcaugguggcucacgccuguaaucccagcacuuuggggaggcugagacagguggaucaccugaggucacagguucaagaccaaccuagccaacauggaaaaccccgucucuacuaaaaauacaaaaauuagccaggugugcuggcauaugccuguaaucccagcuacucaggaggcugaggcaaaagaaucucuugaauccaggagggggagguugcagugagcagagauggcaccacuguauuccagccugggcgacacagugagacucugucucaaaaaauaaaacaaaacaaaaauaaaaaaauaaauaccugaggcuggguaauuucuaaauaaaagggcuuuauuugguuuacaauucugcagacuguacaagaagcauggugccagcaucugcaucuggugagggccucggacugcuuccacucauggcagaaguugaaggggagacagugugagcagagaucacauagcaagagcagaagcaagggacugggggaggugcaaggugggaagggcugggcacaguggcucaagccuguaaucccagcacuuugggaggcugaggcggguggaucacaagauaaggagauugagaccaucauggccaacauggugaaaccccgucucuacuaaaaauacaaaaauuaguagggcgugguggcaugcaccuguaaucccagcuacucgggaggcugaggcaggagaacugcuugaacccgggagguggagguagcagugaguggagauagugccacugcacuccagccugggcgacacagcaagacuccaucucaaaaaaaaaacaaaaaacaaaaaaacaaacaaacaaacaaaaaaaaaaccaucucuggcaggaacuaauaaagccagaacucacucacacaccccuggggugaggacauuaaucuauucaugagggacccacccccaugacccaaacaccucccauuaagcccgccuccaacauuggggaucaaauuucaacauaagauuuggaggaacaaauauccaaaauauagcagccaccauacaauagacgauuucaucuucacaacaacccagugaagucgauaucaucauuauucccauuuuauagaugaggaaacugauacuugaggggcaacguaacuugcccaaagucaaacacuuugaaaaugacagauucaaauucugacuccacagcuaugcucuuaacuuucuuucucuacugccucuguuacagaaagugaacuccuuaucucuaagugcugcauuguuguauuccauagcaaugacuggacuagcaacucugaaacaaucuuuugugcaaucuagacuugauaaaugaguauauauauugagaauaguggaagccagguuucuuacuguugguaauggaacuugcauguauggaaaggggaagacuagaacauacacuguaguguuggguuacaguuggaaguaucacuaugggcuaauuuuuuuuuuuacauaucuauccuagcucuguccaucgagaaggccuagaaauaaugacauaccaguagccauaaacauacugagcccccagaucuugguucuaaauacuauucuccaguaaaaggaaccagagauccuugacugauucugguucugggauagggacagcacaugaugagccuggaauaucuuguugcuccaaaaaauacccucaauaaccaaagcuggaaacacuugagcaacaaaauaaaguauuauuggaugauaacacagaauguaaaaaacuauuuuuuauccauacugauauaaauuguugaauagguaaauaauaggaaagaagaauucaaaauaugcagauucucuacuaucaaggaggugaagcauaacuucacuucuuaagccagugcuucacuuggugacuuccuuucaaagaguacaguaugaaaagguaggaaaaaaacccaguagcuucagaauagaagaagcugacaaacaccaugucaggcuggugggagcuuucaguuggcuccucuguuccuuugacaugccuccaucaauguguuuuuauuugagcacuucuuuucuuuuugguaaaacaaaauacuccaggcuccuccuguauauuuccucccccaauccuagaaccagccauuucuccaaagagcccuaguuuauuuuauuucaagaaugguauuagaaaccaagaucuuguaguuuagugugcucauuuuuacugggauuucauugcuucuagccucugcagacagaagaaaauauauguguauauaugaauguauauauucauaucuauaaauacuucuaucuauauuaagcuaaacaugaguuuaaacugaugucuucaacucuaaaccgugaccacaaagaucagucuagcccccuccccuugaucaucuguaaccucucacuggaacagugaaacaccuggcuccuaccauccauuauccauuuauguaaaauuucacuauauauguauagugguagccaacuuuuuuauuuuagccauucuaauugguagauaguaguaucuucuaaagguuucaguuuccauuuuccuugugauuaaauauguagaacaucuuuucaugugcauucuucccaucgguauaucuucuuugguuauauaucuguucaaaucuuuugcucauuuaaaauuagauuuuuucuucucauuauguuucagaaguuacuuguguacuuuggauucauguccuuuaucagauaugugguuugcaaguauuuccucccagacuuucgcuuauuuguucacucucugaccagugcuuuuaauucugaugagaucagauuuaucagaaucuugguuuuuauuuuauuauuuuacgaaccauguuuuuguugucaugucuaagaaguguuugccuaacccagugucacugauauuucucauacauuuuuuacuuccaaaaauuguacaguuuuggucugcgaucuguuuuauaguuuauuuuguauauggugugauauaucgauuaauuuuuuugcauaugaauauccaauuacucuagcacccuuuauuuaaaagacuacuuucucuucacugaauugccuuuacaguuguagaguuuguagaguuaauuguucauguauuugugagcaauuuuuuuauucagacacucccuauuuuguuccauugauuuguuguucuaucuuuacaccaauacuacauugucuuaauuacuucagcuuucugauaaguguuaaaaccagguuauuguuucuaaaacuuuaucauuuuucaaaauuguuuuggcuauuugagauucuuugcauuuccauaugaauuuuagaauugucuuguugauuucuacaaaacuccugcugucauuuugacugggauuauauuuaaucuauagauucauuugggaaaaguuacauuuuuuuuuucuuuuuuugugacagggucuuacucuguaacccaggcuggggugcaguacacaaucacagcucacugcagccuugaccuccuggucucaaguuuuccucccuccuuaaccucccaagucucugggacuacaggcaugcaccaccacgccuagcuaaguuuuugguuuuuuguagugauggggucucacuguguugcccaggcuggucucgaacuucugggcucaagugauccuccugccucagccucacaaauuacugggauuacaggcaugagccaccauucccagccaaaacugauaucuuaacugucaucuggccaaggaacacaggauauuuuuccauuuguuuaagucuuccuuaauuucucucagaaauauuuuauaguuauuaggguacagaucuugcacaucauuugucaaauuuauuccuaacuaguucauuuuuguggugcuauuguaaaucauauuuuugaauucaauaucuucuuucauugccaacauauagaaaugcaguagauauuuguauauuaaucuuguaucaugcaaccuugcuaagcucacuuauuagucccaauagguuuuuuauggaauccauuggauuuuaacauagaugauuaugucaucucuaaauacaguuuuacuuuuuuucauugcaaucugaauuuauuuuuuuucuuuuucuugccuuacugcacuaauuaaaacuuccacuauaaugcugaauagaaguggugagagcagaaauucuuguauuauuucugaccuuagcaggaacauccaguucuucaucacuaagugagauguuaucuauagaucuuucauagauguucuuuauuagguuaaggaauucucuugcauuccuagauugcugagaauuuuuaucaggaauaguguuauauuuugucaauggcguuuucugcaucuauugagauaaucacguuuuuucuuuuuuaguuugcuaauguagugaauuacauuggugacuuauauauggugauuuuaaaaaguuaaacuuauauucaugggauaaaugaccacuucaucauuauccuuucuauauauugguacaaucaauuugcuaaaauuuuauucagcguuuuugcuuacauguucacgagggauuugaguuuguaguuucuuuucuuguauguuuuugucagauuucagaaucaggcuaaugcugaccucaaagaaugaguugcaaaauauuucauccucuucaauuuccuggaagagcuugccuaaacuugguauuauuuucucuuuaaauguuugauagcauucauuaguaaagccaucugggccugaauuuuucuuucuuugaaaguuuaaacaaaaaauuuaauuccuuuaauagguguagagcuauuuaguuuaucuauuuauucuugagaaaucuuuagccguuuguaucuuccaaggaauuuauacaucucuucuggguuuucaaauuuacuagcauaacauuguuuguaauauuccuuuauuaccuuuuuaauaucuguagacacuauuguagugucaccucucuauccuuauauugguaauuucuucucauuuuuuuccugacuauucuggcuagagguuuauuaauuuuauugaucuaaaauaucaguuuugauuuuaucaacuuucuuuauuucuuuguuuucaaguucgcagauuucuacuugcuuucuaugcuuucucuucuguauacauuggauuucauuuguuuuauguuuucuaguuuuuuaagauggaagcugauuugagacugcucuucuuaccuacuacaggcacuuagugcaucaguucucuccuguguucaacuuuagcaucauccuacgaauuuuauuccucuguguuuucauuuuuauuccauucaaaacacauuuugggguuuuuuuguuuguuuuuuugagauggaaucucacucugucacgcaggcuggagugcaguggcacaaucucggcucacugcaaccucugccucccagggucaagcgauucuccugccucggccuccugaguagcuggaauuacaggcacaugccaccacgcccagcuaauuuuuguauuuuuaguagagguggggagucaucaugucgaccaggcuggccuugaacuccugaccucaagugauccacucaccucagccuccuaaagugcugggauuacaggcgugagccaccgcacguauccucaaaacacuuuuaaauuuuccuuucggccaggcgugguggcaaucccagcacuuuaggaggcuuaggugggcagaucacgaggucaagacauugagaccauccuggccaacauggugaaacuccgucucuacuaaaaauacaaaaauuagcuuggcaugguggcacaagccuguaguccuagcuacuugggaggcugaggcaggagaaucacuugaacccaggaggcggagguggcagugagccgagauugugccacugcacuucagccuggcaucagagcgacacuccauggugaaaaaaaaaaaaccaauuucuuuuuuuuuuucauuauacuuuaaguuuuagaguacaugugcacaacgugcagguuuguuacauauguauacaugugccauguugaugagcugcacccauuaacucgucauuuaacauuagguauaucuccuaaugcuaucccuccccgcucaccccaccccaaaacaggccccagugugugauguuccccuuccuguguccauguguucuuauuguucaauucccaccuaugagugagaacaugcgguguuugguuuuuuuguccuugcgauaguuugcugagaaugaugguuuccagcuucauccaugucccuacaaaggacaugaacucaucauuuuguauggcugcauaguauuccaugguguauaugugccacauuuucuuaaugcagucuaucauuguuggacauuuggguuaagcaauggcaacaaaagccaaaauugacaaaugggaucuaauuaaacuaaagagcuucugcacagcaaaagaaacuaccaucagagugaacaggcaaccuacagaaugggagaaaauuuuugcaaucuacucaucugacaaagggcuaauauccagaaucuacaaugaacucaaacaaauuuacaagaaacaaacaaccccaucaaaaagugggcaaagcauaugaacagacacuucucaaaagaagacauuuaugaagccaaaagacacaugaaaaaugcucaucaucacuggccaucagagaaaugcaaaucaagaaaaauuucuuucaucccuucuuuuaucaugaguuauuuagaagaguguuauuuaauuucuaaauauuuguagauuuucuaaagaucuucccgguauugauuucuaauuuaauacuguuguguuagaaaacauacuaucuguggcuugaauucuuuucaaaauauucagaucuguuuuauggcccagaacgugguuguccuuguaaauauuucaugugcacuugaaaaaaaugucuaauuugcuguuauuagguggaguguucuuuaaguaucaauuaaauucaguugacagauuguguuguucaagucuucuauauaccuacugaauuuuaucuaccuguuuauuauugagagagaggcauuaaaaucaccucgaauuauagauuuauuuuuccuugcaguucuaucuguuuuuacuuaaugucuuuugaaaaucuguuacuaguucauuaguauuuaggauuuuuauguucuccugauggaccaaucucuucaucaucaugaaaugaccuucuuucucccuggcacuauucuuugcucugaacuacuuccucugauacuaacauagccucuccagcuuucuuuuucuuucuuuuccauguaauaccaugguuaucucuuuucauccuuuuacauuuaaccccauuuguucuuuguauuuaaugcaaguuuuuuguaggcauuauacagcuaaggucuuguuuuuuaauaugacagucucugcuuuuuaauugagcuguuuagaucauuuauguuuaaugugauuauugaugugauuagguuuaaaucuaucaucuugcuguuuucuauuugucccaucaguucauuguucuucuuuuucugccuuuuucuggauuaacuaggcuuuuaaaauuauuucauguaucacccuuauugccuuuuuaagauccaacucuguuguuuuagugguuucuuuaggguguacaguaaaggccaucuuguuagauaagcuuugcgguuucucuauuguguuacuaccuaccuccuaaaacuuucacaggaacauuuuuacugucuacucuguaccacguacuuuucaacacuuuaaauacaucaggucauguaauauaacaauacuacgaggauggacuguuacuccuaucuuacacaugugaaaacugagaccuaacagguauacugacacuugcucgugguuacacagcuaguaaaugguugaguuuggauuaaacuccucuuuccuuagcccuggaucucugaguguuaguaaguuuauacuggugaugacaaaucaguacuauaugugguaacugccuccucugaaaauuuaguuuuguguuauugcuuuuauuguuauuguuuuaauucacaaaccuguuugugguaacuuaagcauuaaggauuuccuugcauuuuuaauuuuaugugauuuggaaaauugccauaccacauggcucauugcauggcccucucaguuccugcaaaguaauccaucaaacagaaaccacggcauuuauuguucuaaauagucuuccacuggguauaacauugaacuccaccagcucugaggguuguuuucguuuguuugcuuuuuuuuuaaccaacuuuaccagucugaguguuuuaauucuccccuagaacugauuacuaaaaaguuauaauuuaucguuuuuaaaaugugauguuuucccacuuaauauggauguauauuuccuuuuuuugucaagaagauaauauaccaaaauaauaaauugcucuaaauugcucagugauuucaguuaaugugaauccauguuuagcagguuggcauauaacagugguuaucaaagcgugguccacaaaucucuggugguaggggcagguaaggggugugucucugacaccuuuggaugaucugagagggcaaaacuauuuuuauaaaagcacuaaaaagauugggaggccgaggcggguggaucacgaggucaggagaucgagaccauccuggcuaacacgcugaaaccccgucucuacuaaaaaauacaaaaaauuauccgggcaugguggcaggcaccuguagucccagcuacucaggagucugaggcaggagaguggugugaacccgggaggcggagcuugcggugaguggagaucgcggcacugcaccccaaccugggcgacagagcgagacuccguaucaaaaaaaaaaaaaaagucacuugcauucuucauuauguugacauuugcacugaugauaaaaaggcuauauuggauaaaacuuuuggugccuuagcagaaacgccaaggcuauauuaguagucauauucuucacugaagugcacucaaagggaaagaaaaagacaguuuuauuuaauauccuugauggaacaguuaaaaaucauuaauuuuauugaacaguaacccuugauuacauguuuuuaauauucuguguggugaaagaggaaguaugcauaaguauuucuucugcauaccaaagaacaauuguuucaaggagaagcacuugugugguugccugaguugugagcgcaacuaaccuccuuuaaaaaaaaaaauagaaacuuacuuuuacuugaaggugcaacugacagacaacuuauggcuauuuauacuuggauauuuggcagacauuuuuuaaaaaaugaaugaagucagccugucauaagacauaaaauugacaguauuuguugccaaugcuaaaauguauucuuucaagugaaaauuagaacuuuagaaaacuuguaucugucaccaugaaugugacagcuuccuaauacuuaaaaacucuucugauaaauugauagugauauuagaaaauaugauuuuuuacgucgcauaauaaaauguaucaacauuuggaaaaucucuauaacucagucagccaauauuuuccaaauggccagugcaugaucaugccugaauaaaagugcaagauaaaccaauggauacuacuguaacagaguacaaaauguuaguugauaugaucucagauucuguauuacaacuauuauuugucagacuuugguauaguaacaaaaaagaauaucuaugauuauaugaaaaggcuacuaaaauacuccucccuuucccaaaugcauaucuguguaaaaccaguuuucuaaauauauucagccaaaauaacauaucacaacagaguaaaugcaaaagcagauaugagaguacagcuauuucuuaucaagccacucauuaaagaaacuugcaaaacuguaaaacagugcuacuuuucucacuaauuucuuuuuauuuuggaaaauauuuauguuuauuauauauauauauauauauauauauauauauauauauauauuuuauuuuuauuuuuuuccugaaacggagucuugcucuguugcccauucuagagugcaguggcaagaucuaggcucacugcaaccuccgccuccuagguucaagugauucucuugccucagccucccaagcagcugagauuacaggcaugcaccaccacacccugcuaauuuuuguauuuuuaguagagacaggguuucaccauguuggccauguuggucucgaacuccuaaccuuaggugauccacccaccucggccucccaaagugcugggauuauaggcauaagccaucacacccagccaaauauauuuauuuuaaauaaaauuuauaucaagccaggcgcaguggcucacgccuguaaucccagcauuugggaggccgaggugggcggaucaugaggucaggaggucaagaccauccuggcuaacauggugaaacuccgucucuacuaaaaauacaaaaaauuagccagacaugguggcgcgugccuguagucccagcuacucaggaggcugaggcaggagaaucgcuugaacccugguguugcaaugagcugagaucgcgccacugcacuccagacugggugacagagcgagaccccaucucaaaaaauaaaaaauuaucucaguauuaacaucauggguuuauuauuuuuaauggauuaaaauuaaaugguuuuaaauuucucaguuuuaauuucuaauaugguaaauguugguaacuauaaccccaugcuuuucaggguccucaguaauuuuuaagacuauaaagggauuccgagaaaaacaagugugagaacuguugguagauucucagcucacacugauuccuuuucucugauaacugcucuuucucccucuauccaugaaggauauuggaggauagccuagguuauuguuuuaccuaggcuaucauccuuccucuccucccuggaucaguguauugagggauagaaggguuaauggguagcgguaugggguguggauuuugaccccagcagggccuaucuuacucuccccuuacaauucaaguagggucaaaagcguguuaaugucuaucuaaagccugaccccauaguguaugauguaaauuacauaaaggguccaacuucccacguaguggagagaacaagaggggaaguugguuugaagacugugaagagaauaaagcagauacacgaagaggggaaaagaugagagacagacagaaaagcacaaauuucuaggguuucccagaucuccauucuuugguucuaguuuaugccugaagaugggcuugaguucuauaaaagagcccagugucacguuacuaaauauuaucuuuuccuuuagccaguuugaguggguuucuuuuacuugcaaccacauugaaucacuuauaguuagguaccaccugccugccugcugccguugcucacacccguaaucgcagaccuuugggagaccaugccaggaggaucgcuuaagucuaggaguuuaagaccggacuuggccacauagcagaaaaaaaaaaaauagccuggcuugguggcacucaucucuaaucucagcuacuugggaagcugagguaggaggauccuuugaucccgggcagucgcggcugcagugagcuaucaugccacugcgcuucagccugggcaacagagcaugacccuaucucuaaaaaacauaaaaauaaacuaaaauaugguaagguaggacauaugugaucuguucucaaccuuuguaagguuuaugaugugccauacauuuuagggucuuaucagcuagaaauacaagaccaagguuuucuggaaaugcaaagauacuauuuuuauauugaaguuaaaaaagaauuaccauaggcuacacauggauuaauuacuaucuucaaagaauuagaacucuaucaaacauucuuaccagaaaauuaugcugaacaaaauuuaaucuuucugugacuguucaaaggaauuuagaaucuuguaaugcuccagggacauuaccauuuuauaaauuguacaaaaaa

SEQ ID NO: 16287 - RNA, 466 nt, Homo sapiens
ccuuucucgcucccgggccaucuuagcagcagcuccugguugggggccaucccacaccuaaggcagaaagaugguggcugcaaagaagacaaaaaagucgcuggaguugaucaauucuaggcucuaacuuguuauaaaaagugagaagcaugugcugggguacaagcagacucugaagaugaucagacaaggcaaagcaaaauuggucauucucuguaacaacuguccaacuuugaagaaaucagaaauggaguacuaugcaauguuggucaaaacugguguccaucacuacaguggcaauaauauugaacugggcgcagcaugaggaaaauacuacagaguaugcacacuggcuaucauugauccaggugauucugacaccauuagaagcaugccagaacagacuggugaaaaauaaaccaugcaaaauuucccuuuaauaaaauuugccagugcuuguuaaaaa

SEQ ID NO: 16288 - RNA, 1032 nt, Homo sapiens
guuuucuguuugugaauaauccuuuuauuuuaugccauuaggcacauugaauuauuguuuauuccuugcuuuuugcacaugcuaggaaauauuccaaacaugguaacgcaugagauauuucuccugaaaaaacgauaaaagagaugaaguugagcucuuugccuuuuuccuuugcuauacauacguuagauguuucugugccagugacuuuaugcauaugcaauauuaacuaucacaauaaaucuuaucugguacaugcuuuuaauuaaacugaaguuggauaaaguuagcuuuuuguugcuauguuuggacuauggcuauuuaaaaauaccugugguaucugaguuaaaucuccaauuacccucccaagaaagguagagaaugaaaauuauuguugcuuuuacagagaacacaccuaguacuuagcauugcaacaugcuuggucuauagcuacuugcacuguacacugugcaugccuuuacacuucaaauuucacugaaaacccauucuauguaacuuucucuucuauuuucuccucacuggucauuuggauucucuuuuuccuggauauuuuauccucaaaauacacaauuucuuccuugaccucaugaugccuaucuaaaacagaguagaaaucuuuuuaaacuggagaucagaaaacccagguucuauuuaucacuguugcugagaucugaaggcuccucacugggaaaauaaagacugcauugaaugauguucaacauccaauucaauuuuaaaauuuugauuucacuaaguaggaaaugagauuuauugcuaaaagcagguggguuacauagugaaugccaaaauuuggugcaauggaggugagguguuugcucuuggggguuauucuagcugccaugaccuucuguuagcauggguaauuaagagcucccaaacauuacauuugucagcuaguucaugggguuucagaccaauguugacuggucaaaaaguuaccauuuuguguucaucugggaaauugcaaucuuuuuauguucugagccauuu

SEQ ID NO: 16289 - RNA, 1032 nt, Homo sapiens
aaauggcucagaacauaaaaagauugcaauuucccagaugaacacaaaaugguaacuuuuugaccagucaacauuggucugaaaccccaugaacuagcugacaaauguaauguuugggagcucuuaauuacccaugcuaacagaaggucauggcagcuagaauaacccccaagagcaaacaccucaccuccauugcaccaaauuuuggcauucacuauguaacccaccugcuuuuagcaauaaaucucauuuccuacuuagugaaaucaaaauuuuaaaauugaauuggauguugaacaucauucaaugcagucuuuauuuucccagugaggagccuucagaucucagcaacagugauaaauagaaccuggguuuucugaucuccaguuuaaaaagauuucuacucuguuuuagauaggcaucaugaggucaaggaagaaauuguguauuuugaggauaaaauauccaggaaaaagagaauccaaaugaccagugaggagaaaauagaagagaaaguuacauagaauggguuuucagugaaauuugaaguguaaaggcaugcacaguguacagugcaaguagcuauagaccaagcauguugcaaugcuaaguacuagguguguucucuguaaaagcaacaauaauuuucauucucuaccuuucuugggaggguaauuggagauuuaacucagauaccacagguauuuuuaaauagccauaguccaaacauagcaacaaaaagcuaacuuuauccaacuucaguuuaauuaaaagcauguaccagauaagauuuauugugauaguuaauauugcauaugcauaaagucacuggcacagaaacaucuaacguauguauagcaaaggaaaaaggcaaagagcucaacuucaucucuuuuaucguuuuuucaggagaaauaucucaugcguuaccauguuuggaauauuuccuagcaugugcaaaaagcaaggaauaaacaauaauucaaugugccuaauggcauaaaauaaaaggauuauucacaaacagaaaac

SEQ ID NO: 16290 - RNA, 5734 nt, Homo sapiens
accuuugucugggcguccacaugagccccuugguuuacgaggacuucugccacauucacucgaucuucuugagcagccaaauggaguggggucaggccgcucugcaaaagauucaaagggcacagucaucguacaggaaggaaugucacacacauagccauguuugagaaaccauuugugaauucuaagaugguaagccgagaauuucuauguuagaaaaaaccuauggaauaaauuuauaugcuugggaggcugaggcagguggaucacaugagcccaugaguuugagaccagccuggccaacauggcaaggucccaucucuacaaaaauuagccaggugcaguggcaugcaccuguagucccagcuacuugggaggcuaaggcaggagaauuguuugagcucgguagguggagguugcagugaguugagauagcgccauugcacuccagccuuggugacaggguugaaugaaaccugucucaaaaaaaaaaauuauauguuauacugucuuagcacuguggcaacaugacuaucuguaggcugcaugaaaaauuguaggcauacucgaaaguguaagaaauggagugagccuuguauacucaucacagacuuagcaauuaucaaaguuuuccuauauguguuucaccuaucccucuuuuccuuuucauucauuuguggcaauauuaacacaaaucuagacacuauaacauuuacccccauacauuucaguguucaucuacaaaaauuagacuuuuuuuuuuuuuuacaaaauuaugcaagaguuuuaacauauugccaaugccacuagcuuuaccaaaaauuauuuaaaugauaucuguuuacaaagugaacacugacauaugcugauaauauuuucuccauauuaauucccaaggucuaaugaauauuuucuguaugucacucuggguaggaaagaucgccugugaaauguaaugugaaugcaagaucaugacaauuuccaggucauuuagaugauguauggauuuaacaagacugauacaguauuugaaacuaacccuauuagagaauuugcagaacacaugguugcucucaugaccaagaaaaaaaauuacuaagauuauacuccgguuuuaaaaaaccucuuuaaauuguaaagcauuuuuuauaauauuuaagagaaagugaguugguguuaguacuuucagauuuuuugcuuucauccauuaugagcacagaaguuaauaucuuaauccuggaagucuuuucucccccucuagcaucugugcaaugaaaauaucagccuguccuauuugucagaggaaaggagguaaucaaaggcaguuucaggaagagcacagagucuucuagaugugaaacauuauuuauucagggguugcuauuccaucagagcaauuauggaaugcagagagagucaagcugggacuuuuuaauaauguuuauagaauuuuggaggaagcucacuugaacugaauaaagggggaaaugugaaaaggaggacugaugcauucacuugaaauucaagaaaaauaagccagagccaaaauuggcaccacccaaacacugaccucaucacagaaccauguuccguguucuccuucagaggaaauaauauugucagccacaacauuuugugagugucauggucaccuauucuaaguuugaaacuuuugacacugaggguaccuuacugaguagcucucagcaaagacugagaauguguugugggcacauguuguccccucaugcucccaugucuaggugccugcugcucagcuggcuuacccacucacugauggagucacuucaggcuucccuggccuuucucucuucucguuucaauaaagggccaaguuauuacauuuaugugcaaaccuacuaugugcucacuucuauuacaaauaucauaauccugcauuuaaacucuguuuucuugcuugucuuccucaaaccacugugagcuuguugaggcaaguaucguaucuuugauuuuuauauaaccagugucuagcaucuagcauuuaauccacucacucauagauuaaaucagagaaaaaaaaucaaacauuuuucuuagguagaacaguauaaauuauauaaauaacauuuuauuuuuauauucuugguuauaauucaaaagauuuuaaaaaacaauaugaagguaaccacagcccuguuugaguucagaaguuaccuguuaaucuuuuauggcauuuugaucauugcucauuuuaaaaauagcacuuagggccgggcacaguggcucacgucuauaaucccagcacuuugggaggccaaggcggacggauccccugagguugggaguuugagaccagccugaccuacauggagaaacccugucucuacuaaaaauacaaaauuagccgggagugguggugcaugccuguaaucccagcuacucgggaggcugaggcagaagaaucgcuuacacccuggaggcggagguugcagugagccaagauugcaucauugcacuccagccugggcaacaagaaugaaauucugucucaaaaaaaaaaaaaaagguauuuauuugaaacagagaaaacaucaaauuaaaauagcaacaucucuguuuaauauucuuucaguuguauaaaaaauauaagcauuggggucugcaaaaccuauaugggaaaauaggaacaucaaaagcaaaauugaaucaaaucgaacacuagcaccucaacaauaacuugggguucaugaucauuuuuccuuaaaaguacugggaaagugcugguuacuaguaagaaaaaagaaaguaaaaacaauaaaguguuuaguucaacauaaauuaugaaagcuaaaucuuuuuuaauaguuauuuuuuagcaaggaaauaaaauguaguguuaugugagaagagggaaagguaggcaggagaagggaggagggaacagugaguaauugaugcuuaaaacacuggcagcucaggaaaaacugacaaaaacugagagacaguuccuuauugaauaauaaaaaguuuugcugcuuuucuguuuucacaucagggcauauuuagugcuuuauacugaaaacgacaacggagaaaggaugcaaggauuuacaaaugccuucuuauuagauaguuucuaaugagaaguuagaaguuaaaaguauuagaaguucucagaaguuccuuaaguucaacaugcuaauggaaagccaguugaucuuuuagaauuccuuuaggaauaucucugcuuguguaucauuuacucaggaaaguggccagaaauuuccagguuucccugguuugcuauaugucuuugagucuuuagaauuccuuuuguuaauuuccacucuacuaaaacaagcacugagaaaauuuuugcccuaaauauuuuuagccuaaaaucacccuaugaggcuaagaugaauucaaggcugggcauauauuguaccaguuggcugcaggauuuugaagaaacaaagucagucacacugcaguuugguaucaaaccuacuggaaauauucaauuuaaaccaauugugaaaguacuacauuguuucuggaagaaaugaugaaauacaauauuaugggcucacaagagaaaauacacucugauaccagcaugugcuucaauuugggaaacacaagguccucuuugucauaaagacaaauugaguuuugaggcaagccauuacaauucuggucucuaaauugguauauaaaacuauagaaaauucaaaagaucaaacaaaucuuaacuauaaugacgauuaugaaauugcuuuuugauucccauuaaugcugagacaugcacuccuaaaaggaauguuuaacaagaaaaaaauaaaauuaaaaaaauguguuugcucuguaaugaccaaaaaagauuuucacaauacuaaaacuaaaaaaagauaucccuggucuccuguauaugucuuuuggucuauagaauuuguuaaauaauaaccuugagaauucagauuguuauggaguaaccuuuuuccaaaacuguaaaaacuccaaaauuaaaaaaacgauuuuuucuuacuuaaaaguguugaauguuuucucaguguauccucaaagcaacucaagaagucaguauugcuaucuccauguacuaaaggacaaaacugaggcucagagagguaauauaacuugccuaaaugacacaggaagaauccaacuuaggauucaaacucucugugauuucaaaacacaggcacacguguugaaaguauuuaaauuacuuguuauuugucaacauaagacuauugcuauuuugcaacccuacuccaauaucugagcuaggccugagaaauaucacagcuaugcccacacccagcaggcagaagagaagcuaaaugccagacaggggagguuaucagaaucugagggcccuuuugugugguuuccuauuaucugaagauuuagaaacaccugucuuguguuuugggucaaucuuaaugagcaauucagcaaaccuaaauuugauacauacagggagaggcaguaacuucauuaacaaguuucugguuaauugucggcugaacuuucacuuugcuugacaaaacucuagucuuuucuucaugaauaaugagcauaucaaagaugacagcauggguguuugaagaguuuagggaacagucuucacaaguuccuucaaaauugccaacaacuucuccuaucuacuccauaaaauagcuacucuaaauuuguuauuaaaaugaacucacgaaggcagcaauguuucccauuucucuuuguaaccuagaacuuaaaaacggaugagcaaggagcaggaccccaaacauguuugugaaauaaagcaaagggcuacaauuugcagcuucuucuuugcuauguuauggugaaguaacaauggugcucuuugaauuaacauuauaacaaaacuuuauguuacuacaaaaacuuccuggacuucauuuuuauggcuauguguacauagagccacuuccauauauacucauugucugacugaauuaucugaauuauuuauuuaccauuaucuuucugucuuuuuuuuuuuuuuuuuuaaagagacagggucucacucugucacccaggcuggaguauaaagaagcaaucagagcucacugcagccuccaucuucugggcucgagcagucuacccgccuugucuucccaaagugcuaggauuaaaugccugagccagagcaacuggcgcauugaccauuuuucuuauuguuuaaacagauuguuuccaaauuuuugcucuguuaaguaacacuuugguaaacaacuuggugcaauauuacacuuuacacauccuauuugacucagaucuucugugaauucuuagugaccuuucugaggggugagguuuuggugugcugcaugcuuugucaagaaagaaguggguuaccuuauugcucagguucacauucgcauuucuaccgaggagcagcgacaccauguccacgugcccuuccugagcugcgagauggacggaagcaauuccuugccggguaacugcguuggcaucagcaccauauuccagcagaguugucgcuauguccaucugguucuuuuuggcagcgaugugcaguggcguauaaccauucugucaacacaaaucacuuggucacaugcccaggaacaagauaaaaaugugcacagugcauuuucaaauaguuuaugucucuuucuagugguuuucuaugauugcuuaagaaaucaugauuaaguaagcaaauacugguaaaccaagu

SEQ ID NO: 16291 - RNA, 19749 nt, Homo sapiens
gaaaagcaaacuucuuuauuguacacaguacagaauauaacgcagcuuggcaggaugcauacggcccugcgcaggggaaaguauuucaaaucagcuggcagguucaagccuuucugcacuguagacuuuccacacucuggaaaagaagcaaacaaacaaaccccaaagaacccccgaaaaaaacaaaaaccauccgggaggugcaugaguccaaugggaaugcaaccgugaugccgcuguccuaugcccagugacagcacaggucacguaaguuacagcaggggagggguagcucaagcuacagaggauuauugucauauugcuaagacagcauaaauccauucaaaagaaaaaaaaaaaaaauccaaaccaggguaaguaaagaaaggaaaaccaaaucuauacagcauuuacaacaaauaaaucucuagccagcuggggguaaaauaugcaucuauguauagacuauguguagguuaagaaagcuauaaauaugguuuagaaagaguccuuugauuagaguacaaugcuaauuaaggcccaaucuacagguuuaccaccuuugugggcuaauuagcuuccaauagaggagaaucucauguuuccauagcuauaaagugcaccccuuaucccugcgaaccucuucacaaaugugcuguuggucauaagggggacaguuugagacuauggagugcuccaugaauagaaaagcaguucaaagcacgugucucacacucacggagucagcacugccuccuucacauacgaggaacaguguagucauucuuaauguacuaagugucacggggagcacagaauucuaccagcagagcaggcagcaagguaccaccaguaacuuuuccucuacuuugagcucaacuuucacauagcuuuagcuugguuguuuaaaacuuuuccaauauaauacagcaaugagaauaauuucuuuuuaaaaaaaggcaggaaucuagaaugcuagcacuguugcuuaccugucaguaucacacguaagucucaaacccuacugaaucacacagguaggguuuaaaguccaagauuuaaagaaaaaggaaaacaaaacaaacugaugaaauggaaauugucaucagucaugcccagggaagaaucccaaggguuuucaccaggugaccagguuuccaaaggacaugacacauguuauauacauaugcuuuccagagagggcauguuagugaacacggggaacuauacauagagaaucuaagcuuguguccaggcugcccugcacacuucaaaaauguacaacucaggugcaaauguuccaucagguugucuggugcagaaagcacaaagcaggcaacaaggcgggcuuucacauggccaaggggaagccucagcaaagccccucucaagcugcagugucuucauaaguuggcacggcccuggcuaaaggacacagugcacaguuaccaaaagguuuguuuuuguuuuuuguuuuucguuuuuuugcuuuaaauaccaaaacuacaaaaaucaguuuauaaacuguuuuuccaaaacaaccaccaaaacaaaacaaucccccaaaucagggcaaaacaaaauacugucaaaaguguuaaucgcccuucuccuaaaauaaaagucauccacacucagccacgugauugggaagagaaagggggcuugcucuacuuggcgaccacauggccgggugguucccaagaguagccaugguuuaugauuuugagaaccacggaguggggaacagcuguucugacugccccccuuuuucuagacaagggguaauauuucagauucagcuagaagagcuuuccaauguuuaagauguauuuuuaacccuuaaugguuugagccuccccaacuuagccuacuuacuuuucuauggguuugugauuuuucaacaaauugugcaaaucagagcccuucuauguaaaggcauuuaguaguccaugaucgaugcagauugucacauacuaugucccguuuugcggguacuaaccugaacaagauauugcuuugcauguauuguccaugguaaggagacuccauuuugaucucuucccagaaaccucaucagaaucaagaguugaggcacuggccuuuuggugguuuucugccccucccuguucccacuccccagccaauguaucugucuuuaagggugccaauccagagacagcuuggguucuccagauaauacucaaagggcaagcuuuaggaacaaccaaaaacacaaacaaaaccacugcccuuguuugccugaaugggaacugcuagcucuaggguuuggccacuccgccacucagaaacuuaguaagcaaagccuucggcauaggggaggcugcugcagcgguccauguccaggagguaagcggggcugucuucaaagugggucagcggcaggguguccuccucgcugagguggcacucggacucugccuucaggaacggacgcugguuauccgggaaagccauggagaagagggcaucugggucacagacaaauuuguagacguaucgcucuccagccaccugcgggagaacacacaccuuacagggcccaguuggaacagggcaugggaucaggggaagagaacgagguauuccuaagucacaaagccagggaccaaaggagcagccgauuaccccaaucacucagacuuauuuugagaacuccugggaaccuauuaucugccaaguguuuuacugacacuacagcaguuaaaaaagaagauaucugaauuucgaauucacacuagauggacucuuaaaagaaaaucuucacuuucugucuuccagugacagcuuugaaagcaugguuaugcugagccuggagucugguguuccaaaaagguuuaaggacugacaggugcaaggcagaagccugaccacauuuuuagucacuuccagaguuuacagucuucacaguauggccuuguuauuuagaaagguuagaaaucugaugagagcgagccugcgcagaagccuuaaguauguuccaaagcugaaaagaauugcuuuuggcuuaccugcagcuuuaaaugacucaccgcauggcucugcuacacugagggaaccgcuaacuaccuuucuauggguuuucugcauuauaauauuagaaccagaaggucuugguuguucaaggaccucaugguauguggcugaugagacaucugcgucaaugggaucaccuucucucugcugguuguucagcaauaguacaagaggcaccuaauaccgaaaaucaaacccaauaaucggcuucugucuggagacgcagagggggaagggaaggcagccaaauuuacugauaagauaaacauuuuagauuuaaaaaugcaaacuguugaguuuaauccugcccuucagucauucugcugugauucuaaaaucuuuuuuuaauugaacaaguauggcucugcuuccacaucucuaccaaucaaccaccucuaguuaguguuguacgcugguuuuaccuuaaagcccaaccccaaaaauuaguuugugugggagagugaggcaggagagcacaguggaaauaauccuagaucagaagcugggaguugcacggcuuccaguccugguuuagucacuaaugagucuuaaccucugugaaccucaauuuucccuucaaaaauggagggcaugggacuacagcuuuucuaagucucucuacacaccgacgggcuaucauucaccuuuuaaugagcucucauguacucgugagucauguaacaaauaaaauaauaaccccuuccuuacacuggauggcacauuauuauuucugaaauauuuucaaauauauuacccugugggauuaaagcaagaauuauuaucuauauuuuuauuagaaauagaggcuuugggagauuaggugacuuuccucaaaucauacagcuaacaaauugaaguguuaggaucugagcccacgaagccucauuccugggccuuccuguacucuuugccuacuuauucucagaaauaaaguucucuucuacucccuuagaaaacacagaagcuagucauaaggacagcucauuuccauugguucaaguuacuguguccuggguugcaucuccccaugcuggauguggaguugggaacagcaaaggaauaauggcucucccaccugaacuuaggauuuggccugaugauaucaacucuaaggaggauagaggacaauggggaguggcugcugauggguauggcguuucuuuuuggggugauaaaauguucugaaauuaauugugguaaugguuguacagcucugugaaaccacuggaccguauacuuuaaaaaaaggagagguaagguaggggaccaccuauccuacagcauuuaacucuguaucaagcacugaaguuaaaccucaauuccuaacccaaaggagcuuacacuccagugggggguaguaacaagaaaggaguuaagacacagcgagaagagcagugguaggaacaaguacuggugccaucagaagcagcaaaggggaccaccuaacccaaucugaaauggaaaggugacagaaaacaaggaggggcuggccagguacugagagcauuaggaauguucuaggucuuaaguaggaugacaguuuaauaggugucuuccauuuuaugguaugcuugauaauguacaugcauguaacauguauucuuuggcaaacaaauacuacauuacauuaaaagguggcuaugcuagugaaagccgucaaguuugagugaagaaacgagaguuagguggugaccagacugggaacagccucagagccuguaugacgcacuagcaagucuagaguuuauccagaaaaucacaaugagcuguugaguauuuuuuaagguggcgaggagaauauggggucacauuaccacccgccuaugagaaagaugaaucuggcuucuuguagacaaguucucagcaguuuugcccauaugcuucugccacguucaucuuauuggcuacugccagguagacuggcucaauguguaaaugcuaguaucugggcaacaguacauuacgaauuugguagcuaagaaagacuugccauucccaucuucuacuuauccaugggauguuaagacuguggccccuugcuaccuaucccacgaagaauuuuguacugauuucuucaaaauaugcuucauccucuauuccacaaagagcaaccugcuaccaggugacucugcugccauucuacaaacguuggguuuuuaacuugaguuccaguuucuguaagucugaaagaaaaaucagaugcucuuauuccucuaacacuucugagcauaucaaacuaacagauuuggaggucuagguguuuuaauaacuaaagacuucaaucaagcuguugaaguagagaccuucaaguugauucccuguaguccuuuuuggauacaacaguuggccuaaguuucuggaaauuucuauauauagaagcaguuuugggaaagcagagaagccuaauuuucuauuguguguucugcaugcaacuucuaguuuccacauaaccaacagcaucaaauguacucuauaucucauuugauucuugucucaaguuugucuucucaagauuguuuccuaccacagaaucacuuagggggcuaaaauuuccucguagcgacgaucaccagucucacuacagaagcccuggacuuuuuccuuaaaagagaccagagugggcuaagggucuuguauaauggcucaccuucugcaugaugcccuuuucauaguaauagcggagagagcggcucagcuugucauaguucauggcuggccgguucuucuggaugccccagcgccgagcaaccugaagagacaggaaagugaagagcaauggaaacgcauucccugggccccauguucucucccaaucccagcagagccaguucuguaaccugacugcuuuggucaaugaucugcuacucugaccuggaagggaaggcauuuaacucccucaagaccaaacauucaacaaaggcgaugauucagugacaacuacuaggaggugagaccuagagauggaagaauccuagcacuuuaagauugcagagggcuuggcuaacaucccagaggaugcaggcccucuacuauuucuccacguaugaauuauugaccaauacccauagaccauuaacguguugccauuaagugcuaugguuucuguagcagucaauaaggaauaauuagaauggucauuccugaaacauuagaaacacacuagugaguugcuaaugggccagcagagcaaaaguucaauucuaauaagauuggaggggggcugggagauguuuacuuauugcagcucauggacuaagggggaaucagaucauuucagccugcugccauccaaucccaugcucccagcagacuugcagaauggacaugaaagcauguagcaccauuauccacuuaaugaaaaauuaacagggcuuuccaaacaguucugaaaugcauuauauccaacccaguccaccugaggcacacugauagggcaauauaauuggagcucugggcaaagcagccuucuagcaggaaaacuuccuaguagaguuuacccaauuaucacggcagccaagcaauuucuguucucaaguauaucagcuuccaaaauccuacuuaugagaaugacugucaagguaguagaauaacccuggaaaugugaguuuuacucagagguuuucaaauguaugcaaaccaggggucaggggucacguuuggagcauuuuaggucaguuuuggaaacuuaaaaaaaaaaaacaaacuauauuccuucgauuauuuuauuuuuauuuucugagauggagucucacucuguugcccaggcuggagugcaguggcacgaucauggcucacugcaaccucugccucccaggcucaagcgauucuccugccucagucuccugagcagcugggauuacagguguccauugucaugcccaacuaauuuuuguauuuuuaguagagauaggguuucaccauguuggccaggcuggucacaaacuccugaccucaagugacccaccugccucagccucccgaagugcugggauuauaggcaugagccacugcacccggccccuucgauauuuuaaaagccaaauguuaaacauggaguaggaaucagagagaaaacagcauuucacauaaaccuuuuccuuaaaauaucuaggcagaaugaaagcaacaucuucuaaauucaggauucuaaaaugaccuuucauaaaagccaaaaaugaucugauaagaaugcaucucucuuaauuacaauaauagcaaugauucugcucugccuugcaagaaacccugugaaaguccaauuuccguucaguugcuucauguccccacagcagacacgauguccugggucuccucuuuucuccauaugguacccacucuacucuaccuuugaaacagcccaaaaggcaaaauuaaccaaaaauuacauccugguuagagaagauaaacauuuaaaaccaauagaaauaaugguaagaagagacaucugcuaaccuaauaauauacaucauuguacccuguucaaagcaaugaugccuuauaaaacuaaucuuuaauugcugucugccacaagugacacagggaaauuucagagaagcccagccucaucauuuuacuauguuaagggguggaaaacaauccuugaauauucuucaacuucagcggccaccucucagcugucacuugcauaugcaauugcuuacuggagaaagguuugguauacgcacagauuucaaagcagcucugguagccauaguuacugacucauccucccgggccagagcccugugauucuguagcccucaccacggcuguuccuucuacaguaaugcaugaggcggcucagcuccagagcagcugggaauuagggcugccccucuucugggacuggggaggcaggcaauagcuugucaucagaucuuucuucucucucauuaguuacuuugguagcacguaucuugaggacugaggcugaaggaguuaacggaucuaccuauuccuucuccccuuuaaagagagagcagccacagcccagggaguggcucuuucuagcagcccaucccuucaaaccucccagcagcaguuaucugccacauguucaacaaacaacccuaccccccaaaauauucauuaaugcagauucacaguuaaaauggcuccagauuaaagccgagucagucauaauugagagggugcuaagcuggaugacuaucaaaagacauuugauuagggggccugccaaaacgcaguucuaaaaccacaauuuccaugcacaguguaauggauauuauggauaauuacccagagugcacuacucagccacacagcugccuacaauuacgucccaacagcuuccuccuccgcuucacccuucaagcucccccaugacgacuucuuacagcuuuuuccagaagcugguaucuuccugacauuaacaagaacagggcccucacagguauacaaggagggguggggggagcucagcaaaugucaccuguccugaggcuaacgugcacauguggcacccaacugauccugggugaagagaaaggaacauuuggagcuuagggaaagcuuggggacuucaaggugggguggaaagcaccauuuccugaagaaacaaagcugcccggucaaccgagggaggcucaaggacaccacaggcuucucauaugacuuggcugccuggcauuuacgagcauucuguauuaauauuaguuucuuuauuaaguaagaaagcaggggcccuuugccaucuguucaucauucucuaugccacugguaggagugcagaagauucaauaacagcuuuacgaaggaucauaaccagguuuaccugcagcuggacggccugugcuuaggcccgaggcaguggcaauaaaauaauaaaagcuccuguuugugaaacaagauaaaucaauaagggcugcccacaugacagaacuacuuucagaaagccucagugaaccuaggugacaugcuuuucucaaacuucacauaaaccaggccacguuauucagaaagcagugaggagaggcaugggucggcgugggguggauggcucugcagggaugcuagaagccuaaaacauggcucuauuucuacauggccagaaaaaaacacguaggcacuaaacuaacacaguggcacucaacuccagcucugaagguagacugaaccgaauagaagcuguuuaauuaguccaucuagagaugcugacacauuuccauucucgugagugaauauaaaacagggaacacauaggcacaucuuguuuucuaauugccuugaaugaagucugccuucuucuccuaucaaucaggauucuucauaaauuucuaauccacacauucuccuccuuuucccauuugaaucuuuagaccacuuucuuguuccaaaccaaguccccgguugcuaccuccuccuguuaaccccaugccagcguauuucucuggugugcuaaagcgagcccuagaguuaacugaacacugaaaacagcaauucucguucaaaugcuuucuaagagugucuaagaguguuguucccaauuuaauuauacccaacccaaagaugccuuuugaucugcugguuuaauuuauaugccuaagaacaugcuacuaaaagaagcguaugucaguuuuuuugggcaguuauuucuguuccauuuauaaucucucuagauucuaaaucaaacagaaauuaaaaaucaaccccuuuagaauaugcuauacugagagccugauuuaauuuacuuuguuaugugauauucaggaaagggauucuagggugugucuucuccacugaagaaacggcacugguucugucaacaguguauuucuguucugggcacaaaaacaguaacaguguuuuuuuccuauuaaaauaacugagguuuguaucaucucucaacuacucuauugugaugucacauaacacacuuucauuuuauuuuuuuggacacagggucucgcucugucacccaggcucaaucgauccucccugccucagucucccaaguauuugggacuauagacacacaccaccaugccuagcuaauuuuuuauuauuuuuauuuucuuuuauuuuuuguagagauaagguuuugccauguuacccaggcuggucucaaaauccuggggucaagcaauacaccugcuucagccucccaaaauguugggauuacaggugugagccacugcacccggccauaacacaccuuugaaaaaaaaaaucuaagcucauuaagauugagccaccucugauaauuuuauuucuccaggcuacagccauuugaaauacacaguggguaguuguauccuguaauauauugucaaaaugucauacaguauguucacguagacucagagauagacuauggcccacaggggcuaagaccaaaacaagucuguaucauugaaacagcaccugaaaaagacuuuccaagagggagagcauauccuauuugaauauaagucuucaugaucuugcccccuaaauuuugcagaaguguuacaaauacuuuucauguauucuacacuggagaacucugccuguccauguauuagaaacugucccauuaauaggagggauacagccaagcccacuggccaggccagaauaugaaugagaagcaagagcagacuugacacaaaaagccucaauggaaaucuaaacaaaaaacaucaucaacaacaacaaaucaaaacccgucugaguccagcauccagugcauaccucuuccgguucuaucagcuugaacuccaugccucgaccuguccaggcaaugaagugggcauuggcugggucaucaagaagggugaccaggaacugccacagcugaagggaaccucgccucugguaagggggccccucucgauacaugguaggcuccuguuugacuuugccuguuugggacaaggacacaucacacaauagcuuaguccuaaguuucucaggugguugggacaaaaaggaguuguucaugcugauuuaaucacuggacuugggaagagagucauggcugagguguucugacaccuccaaaccucuaccuggcaacaaaccuuggauggggcuacuuaccuuccagucucucaggcacaacacaagugucgucaaaguauaaucggggaucuuuuucauaugaaaaaccugaaagagaauuuaaaagaaagacuacguugcuuaacaaauucuguguuguacuaaaacuauggauuuaaggacuagagugcaauccuaucauuucagauccuaaguccuacugcuguaucuauggcagacugaauuuucagggacuucaagagggcuuaggcauuccaauucugauguaaucaccugcgccucagucagagcagcaucaauuccugcuuuuacagcuaagacugcagggaagugcugagucaccaguacguuccuuugcauuuugcuucugaggucugcauggaucaauguugcucugacuaagccuuuacagcuggaaacacaucucuauuucaguuggccuagcuggauggauuugguugaucuguacacagaccugccauuuuccuuuuagcuaaaauuaauuucaaccuuuccuacuaacucauccaagcuacucacauaccucguucaauuacgaaagagcuugaaggguaaagaauguugccaaaaugaauaaagacuugggccuguagaggauuucgaaagcaguauuggggguauuauuaccaaacaguggagaggaucugaaaagacuuucuagcaaugaaacaaauucacuguauagaugacaaaacagaggucaaggaggaacuggcccaacaacacaugcaaacgaaauaaaagaaggcaaggcaaaaaguuaaagggcucaagaaggaaggauggccugacagucuucauccacaaaccccuaauauacacucagugcuaaccaccaugucgcuaggcaccuugucaagauuggugguucaaaucaaagccagguaacagauaacuuggauggggucacaucccuccuuguaguucagccugucucaagguguaaggucuccagugcauacuccuuuaccagcacacgucuuaggagaaugccccagggcuccugucugauaagcagugcuucccugugcuccguuuuccuguuaguucaccuggcucauacuacaggucuguguguguuggauaaugcagugggggcaggcaggugaaaaggcucugcaaugaaggacuuccauuagaucugagaaggauucacugcgacuuaaaaaauccacgaggcugggcacgguggugagcaauuauaauuccaugagcaauuauaagguuuaaggguucugaaugaggauagccauaauaacaagugcuauguggcuuauggaggaguaggaaauaagugauuuuagauugguuuguugaagacaaauagccuguaaucucagcgcuuugggaggccaagauggguggaucaucugaggucaggaguucgagaccagccuggccaacauggugaaaccaucucuacuaaaaauacaaaaaauuagccgggcauaguggugggcgccuguaaucccagcuaccugggaggcugaggcaggagaauugcuugaauccaggaggcggagguuacaguggguggagaucacgcuauuguacuccugccugugcaacagagagaggcucugucucaaaaaaaaaaaaauaaaauaaaaauaaaaaauaaaaaaaaagaaaggaaaaauccgugaguaaaggugccaagguauaauuucaccauucuuuguuucuucagucaacccagaucaaguagcuucuuggcaggagcagcaccauuuuuaagaggccugggacugaagaaacucugcacaacugagacugcuuugagguuuauauuauucauuuuuguuuucucagcccuaagcauuaguucucuguugcuuaacgacaucaaagucuauuuuauugucauuuauauauuauuuaauccacuaaguauuuaugccaggcguugugcuagaagggaguagguagccaggcgaauguagacuugguccuuguucucauggagccugcaucucaacugggggcgacagacaauaaaggagaaaaagaaacgagagguggcauaguacugauggacuccagucagcugugcgaucuugaauaaauuaaucucugugcuccaguguccucauugcagcagauaaaaauuccuaccuuaugguguuguuauaagaguuuaauuuaguaucauucaacugaucuauuucucuaucuucauaccagagugccaagaguagcuccugguacauaaguguguaauaaaugguaguuaaaaaaauaaacauagucauuguacaacauugugguaagugcuauuaagaaauuaacugaauaaugucagagcuugaucuuauauccuccaccaaagauucuaaauuccuugaggauaaggaucguaucuugguaucuuaguguccucauggcaccuuacacauaaguacuaaauaaauauuugaauaaaugagaaguuuuauagucuucauuaaaaaauauuuaagaauauaaugcuaacuuuuaagucagggauucaaugacuccugauaaauuuauuuuccaauuuggcacuaaacugacuuuuaugaccaacugguauacucuguauuaccaacaagacuuucauaauccacuaugcuucaaacauuuugccuugccugccaggaagcuacauauuucccgaucuuccauauguauuuugauauuccggugauguuuuaauggucuuauuauaaagucauuacaagcgaacuacuucaaguuuacguaucugucaaacuugccauguuauuuucagaguucuucuccucuaagguaagaaaaauacauucacaguauguagaaaaaaacacaaccaccuacaucuagaagaaauucucaguuugguuuucaaagcuaaucagaugaaggucugccuauaagaaguaucacugcgguguaucuugugguuucuagucaucgccacaugugguccucuacaccaucuggaagauacuauugguuuaagugaaauuuaagucaguugaauuugagccagcaguuauaucaguuguggccacaaucaucuaaucacucaaaugaagguggcaggaaggaagaccuguuugaggggcaaacuagaaacgaaagacucaaaacauuaugcaaggacuccaggugaacacuuaaggcaggauggcuaucuuagcaaucacagaugccaaucagaaacacuuguuuccuuaacuguuucacaggcaucuguggucaagccuguauaaggauaggaaaagcaugucaggguaauuuagaacaauuaaaaaugcuggauucuuugaaacuaacuucuuugaugugugugaagucagggaaaggaaugggaaaggguggagggaaaacacacacaaaugcaccagauagucuguguguaguaagcaacccaaugccuugcuaaaaauauuucccuuaagagcaugcucuuuccuaaauguuguaauuaugcaaaauguuuuccucccucucuucccccacucccuccuaguuugccugcugcagacaucaacugcuucuguagaaacauucaggaaccucaaagagccccaugcagcugugcccaucacagccaguguccgggagacagcccugccuuuccagggcuggacacuuacucagaacaucacaggguacccagugaaacaacacucggucucccaucuaaccaagugagugcgaagcagcuacccauaaacacggcucuuaugaacuaaucacuuauaaaagccacccaaugcuucaugaguaucagcucuuuugacuuucauuuaaaaugacagagaccagugguucucaaccuuggaugcacacuggaaucaccuggggagcuuuagaaacuacuaaagccugggucccaccccagaauuucugauuuaauugcucuggaggaaaccuggaaaucuacauuuuuagaagcuccucagguaauuccaauguuugaccaaacuugagaaccguuacuacucaguagauuucaaacuugaaggugcaucagaaucuccugcaggacuuguuaaaacacagacugcugggccccaccgcuggggguucugauucaguaggccugggauggguccugagaaugugcauuucuaaaaagucccaggugaagcuguugccacagauuuugggaaucacacugcuuuaaaucuucagggagaaauacacuugagaaaaagaagacauacaucuggggaagguguucuaaaaaaacuucccuauuucaauguuuagaagggaacuccucaauccaccauaccaaguuagccuuugcccagaaggguaacuuuaagcucugagcccaccucuccaggccuuucauaucccucaagcaugaucucagucccuaccagggcuccuuuccaucaaaugagcccacugauuugcuacugucauucauuuaugcaggagcuuaaaagcccgauuauccucccccaacaaaaggaucccuucuuccuuuugauucacaucuaauuacuucuuuagauaaaucguaaaauuuaaaaaucugugacaauguacuaaaaacaacaacaaaacagacccucacaaaaaccggcagcagaugccuuaaaaaaugucauacccuccuuuacccagaaauuucagaaacuuagcuucaagaaucaagagaacaagaaaacacuuagcuagaugaauguucauggaauuugagaauaaccuggaaguacccacuuuucagcaauaggugauuagcuaaaagcauccccaugcaaugaguacugugcagccauuaaugaggaaaucauaguguaauguugggugcuauagagaugacauuggcugugaaauauggaaggagaugaagaguaugggcucuggagccacagggcuuggcuuagaguucuggcucuacucuuacagccacgugcccuugggcacaucuuuucuccuuucugagucucgguuucauuacccuauggggcaaauagaaacaucuaucccuugggaggccgaggcgggcagaucacgaggucaagagacugagaccaaccuggccaacauggugaaaccccgucucuacuaaaaauacaaaaaauuagcugggcgugguggcgcgcgccuguaauuccaucuacuugggaggcugaggcaggagaaucacuugaacccgggaggcagacguugcaaugagcugagauccgccacugcacuccagccuggcgacagagcaagacuccgucucaaaaagacaaaacaaaaccaaacccagaaauaucuauccuauagggcugcuaugagaauuaaacaacugaauuuaugcaucuaaagaacacauaacagugucugaaacauaguaaauguucaauuugaguuaaugacuauuguuuaaaaaaagacuauaaaacaaugaguccuauacgaucuguauaauccuauauuuacauaugcacagcaaagauugaaagacuauguagcaaguuaaugguuaucucugggcagugagauuuaauuuucaucuuuuugucuguuuguauuuucugaauuuuauguaaucaguauuuauugcuugugcuaaaaauaagcuacaaaaguuuauauuugaaagaaaacuaggcugggcgcgguaguucacgccuguaaucccagcacuuugggaggccgaggcagguggaucacgaggucaggagauugagaccauccuggcuaacacagugaaacccgucucuacuaaaaauacaaaaaauuagccgggcgugguggcgggcgccuguagucccagcuacuugggaggcugaggcaggagaauggcgugaaccugggaggcagagcuugcagugagcggagaucaugccacugcacuccagccugggcaacagagcgagacuccgucucaacaacaacaacaacaaaaaaagaugaaaaaaagcaagcuccuccaagaaacugacauucuagcuccauucugaccacuuccuugaagccauaugcuauggaacacuuaugcaucuuauuuguucccaauuacuuucacccuaauuaguaggucagcacuaaugaaggcaaagucacaggcucaaccuugccuacugcuccugcuccuaauuagagugagaugaucucagagacuuacugaauuaaguuggucccaaagggauagggcacaagaacuugagcagacagcauacacccuugauauaaaacgaucaucuucacauaaaaauaaauguuaggauaugugauaauccaggcuuguggguaaacugcuuuauaucuguucucauguuucuccuuugagguauuuuuuaaaaauccaaugagaaaacauuuguguccuucaauaaugcauuuuguacauaacauaccucuccacucccauccccaguacucccuacccccugcuagcucacuuccccaccagcccccucaagguuggugaagaauaccuucaauuucccucccauguuaaaaauggcaaccauuuaucauauaauaauaauuacaaugaagaguuacccacccaagcacucaaacuaaguaaaaaaccuagagacacauuuuuaaaacucuaagacauccuuggacccucacugacauaacuguaaaacauauaaaaaccacccucacugacauaacuccuaaauuccaguuucagcugauaguguuauauaaacauaaccuccauuucuggaaauguggaaauaagguggguuuguuuuuucuccaaauuguccuauacuguuaaaaaguuggggucauugcuaaugaaaauggcagcccucacagggcuuaggggcaugcuugaaacccugcgugcaaaauaauugaagauuacaaucaaucagcucucauauucaugagcuaagcaagguuuaaacuaugaucucaaaucuuagccuggaaacugagcaauuuuaagcuuggguauuagucaagcaaagaaagaggaaggaaggaagguaggagaaagaaaagccgagagaaagaaaggaagaaaggagaggagagaggagagaagaggaaagaaaagcagguuccuuaccuucauggcugcuggagaaauaacccccucucauguaggaugacuggcaguuaggcacuucugaaaggaaagcaaagguggacacaauccugucaauaguuucugcagcagaaacagcacaucggucaacugcagcucugugguaaagccccuaaacuuccugcucuggggucaugucuuucuggcuuuguccugggaaagaggugccacaccaauaagcaagauggcaaacaccauaacccaccagcugaaaggcaggcucuccuaaucaagagucacgggaggaaaaaaaagauguuucacucucauuguucacuuauuuuagaaauguguuaacacuaaaucuggugaaagagccaauggcaggggaaaaaauacuggcuuucaaaaggccaagccuggccucuugcccaugcugacuccuggguguuagggugggaacgggaagaggacugcuuuagaucuuuucuaauuugcuccccuuuacugcugguggucacaucuaauuuugcuccaacaggugggaguauuuuuaggccaaagggauuaggggaccugaaguuaggaagccaggaccagcauuggaagggguagaggauugcaguuugguccauuuuugccaugcuggggcugucauacugaaaccaaaccacacucaagugaucucuucuucagccaucauguuaucaguguccaucgagacgaaagacaguaauuugaguuguguccaugugggaugagccaucacccuggcaauacaacucagaucaaagaauuacagauaugguaaccucuguugagugucuugcuuuaagggaguggaguggggugcaaaacccaucaggacagaucaaaaugucagucuuaaaggaaaaaauguugcuguucaugcuacuccugagaaaaauacaucaaagcuuuccagaggaaugcugauggaaauguuuacacacgaucacuaccucacacuugguaauuuuucugucauaaagcaacaggucucucccuucugccuauuuccucagcauuucccauaaccaacuggugccugaauagaucaaucuauguauuaucucagagaaggucgagcaaauuccauccaaaacugaaccccaacacucuccaggcuuggacucagagauguacuucauaccacuucugaaugccuaccgcacuuccuaccacuuacauagcuuuucuguuuuguuuuguauuccauugcgcauaaacaugucagcucuacuagcuccuaaguuauuugagggcaauucuuauaaaaauuauaaaaaauucuuauaaaaauuccuguccccaaggcccugcauguauaagacacugaauaacgagacagaagaaugcaagaaugaagcaaagaauagcacaauuugaugcugaccugaaucgacgcaguaaucccgaggcuccugcuugauucccauuggugacuggaacccgugugcugggggcccuggcaugcccgggaccccauguucauagagugggucaugguauucuuguuugaaucccugagggggcgggggagcugcagggacaauagguucugacauuugccgaugguaacuggggcgauuaucuccaggaacuccuggcugaggagggaagggguggcaggguucagacaguugucucugaaaucu

SEQ ID NO: 16292 - RNA, 3191 nt, Homo sapiens
gcugcccagauggagaggcccagacuccagguguagacaucuggagcaggcaguguucagcuggggagggagcggggaggacuaugggggccacgugggaagaaguccagcccacaucaccugcaccccugcugagccuggucaacagaggcccucaguggguccucacucuccuggcugccucccauuuaggcacccugaggccuggggagaacagagccaggccaguguccccagagaggcugcgcugccagcacaguaguagcagauuuggauucagggaaguagaccugcagccagggugggaaagagcugcaggcgggguggagcccccacauggcacagccccccuccuuggaggucuaugcugcauuuccaggacagcaagucccagggauggauggugccuggugccaagggcuagaggcauggucugucugcauucccuacaggggcaucuuguagucaccagcauuugaugcugucaagucccccuguccucugugcagacugggaagcccuuggucacccugggggggguugggggacccaggccaggcugcagaaacauaaggacuugaacccggguccugagugacaccaccuuggguccuccucccucugccucuguucagcuccaccuugauggugacuaggcugggccaugcggagaggguuaggggauagagaugggagcuggggagcagggcuccacucugggaggggggcagccuugccggauccagggcagaguuaagcggccccagcucugcuuuccuagagcugcugagaacccgggaaaugguguggagguuccggggagcccugccccuaccuggcaaccgcagugcagcaggcaccaaguucuccugcacauugcgacagugugacccugggcucuggcgggcaguagguggggccuuuggaccuaccagcagugagggaguuaacacagcagcugacuccucuaggcaaggaaaacuccccucagacgcuuugcugccuggccuccugccagcaacaagcaggagcugaaaaccagaaguugaggcgugaguuuggucacuccguagugugcacuuggugagggcagcagcucgccacagcugccagccgucuguccauucacccaucuguccaucuggcagcccgcuguucagacccgucugucuguccgcccaucuguaagcccaucucugucccauugucuaucugaccaucuuucucuuacuguccucuuugucuagcuaucuggccuaucugucgauccaucuucgugucugucuucagcccccaccuguuuguccaucuguccaauuaccugugagucuaucuaugcaccuucuuguccauucaucugcccacccaucugucccuccgucugcccaccggccuccccucuccuucugggccgcagagccauggcccaggacugcagagccaugguuggccugguccugcuggggcuggggcuugugcuggcugucauugugcuggcugugguccucucucgacaccaggccccauuugacccccggccuuugcccacgccgcuguugcugcugacuccaaggucugcucggauauuggacggugagugagacgugggaggaagcuggguggcccuuggcagccagccccuccuggagaaggcgugugugugagagugugugugugugagcaugugugugugugagagaguaugugucaguguguguggguauaugagugugaguguggggugugggugugugugaaugugugugaucguguuuggguguguguaugugugagugugggugugugugaaugugugugaguguguuuguguguaugugugaguguggguggggguauaugagugugagugugugggugggugugaacgugugugauuguguuuugcugugugagggugugugugacuaugagugugugaguguggguguguguaaaugugugugauugugugaguguaugugugggugugagugugugagugugaguaugggggugugggugugugugaaugugcgugauuguguguggguaugugugugugugugugagugugugugugugcgugugugugcacgugcacuggcccaggcagcaggagccaugugugugggcuucagcaccugcagggcuugagcgcaaggagacagccucagggcccuugcacagaacaggcggcagggugugcccguggggcagauggggacuuggggacaaugguggugugugaguccauaccuggcuccaggauucaggaggcccauuugcacaucccaggugggaaccugucuggccccggcugacccugcuggccggugcaggccccuucagugaggccaauucuccaaggcugcggucuucucccagggucaugggugaagggguuuggaggcucccugcguggguacuggccugcuggguuacacacaaugcugccauagccagucugccccuacacccagccuggggccacaucucaggucucucaguccugaggagcccggugccccaccccucacauccucucucccugagucagggccugggucucgugagcugagugacugauacuugguguccuggaugagggcgugauggagaggggccacagcggguguuuccugacccucuuccaggaaggugcugcugccgcugcagggaggacacauacaggaugccccuuccugcccccugccucccauugggcccacaaaagccagggcaagccuccccucccugccagccaccuggucugcuucccagaaauucugucuugcaggcuguugggaggaucccaguacuuuguaaacuaaagcaagggaggaguggccguucucucuguucauucauucaccuuuucauucauuccuucuucccuccauucccccaucuguccauccuucccugcccugauugcucaugccaccgccccccgcagccccuccugaccugguccuuugguuucucuucagggauuucugucuccucccacagggcugagaauggcagcucagggacaaguaggggcuggggacugcuuagucuccccaguggcucucaggggauuugaggguuugacgccagcugccaccccaggcugugccccuccucugcucaggaggacauacaggaugcaacacccacuuaaacucgaaguugcaaagaugcaaaug

SEQ ID NO: 16293 - RNA, 7844 nt, Homo sapiens
ggcggccacaguucuccaucccacugcauacauggagagagagccuggggagggagcauccccggcaaccucguggaggaagcaggcagggcucagaccugccucacucuggauacuguugguggugaccccgggaggcggucauggaacucuccagaaccagggcgcagcaugaacaccaggagaccagggaaggaaacaaggcgcuuguuuucucuuugcacaggcagggaggguguuccugagugaccuuccagaagaguucgaaauuauaagccuggagugccgagggaggccucugccgcugggggucucgcugucugcuuugggguucuggggccucuccuuaccccaucuggggucccaggaugggcccagggguccaggaaccaaggcagcacugcacuggugcccgcacgguccgggagcaggccuccguagaucaggggucaggggccccggcaucaggcucuggggagugagguauuggaaucugaggcucaggggucaggggccccggcgucaggcucuagggagugagcuauuggaaucugaggcucaggugugggagugucagggcucaggacauagguauuagaaucccaggguaugaaguuucagguuuggggaauuagagccgugaguauuuggggaagagcacggagcgcugcuagcacggggcuuggguguuggaacacugggccuccugccuggggucugagaugacagaguaggggguuaaaugcccagguaucaaguauccaggucccaggugucugguccuggggaugcgggagucgcaggacugggcugccuguucucaggagucuuggccuggugcucacagccaagcugcucccaucagggcugugcaccccagacgugccugcaacagaaacgcaguuagaaguagccucgguggucccaccggcugucucggggucuugggagaggggcuggggggucucacguguugcccuuccugcggcgcagcagcacauagacgagcgcaaccgccgccaccaccgcgaggcccccaaagaugaugcccaacagcaccgcguagcugcguccuggugagggagcgagugucagugagggggcucucugggguggugaguggggacaggugcaggcagguguaugagcagaguguccucaccuggcuggcacuucggggugggugaggaccaggugccgucagccuggcaggugcuggucucugccccggccaggcuguagccguugucacaguggaaguagaugguggaacccgccagguaccuguugcccuccuuuuguccguugggagguggggccagccagccacaggacaccacugggauggggacagagugcagacaacaggccugagcugccaugcauacacacaucuggccaccccgggggguccugucccagcuccccgcccacccccaccugcccgcccucaccuggcugcaggcucugcaugcgacgcuggugcagcuggugggccacccgaguggcagugcccgugcucaggcucccaguggcugccacaucaaaguugcagaaaugaucguccccacauaguuuggcugccucuugugccaggcugggguugaggguggucucacuggggaagaggggcucgaagguggggucgugcuuggguugguacaggaaguuguggaccaggaaccaggaaucguaggugagcagggaggacgcauugugcacggucccuggaagauacaugaccggggccuggcugggcauggcucccuuugguccccaagcccugcccgugccauguuuccaguaacccccaccccgucugccccauauacuccacggucacucacaguuggccccaaacaggaacagcuccuggggacuggugccugggggcaggacgcgcccgcugugcagggugaagucgucgguggggucguuguugagugucccgaggaggccgugggugugggugaggaacuucucaggcagcaggacggacacacucaggaacgggcccugcacgcugaccuccaggccggccccugaugccagcaugauggagacccuguccccggcagccaccgacaggaacauuccugggcucaagggggaugcauuagggucacccgcugugagcaucuuguccccucccgcagccccaggacaggguggucggcacccaggggcugugggugagggcaccugcaggggaagggagggcguucccggggccaauucugcugaccaugacccuccgccaccccugccaugcuugcgguggaacucccagcggcaccugaggugcagccccugcagugaaucccccauguugagaugcacgugugggucccucuggccuuggcugcagcagccacaccugccugggcacgucccgagggucccugaacccucagugcugacaggccccucccagguccucacccaucccaaccaggaauccuuucauugacucaguucccugaggcaagggguucagauguggagcuaccacuugccaggggcauccuuaaccgugcagggcuggagaccuugcaguggcuuuugaggacugagggagugacaggagcacaggaguggcucugugcaggccagcggugaacguuaccagggugaguuccccuccagaaggcucccgggauccuccguagggaggacaugucccaccgucacggccucucggcuuuugaccagguggguacgacgggggcaccucggugggugugaaggccugaggucggaccacccaggccucuagccaggacugggagaggcaugaaggcccagggcuuccccucagucucccugcaggaauggggaggaggugagggcagcccgcagccucgcguggcuggacugcucaccuuucagguccauccagcucugcucggugaagcucagcaccuccugguucagcagcaccuccagaccuccgguccuguuggccagccugacuuccaccacaucugaguugcccuccuggacggccacugcggucagcccagugccacgggucuccgugccugcgguggugggagcagaacgggagccacuuggcuccagccucccaccuugguucuaccccaugccaaccagagcagccccuagcccuggccucaccguuggacaucgucccgggcugggcccgcgccugcacccucaggucggucagcgcugccuccagcagcacguacucuccgcgcccauugaaugugaaguuggugccgucgaaggucacaaagugugggucuccgaaggcggaggcuagggugagaguggagggucacgugggggugcaccccagcccagcccgaucuuucccagggucuggggcacgggauggcacccacccagucuugggggccgguaguugcggcagucauuggagggccgccguugcauguagcgggggcagucgggugcccagaggcagcaguaauagaagcugaggacaucguagagccagugggacaugcugggcacucgggguggcgugcggaacgggggugcgccccagucauggccgcggucgggagugcugccgccgcuggagucagcugucaggagcugcgucccguccgcuguguagcagcacugcugaccugagccguaccggaggcugcaggagccagugagucagggccaggccacuguugggagcccaccccugaccccaauccccauaccggccccagccugggggcucaccuggccugcacagaacgcacacagugcacggccccggggugguaggugcacacgcugcccugcuccaugucacagccguaguccgucugcagagcagcagguggcugucacccaguggccucggguucugucauccccucccugaggccaacccugcagggguccugagaccccagccccacccuccaggacaccucugucugccuccccuggugcuguccucaguggggaggcuaaccccucauccccucuccugggcccugaugggaggcucacgaagaagcggccggagucagcccgggccugggucagggugcaggggcaguccggcagcuccuccaggaaguugggcagcugauccuccagcuccucccaggccuggcacugaguucgugcccaggccacaggguccucucggaagucaucgcucaggugccaggccagugcguggucguugguccagagcgccugcacgucccuguggaggugaugaugcuggagcugggccagcccacaccaccccauggucgccccacucuccccacccccagccugggcugcccaggcaagcaugaugggccucgggcggcgaggcccuccagccaucaccugcacauccaugccuucuuacuucugcccugcguaauuuuugcugucgaugauccgaagugcacccacucgccaucucugguagcugggaggagcagguuuuggggugaaagugaaagagccggaguuggggauguguguggccaggggguacagguacgaccacuuugcaguccacuccugugaguagggcauuccugagggagaggaugccugguuagcccugggguuccuucgaggccuggccccaggccuugccaccuacagcagccugacagauggguggauggaccgccaggcgguccccuuaggaggggcuguucuagcagggaccccggcuugggugaccaucaccuccugccacacuccaggaucccugucccugcuggaagcugggcccagggccaugccagccgugcagggguuccucaugagccuccuccccuggagccaggccccaugagcugcccccucccaccugccugaccccccugaccugcacuucccuccauccgaauccucaaucucugccuggaauucccuucccuccucaaccccaccuggaaacucccuuccuccucccacacagcugggacccccuuucucccccucugggggcccaaagcucugaugccaccccagcccucagcuggccucaccugucuccucguagccccacaguucgauggugauggucugcgugggcagcgacuugacaugccaggucaggcugagguugccugagguguuggcggugccguaguauugccaacgcgucucguucaccaacucgcucuucuccaucauugacacuuuguuggggugcacugggcaggggaggugaggggugagugagggccugggcccagggaagcagggaggaggcccugaggcuucaagggcugugggagccuccagggccaaugcauggcagcagcugggugauggucucucuggcccgcacagcagaaaaggacgcugaggccgcagaggcaggggccugcccucccuccacugcccacgccucuagccucgaccuggcuucuccccugcccuggcauggcggagcucaguggauaggcacuggcccaccucucuagggaccccugcagcucccacucacucugggcugggaccgcggucuggaugccagggaguggaaaggagcugaaggaacucucgcaggcgggcaggccucccaagggacugguucagccagagaggcagggcacggacaggccaagucucggugugcauagauuagcgcuggggaaaguccccgugggggcaggcugugggcagggaggagggcucaccagccagccaggugcccgcacgagggaaggaguggccguuguccagugacacagugaaggggaugcggccgcucucauagagcagaggugacacacagugcacuugcccggaggaguccacauggccgagggucuggaugcuguccuuaaaccugugggcguggugguggugggaggggcugggucauugcaggcugagccucucgauggucugggcccccaaccucccuggggaacccaaccagccagcugucccugugcccuccugccuguccuggguccgaggggcuccacucagccagucagugggucugagcccucagcaugcacagggaugggggcguggggccccagugcccggccuccugggccucccaaccugcagaucacacuggcgucuguggggcuggacaucuugaagugccgcaccacaaaguccuugccgcccaucauggauccugaguagggcaauaucuccaggcagaagucccggaaauccaagcagcaggugccaaggccagagcacgucggguggcaggaacauggcccguccagggcgccacagcgcauggagcagcucucuugggcaucuggaggagaggaugcugagggccuggcccggcggguacuggacuggcugccccaugugcagggccugucucuguuucucccacagcccauuagacagcagcauccccaggagaacgcuggccaggaacugcacaggccaccagguggacacaguagaaagccacagggcccguggggaugggaugaaucuuagcacagaccaucuggcuguugcccugacugacgggcuagaaugcagcgagaagaggcaaaaagcugcauccgcucagcccugcagggucaggagaagccccugggcaugacugcccuucagccaccaaguccucuaucccacaggcagggguccucagugggccacgguagcuggagcccucgaccucucuuggcuccccagggugucuguggucagcacgccuucugggggcccugaagccugcagaagaaccccucuugcuugccuggacuggggugggggauauggcugccaagagucucauuugaggccugguagggaauggugcagggucugaacgugacacuucucgcucucccaggggcugcaauugagaccccaaagagagcuccgugcucagggcagaaggccagggccgcuccccuccuuucuggggagaggagggacauuucaagcaggggucccagcaguggggaaagggaagugggggugcacaccacaaggggcugugggcgccgggcccaaaacuucuccuaugggccauaagaccggugggcaaggccauauuuccaggggcuggcaugaaggaaggguugcagggagggacuggggcaggugcaugcacccaggcuggaauugcacuucccuggcccuuccccaucccccaucaaaagaggccagucgagggccaggccugggccugagccaccccgcuggccccacuucaccaagugcagugccuggcacuuaaaagcaacaauaaauauguacuggccaaggauuugguggcgcacaggggucgggggaggaggccgagagaugcuugcaagugagauaaguggcaagagggucgaugggaaauggggugggggacggggggcagccugggaccaguguccugguucuggaguucggggcuuucccuagacuuuccuggauucagccccacccugaugaggacccacaauccuggcucccccuccgugaucccgcccugucagggcuggggacacaggcggaggccucugcuggucucccccgccucccuccuagcuaccagcagguuuagggugggcccggcucagaccucccauccccaugggcugccccuccacauggacccucagaauuucuucccaucaccccuagcacagccacagauggccugacagauggacagaggcugagcccagagggaugucagcccaggccuggcugcagacagauggacagacagacggggacacagaagggcagggaggcauaccugcuguggguccggggcccgggccgagggcugucgccagcagcagcagggcccagggcaggagggcuggcuucauggugcagccugugucugcagccagcagugcaguggcuccgaggcgaggcggccagacaagcucacu

SEQ ID NO: 16294 - RNA, 3089 nt, Homo sapiens
ugcuggcugggccacgcgugcuugagaagguucaauggcguggcagggacuagcggccgaguuccugcaggugccggcggugacgcgggcuuacaccgcagccuguguccucaccaccgccgcggugguaagcggccgggcggaccggacgucgccuugguuacagccucuggcgggaggggugagggucgccaugguuacggcguggcucccgggcagcucuugacuggccccugguuccacagcagcuggagcuccucagccccuuucaacucuacuucaacccgcaccuuguguuccggaaguuccaggugaggccgccccgcgccgcgcaccugugggcccgacccacccaccccgcaccugaccgcccgucccccguaggucuggaggcucgucaccaacuuccucuucuucgggccccugggauucagcuucuucuucaacaugcucuucguguauccugcgcccugcggacacgggcuggguggagggcaggccggccgggcugggagagaggccgggacggggaaacugaggccccgccugguggcacuuccuauaccgacgccguagguuccgcuacugccgcaugcuggaagagggcuccuuccgcggccgcacggccgacuucgucuucauguuucucuucgggggcguccuuaugaccguauccuucccgcaggcucuggaaccucgggcuagggcgccucggcguccagccuguguugguccuggggccaacacagccaugccagagagggacacagucgcugucuccagcuuaguauguguugagggcccacucugugcucagcugcaggggucagggcuagaucuucagugcuguaugcaaaauacaaagccaugcacaaaagagccagguggguugucagggccacuagcugagcccugaaugcgaguagccgggagaaacuggggcagggacaggcagugguugggcccugggaugaggcuguaggugugcagggcagauuucgugggaccugaagcccguggagugugucgccuuuauuggacuggcucaucuugaugagggaauagcacauaggggagaugaggggaagaauuccagggucuugggaagucagaggggcccugggcuugggcugaggccugcaccggagcaccuugacucuggcccagcugcugggacuccugggcagccuguucuuccugggccaggcccucauggccaugcugguguacguguggagccgccgcagcccucgggugagggucaacuucuucggccugcucacuuuccaggcaccguuccugccuugggcgcucaugggcuucucgcugcugcugggcaacuccauccucguggaccugcugggugagccucccgguacaucuaguccgccccaggcuggccacuccccucaggacacgcugcuuaugcccuggggccccucucccauccuugcuggaguucuccucacaccuggcuccauccccaucuuccugcccucccagcugcugugcucuuacagccccucaagccagccggcccacauaauuugcaucgucaggacggaucuacugaugcuugcacgguccugaugggagugaggaugggagggucaggguuccugccccauggcucccacuccuccacuauucucaggcccuccccucccuggguccugccugcuucugggccuuuuaagcuuguccuucacggccaacccggggcuggcacucugugcaaggcuuuggggcacucaugcuguggggccugcagggccaccaggcuguggaugggggccuggggcaggcucugcuggucuaggacucugggcuguggagggugaccccacaguccguggcugucucacagggauugcggugggccauaucuacuacuuccuggaggacgucuuccccaaccagccuggaggcaagaggcuccugcagaccccuggcuuccugugaguguugagagcccucccucccucuccccacccucagaaggauccccaccgauggggaccugugcuggccugugcucaacacgggccccuccccacagaaagcugcuccuggaugccccugcagaagaccccaauuaccugccccucccugaggaacagccaggaccccaucugccacccccgcagcagugacccccacccagggccaggccuaagaggcuucuggcagcuuccauccuacccaugaccccuacuuggggcagaaaaaacccauccuaaaggcugggcccaugcaagggcccaccugaauaaacagaaugagcugcagucucuuggcccacagcacuggcuuccccaucucaccuggccacauccuucuaugccugccccguccucacucaguguggccucucagcccaacugcaggugguaggauaggggugcccacagagggcaaagaaacugcccaugguugccuggcagagcuuugagcucacagguugccaggcagagcuuuugagcucacaggugacaggcucaggguucucauccuggccccaccagggccuugggcaaguccugcccaccauaggccucugcuaccugccagucagcggggaaguucaccagauuucggcugcuggggccaggacaggcgucuccuagguugugccaaaccagccuacagauguuccugccaguggugccuucaggcugaugccaaucuagccucuccugucucucaucagccacccugacaggugggcguaugccucauuuuucaucuggugaugccaaagccccauggauucaggugcagaagagggccaggacuaggucuucugcccuuucuaugaccucagagccuaaguuuucaccuuagcagaguucugagacugggugaggcagggacuucuggaagguucuguuccugcccuuuuuagcugaggacgugugugagccuuauccgaccccuguggcucauuuuucucuucugaccuggcagcuuuccuuguuguucuaagccuguccauguugugguuuauuucuggaugcucaguggcacggggccuccuccaaagacagguugucauuuucaugguaacaacacuguucucuguugagucu

SEQ ID NO: 16295 - RNA, 11500 nt, Homo sapiens
aaggggcggcggcccggagcggcccagcaagcccagcagccccggggcggauggcuccggccgccuggcuccgcagcgcggccgcgcgcgcccuccugcccccgaugcugcugcugcugcuccagccgccgccgcugcuggcccgggcucugccgccggugagugcccgccacucgccggccgcuccucgcugagggggcgccgggcacgcgggcugggcccagcggcggauccggaccgaagggggcgccccggguggccuccagcgcccgguacccgaaacgcuuucugguucccucuaggcgugauagacagcgagcuugcagucccugggggugugaaggggagccggcgccggcaucguucgggcuggugggacgggacuccacgcuggacucacgcuugcucccagcguggggaccugccucucgcgcuccagccgcgggugcuggagugugcguugaaggaagcagcagagggagugguaacagggcccccuauucaucgcagggacaaagccgagcagaucccaggcaggugucagccugcagguguguggccgcaguuaguacaccuccaggugugcggugggaugaaggauaaagggagaagggagggcagcgcugugcugcgggaaauggggucuaagccuggagaugucccccgcgggcaccugccggcagcaguuuugggaggcuuggagccaggagaacaugaguaugaaauaguaugagugcagugugugugugacugagagguggcugucagaaagaagcggggagagaaaggaaagggagaaaaugugugcucaggagaggagaagaaagcccagguaagagaggacagcagagugaggagaggagggacugucauggagugugugugacagcuugcaugugucccaaaagcugccccuucccuggggcgcuuccaggcaccagucacagggccuggggccagagccugggccacuccacuccacagcggaggcauccagacagcucgggcagggaagggagcaggagggugugacaggcaggagucucaggacuggccuggugaggaggcaggccuggccaggcugggacccucuguccagccacucuggcucugcucagggcagccuuguccugugcuggcuaugggagcagaaagggaugggaugggugggguagagugaauggggggcaucucagucuggagucuugccuccuucccagccccucuugguuccuaggacuugggacagagucaggaaucacuguggguagacauugaaccacaggucuggaaauuggagagaucuggguuugaaccaugugacccugggugaauccugccaugccucagaaucucacccacuccaucucuaaugggagugcaggugggagggggcaauggugccuacugcuguguccacuguugagcaaugaggugaugccaggcucacuagaaacacugucaccuguagcugccacuuugacgcuugugcauggucagugcuggagcugggggccagcuugggguggggucugagcuggacuguggucugucacucugcaaacacgcagggagcauguggggucaccucugauguguuuaucccccggcugccuucagcaaggcugggagagcucuguaaauauuuauccagcccaguucccagcuuucaggguugauggaagcccugcaguccgauggaugggacgaagcuaccgucccuccuggagccagcagcagaggggugagaauaggaagauuagguggaagcuugagggagaagauaucccugcuugccaccuggcugugugaguugggcagguugcuugaccucucugagccugcauggugaugcucccgucuuccuccauagccuaacaagugcccuccucgaagucuugccucccaccgacaucagaaggcauagcuaugauuaauuauacccacuagaccaacugcaaacugaggcccagaaaggggcacaaugagcccagccuuucgcaguguuuccuggcacccugggguccucccuuaucuccccucuaucuggugccucccauuuucuggauugcaaguugaccccagggcgggguugacuccgagucucuaagcucugccaggacacugggucagcugagaaauuccuugaaugugucugcagcugagguuuggugucuggcagaagaggguggggcugagugagcuaagaacccaccacagggcaggccaagggaggcuacuggccaagacagagggaaugcacuggaagcagaaaugcuucuugggaaaguggguuuuggagaaaagccaagagcuggggagacagggggaagcccuggaggugggaggcaugagccccaggucuagguccagcucuugcaugacuugcugugugaccccgggcaaaguccuugagcucucugggcucugucucauccucugggaaaugggggagcugcuucuuccucaagcuccccagggguguagaugaggccagugguggccugugucuaccaccucaccucacugaauccugagaguccugggaaggccaagcccaccugucucacaaguagcaagcugcuucaugccgugccuuguaguuagggcaucuggccccaggccagaaaggacuuggaaagaugaagugugggaggacagugaggcagaauguguguccuaucccagccauggggaaacugaggccaagagcucaugggcucuaaaaaaauaaugggcucuaaaaacaaccucacuagcuagaggccucauuucuagcaucuccugcucacucaguuucuaagaauuuaaugaacaagacagggacagggagaagagaccuugauaugugggagacccugcacaaggcgcuucucuuuucuaggccugaaagcucccuucuagcugcaacuucuguuuuaccauuuaaagccugaagauuuuguuggguagcuagaggggcggugggugaugggaacuguagggacuggcaagggcagauucccaagcgugggaggggagggccuacagggacaaggaacagggccagguaagaggugcuuuucugugccagaggcuacagcaggcauuacagaaggaugucauguagcccuuugcuguggcaucauucccauuugacagauaggaaaguugaggcuaagagaggaaggugacuugucuagagucuccaugucauagaacuaggccuucugaaccucaguggcuggcucuuuuugugacacuaagacugucaugauccagggguuugggcauggacugggugccucaugagggaaggacaggaagggacaguggaaggggugggggcaugcccguggcucucccuccaugacugucugcaccaggacucacuagagggcagaggagagaagagauuucugaccaugggcauagcagggcuggcaggcugggcucuggguuguuuggagcucccaggggagagcacagcucugcccuuuccagggagggucuucauaccccugccaggcuggggaaaggaaucuguuucuccuguaagucaagggggcaguguggcgaggaggaggaggcaggccccucuggcagcccacauccuccaugggagaacuuggauauguagcaucuccaccugccugguggauauuggaagcccaacgaaccugccugcaaaaugcccgggaaauagcaggcgcugaauaauuugcaccucaccaaggugaggccagccugggucccuccuucaggggaaggguaacucaaccccugcagagcagagcagagguagcagggagcugggugggcugugagcacagacaguccgcugccugccagcuguugucugaucaagcugcuuaacuccucuggggcccauuuccucauccuggaaaugagggugaugaugguggaguuggugagagguuccaucaggggcuaagagcaagucuguggagcuguugccaagguccuagccugcaaccagugcuaaguacuuuuuuuuuuuuuuuugagauggagucucgcucugucacccaggcuggagugcuguggcacgaucucggcucacugcaagcucugccucccagguucacgccauucuccugccucagccucccgaauagcugggacuacaggagcccgccaccacgccuggcuaauuuuuuguauuuuuaguagagacgggguuucaccguguuagccaggauggucucgaucuccugaccucaugauccgccugccucggccucccaaagugcugggauuacaggcgugagccaccaggcccggccaaccagugcuaaguacuuauuaacaauaagcccaggccgggcgcgguggcucacgccuguaaucccaguacuuugggaggccgaggcagguggaucaugaggucaggaguucaagaccagccuggccaagauggauaaaccucaucucuacuaaaaauacaaaaauuagccaggcgugaggcugggugcgguggcgcaugcuuguaaucccagcacuuugggaggccgaggcaggcggaucacaaggucaggagaucgagaccauccugguaacauggugaaaucccguuucuacuaaaaauacaaaaaaauuagccgggcauggcagcaagugccugcagucccagcuacucaggaggcugagucaggagcauggcaugaacccggaaggcggugguuguagugagcccagaucacaccacugcacuccagccugggcgauagagcgagacucucucucaaaaaaaaaaaaaaaaaaauuaaccaggcgugguggcaggcaccuguaaccccagcuacucgggaggcugaggcagagaauugcuugaacccgggagguggagguuguagugagccgagaucgcgccacugcacuccagccugggcaacagagugagacuccaucucaaaaaaacaaaacaaaaaaccaauaagcccagaaucggccagaacccacaacccagugagacugcgcugugccagguaaccaugcaauaagcaagcucggaaauggggggaagcugcuucagggccucacgcccuaaguaguuccauagccuccguguucagaaggccccccuucauggugggguguucuugaugccucagcucugggaucaggagcagggagcguugggacgcugaucagaucccugggguguauggagccugggagagcugccaaaggcugagggugagguggggccugaguggcugagcuccuaccccaaauauggcugugaggaggcugcaguugcccagaccagacaggugcugagucucucagcaagcagcacagcuccaucccucuccuucagugcaggaaggacacuuggcuucugugcgguguccagagccaggccuuagccuuaggccugagccaccagaguccuggccuggccuugccaugcccuugcugggugacuuugcagggucuccaaccucucugagcuucugcuuuucucaugcacaagaacuguaacuucugcccuggagacuuauagacagguagcaggauguagcuuaggucugaaucgccaucugugguccuggggcuuuggcgaguggggcugggcaccugguaauuaacuguccccacccuccccgcuugaagaaggcaggcagaucacagaucagcucccacuguacuccuagcccugguggggugugaccaaaaccaccucugcuagaagccaggccucaguggccaggugccuucccgggugcugggccugugcuaggugcuguacauaccucaccuuguccaguccacaagucagugucacccccagcagucagguuacacugacugaggccacacugcagggcuacagccgcuccacacuggggaggaggugggggaaauccugggcaggagagagggcagauccugcucacaugacagggacaggagcaugacccaggugugucugaacuuagcggacacaggaagaaagggaguuggaagcaaguuucuguggggagcaggaggagguugccugguguuccuucggaggaagcuuuuugggguccauuccuggaguguauggcucauagccagucccagugugcccccacccccagaccucauuggccuaaguagcuggaguaggugacaggcagcccagggcccuccacgaugugggggacagcuugaugccuuggaacaaggugccaagaaaccagagagccagccagaugccaaagggcccugccaugugccggugcccuuucccucuccauuugcccagccacacagugggcugggguugcacguguguuugcugacaggccacaucucuaacugugggccauguggaccuuaggccugaccagacccucaugucauccuccugccuaggacgcccaccaccuccaugccgagaggagggggccacagcccuggcaugcagcccugcccaguagcccggcaccugccccugccacgcaggaagccccccggccugccagcagccucaggccuccccgcuguggcgugcccgacccaucugaugggcugagugcccgcaaccgacagaagagguucgugcuuucuggcgggcgcugggagaagacggaccucaccuacagguaggggccugggagcaggacacuaggaugccaccuguguguccguggguaagccagcugcccucacagcugcugcuugagacacaggccaggguagaucuucgugucuaacagaccuguguguccacugaaccccagggaggucaucuaugggcaaacccccugaaaccccaacuuagacacauacacauauggagacccucccucagcagaggggcagagccuccgucaucaugcaaagagucgcagcacaugccugcggacggguguucagucacucaggcagccuuuacaagagaccugugaggaccaggcucugggacuccacggugaaugaggcagacacagccccauccucugugucagucugaggugggugucagccaugucauuguccaacucuaccaucacaacuugggcuucgagcagguggagacagugguaagcggggagaggcaauagugggcaucucacugggugaccugggaggacccugggcaggugauggggaagcugaggcucacacauccugcggguggggacccagccugaagaaugggcuggugucacacagcauuggagcugagacuggggucuuuagaauuuccuaggugggggccugggaaccaacaggggcucaaggaaccaagguguccccacaguaaguggcacugucaggucuaggaugggggucucgggaccccugguccugguucuuuccacugaauucagacacuuguauuugccuaaguaugagcaaaccacauacacaugugcccauguggccagggagaccagugcgcugaagcugaggcccagaguacaccuggccuguguccugaguguucacacacccaccaagcauccaggggcaacuccuggugccucagccaucgggggcugucccuucccugaggcccaggccccuccaucucccuccaggauccuucgguucccauggcaguuggugcaggagcaggugcggcagacgauggcagaggcccuaaagguauggagcgaugugacgccacucaccuuuacugaggugcacgagggccgugcugacaucaugaucgacuucgccaggugaaugggcggccugggaccccuccgggaacagccucgccugccagcagccacugaccccgcccccacccaucuguagguacuggcauggggacgaccugccguuugaugggccugggggcauccuggcccaugccuucuuccccaagacucaccgagaaggggauguccacuucgacuaugaugagaccuggacuaucggggaugaccaggguaugggcuggggacccauuuuccagauggggcaaccgaagaucauaaagaauggggacucgccaaggucacugagcuggggucuggagcuggauguccugggcaggagguucggggguugcugagccaccucccuuuuucaggcacagaccugcugcagguggcagcccaugaauuuggccacgugcuggggcugcagcacacaacagcagccaaggcccugauguccgccuucuacaccuuucgcuacccacugagucucagcccagaugacugcaggggcguucaacaccuauauggccagcccuggcccacugucaccuccaggaccccagcccugggcccccaggcugggauagacaccaaugagauugcaccgcuggaggugaggcccugccugccagucccccuacuccucugcuggccacugugacugcagcauaugcccucagcaugugucccucucucccaccccagccagacgccccgccagaugccugugaggccuccuuugacgcggucuccaccauccgaggcgagcucuuuuucuucaaagcgggcuuuguguggcgccuccgugggggccagcugcagcccggcuacccagcauuggccucucgccacuggcagggacugcccagcccuguggacgcugccuucgaggaugcccagggccacauuugguucuuccaaggugaguggggguuggggaucugcucgagagacuucccagagccaggaauguuauggccaagggcaggaacagacagauggauccuuagggacacaguggauagggagagcugccccaaagccugggggccgagggagagagagugugguuuguuccucaggcacagguaggagguucucggagguggcucuugagauaggagcagcguggaagggauugcacgguggggccucguguuggugcguucaacccucagccaccccauggggcgggguucuagagaugaggccucuggggccccgaggcagugaagugacucacugugagugcagcugggaagaggcagggcagggaauugauccaggucuaucauccuagagcugggauuuccauccucaacuggcagagaugagagccuggagcauugcagaugccagggacuucacaaaugaaggcacagcaugggaaaccugcguggguuccagggcaguccagccugcaggggcccagggaguggucaguaggcauuugucacagccaaaugccaguggaaggagcagccgcccaggcagcccucuacugaugagaguaaccucacccgugcacuaguuuacagagcauucacugccccagcuuaucccaggccucccgcuucccucugcggguggggugcugagcaggcauuauuggccugcauguuuuacugaugaggaaacugaggcugggagagucugugguaggggucaagcagguccacaguggcggggcauggcagugguggcugggcagguccuugcagccuucccucuccggcaggugcucaguacuggguguacgacggugaaaagccaguccugggccccgcaccccucaccgagcugggccuggugagguucccgguccaugcugccuuggucuggggucccgagaagaacaagaucuacuucuuccgaggcagggacuacuggcguuuccaccccagcacccggcguguagacagucccgugccccgcagggccacugacuggagaggggugcccucugagaucgacgcugccuuccaggaugcugauggugcguugggggugaggcagcuggugggaggugggcacagcagccgcuucucccaccuggugguggcugggcucccacaugccugccacaggaagucuggcucuucaucacagguccuuuguccagagccaucugcccuccucucgguggccggcuagugcuacauuccauauugcagaugaggaaacugagggucagagaagugcaaggucuuacccugguuuuucagccacagccaguagaacaauaaacugcuguacacugagggccaacaaugcucuaagcuccuuacuggucucauccaguucucagaacagcccucugaugugacaccuguugugaacccaguuuccagaggagcaaacagaggcucaggcaaugaggccccuaaccuggacuacccugguggucccugcuccuaaccacugacccacccagccucccacaaccacagggggcuagagccaguccagugcucccuccccugcuaggcuccucuucugugcucuuucucccacaucaggacccacugggagagcuauccuaggguagccuccagcuccaggacuccagggugcccgucaauagccuggcuaauuuaauagaugcaggagagagugauguggaggguggugggggcaacgggacuugcuuuccugagaggugggacucaggccucugaggcucuggguaccugucaggcuggguauuagcccagcccagauuccggggcaggcagaagggcucccuagagggaagagagguucugaaaggccggcccuggauccugcaggacucgaggaacucagcaguggccaagggcuucccacucagcccucccuuagugcccaucccugggcacagccugacaggcaggaguagggcccaguguccgcucgcccaggcuugaccaccuucucuucucaggcuaugccuacuuccugcgcggccgccucuacuggaaguuugacccugugaaggugaaggcucuggaaggcuucccccgucucguggguccugacuucuuuggcugugccgagccugccaacacuuuccucugaccauggcuuggaugcccucaggggugcugaccccugccaggccacgaauaucaggcuagagacccauggccaucuuuguggcugugggcaccaggcaugggacugagcccaugucuccucagggggauggggugggguacaaccaccaugacaacugccgggagggccacgcaggucguggucaccugccagcgacugucucagacugggcagggaggcuuuggcaugacuuaagaggaagggcagucuugggcccgcuaugcagguccuggcaaaccuggcugcccugucuccaucccugucccucaggguagcaccauggcaggacugggggaacuggaguguccuugcuguaucccuguugugagguuccuuccaggggcuggcacugaagcaagggugcuggggccccauggccuucagcccuggcugagcaacugggcuguagggcagggccacuuccugaggucaggucuugguaggugccugcaucugucugccuucuggcugacaauccuggaaaucuguucuccagaauccaggccaaaaaguucacagucaaauggggagggguauucuucaugcaggagaccccaggcccuggaggcugcaacauaccucaauccugucccaggccggauccuccugaagcccuuuucgcagcacugcuauccuccaaagccauuguaaauguguguacaguguguauaaaccuucuucuucuuuuuuuuuuuuuaaacugaggauugucauuaaacacaguuguuuucuaccug

SEQ ID NO: 16296 - RNA, 3031 nt, Homo sapiens
ccgcccccacugccauggagaccagcuuggaagcuuaggggagcugcuguggcccagggcucaguggggaggaagaggaggccaggagucuuggacuagcugcaggguuugagcuaggcugaagcagcagaaccacagagguggcugagcaggggccuggcccugggacccagccauccacacucacacauccacuucucccuccagagcccggcccugaagcaggucucugcuccacgcuuuuccuuaguuggggaaucgagaguugggggaucaaagccccccacaucucccucacccgcugcagcuauguuuaucaaggugauguuuggggguaagugggguccccugucuugguaggcggauagggggaugagcacacucagaggcgugcuuccuuccgcccuugcgguggguggggaggcaauggcgggaaagggggguggugcacauggcgggggucgucggggaagcggcucugugaggaggcgaagccagcaccuggagcgagucccuuaaagggaaaacccgagcugaguccugcucauucacaaggguuccucucggccagagaccgccgcauuacccuggagcagguuuuuaagccgcacaaucucuucgccauucaauccgugauccucaagcuucagcgugcaucagacaccugaaacucuagccacaguugcaggguccccgugccucuggcuggaggcgggucggcccugugcgguagcggaagggaagagaggagccggugggugcggagggcggggacuggcugggucccgugggggcgggucccgggaggaggcugggcuggcgcccacuucgugcuuugcaggacucaagagaccaacacuugggagucaccacacaugggagaaaagucaccacacaugggagauggauggaggguucuccaaggcaguuuaagcaacagauguuggagcuguuaugcccggggcacagucuuagcccauaggcccagucgcagcucugggaaagggagagaugggagggagagacagaggaccccgauuuggaggaagguaagagaucucacaggcucaccuuugccccucuccacagcuggcugcucggugcuggugaacaccucuugcaggcuggugaaccucaccgcccaccugaggcagaaagcaggguugcccccagauggugaggagacagggaggagaaggaggggcugaggggucccaggcaggggugccagcccugcccagucucucuccauguccucccagcgaccauugcucuccuggcugaggauggcaaccuagugagccuggaggaggaccugaaggaaggggcuucccgggcccagaccaugggcaacucccuacugaaggagcgagccauauauguccucguucggaucaucaguaagguggcccaagguucucuccccugcagcuaugguagaauguaagaggggggcauagcagaccauagaccacccaaggcccuguccggccucccaccucggcuggggaccuagccccaauccaucccuacccaaugcucugcucccagccuggacuagcaaacaguuccagagugagaggcagaguagggaccauuaggccagucagguguccuucaucgucucuccacaugucacagagggagaggacauggccuccacccgcuaugagucccuauuggagaaccuggaugaccauuacccagagcuggcaggugagugucaggguacagcccagggggagggcacaccuucucccuaaccccuaccaacaggacuuccugggccuuccagaggaacugcgcaggcugucaggccucuccucugugggccacaacuggaggaagcguaugggcacucggcgaggccgccaugagcaaagccccacuucaaggcccagaaaggugagcucccugccacccaggaguugcuagcuggggcagggagccagguacagagcagauuuggacauccacagagacacccagagugggaucccuuccugcaggacagacacauaugaugaggggcagacccucaacaccaacuccacgcacauauacccccagauggaacacacuguacccugagacagguccccaccaccccacgggagugccagcgcacuaagggccggaauguccucaggcuucacagauguggcauaggggcuggcacacaguaggagcucagugcacaacugcuggaugaacucaaugaaggcggcagcauggugugugauggcacggcccacacuggguuugaagggcuuguucuuccauucuggcaggcuuggggaccuggcacacuacugccaacuagccaaguuggacucagacccaaggggguuagccaugaccucugccuugugugaucaggugcaaacagacaacaacccagcaggacuccucuugcagaaucuggaauugcugagaaguugcaucagcaagaggggcaaggucagacaggauuugaggccgccaggggcaccuaagcugugggugcagagaaugggaugcagagguagagacaagaaggguagagguggcagguaucccugauaagggggagaccauggguucauccugggauuccacccucagagucagaugcccuugggaucaccgacuaaugccucuccaccucacucuggacugcccaaggaaucuguccugugcuacccacagugcagauugcaacagggcuccuccuccccacccagggcccugauuaaggggauggauugcacacuguagugagacauccauccugaccccaccucaucagccagggagcucccugaagacaggccaucgagagaggcacacaacaggcuguggucuaaaauaaacuuuuaauugcacauuugugucuuggguuaucuguggggugagaaaccuccucacuuccaaucccagcuaucuggguacaaucugguguuguggucuggcugucggcgagggguagaggugggugcaggacuggcccccgagucugcaccgaccucuucagggcagggagcucagaccu

SEQ ID NO: 16297 - RNA, 22569 nt, Homo sapiens
gaugccaacucagggcugagccccggaggacccugcacaaagcaggcagcagcguuguguccuggcuuuccaagcuuuuccuuaaaaaaaaucuagcgaaucagguuggucgggaaaauucgcaucacauuuuacucuguuuagugaugaguggggaggggugggaggacaggguuuggugccggcgugcagggugggcuagcccagcgccaccuuccuggagacugucugguggaagacaccgcggagcagggccugguagcuggggacacggaacagguggcucucgccguaggccacgucguacucggccgucuugccggugaccaggacgcggauguggggcucauucaccuggcggcccacgaccaccacgaagaucucgaugccugcccgcugggcuuccugcacggccuucucgauggcagcgggcguggcgcccugcgaguugccaucugagaagagcagcagccucuucuuggcagcgccggacgaggccucgcgguagaagcgggucacauagcccagggcaucguugacgucgguggcgucguugauaaaguccauggcaucgacggcacuggccagggccguguaguucugcaggaacugcagcgacgcccgcucugggcgcugcuggcccgugccgcuguacugcaccaccgccacccgcacgucgugggcgggguccguccugcccgcugugaggaagcgcucggccaggcgcuuggcgaagcgcuugguggugucaaaguuguggcugcccacgcuggcggagccguccagcaggauggugaugucagccggggaggagaacgugacugcggggcggggugggcagccguuagcaugaggcccuggugaugcagccgcagugggccggccagagagcgucuaagcuccccagagagggcacggcacgguggugcucagccaccggagugagccaugcaccuacucucgugaccgccaggcccuccucccagagccccguccucucagagcccucgccccaaccacggugcccuccuccccacgugucccggccgccgagguacucacuggggcagguguaaucuggacacuucuugucuguaaaagagaaaagccgugcagugugagcccacugcuccaccuauaaccccgcaaggagaugucacaggaccucccggccgagcacagggguggccgugcccccggaagucacagcgagccgggaggaggaugccugugggacagccccaggcggccccgugcgcaccuacaggguggccgugccccuggagguaacagugagcugggaggaggccucugggacagcccugggcgccugcgcgcaccuacacagaucugggacggcccugggcggccccgcgugcaccuacgcagaucugggacugcccgggcggccccgcgugcaccuacgcagaucugggacugcccgggcggccccgcgcgcaccuacgcagaucugggacugcccggguggccccaugcgcaccuaugcagaucugggcggugacauucuucaggaaggcauccuccagcagcucugcauaguucuccuugaccagcgagaggccgggccggcccugggauggugccaggccuuggcaagaaaugacauugagcuggucugagccugggaugaagucaaacacgucuuugaugcccacggagaccaccuguggggacagacaguaucgguguggcgcagccugcucugcccucgucuuucuggggacaaggccacccuggcuggcggggcgcccuaggcggggcaggugcagccuggggguggccaccccaccuggaugccggggcugcagagcacguugagcgguguggugucccucugagugucugagcgcccgucagugaugaccagggcgaugcgguuguucgggcugggcggcagcagcuggucccgcguguacugcagggccucccccgugaaggugccgcccgccauccacugcaggcucuugauggcucugcauagcaaagggcaggaagggccgguuggggccaggccugccgcggggccgagcccaccugggaucaggggucagggccgaccugccgugggaacagcggucggggcgaggggugggaggguccuggccgcguggggcacucacuccuugagcuccugcacguuccggaugcuggggcugcgcaggcucacgugcuccugcaucuggcuguggcuguacugcaccacacccgcguacgacugcccuggcucgaacugugggaccggcaccggggucaggacgcgagugcugccccagguccgcauaagcuucccaagggugacucuauuggcugcgggugcccagaggguggcauggcccccaggaccucaggaccuggguccccugcgauuggcucugggugcacagaggguggcacagcccccgggaccuggguacccugcgauuggcuccgggugcccagaggguggcacagcccccgggaccuggguacccugcaaagcaaucuuccuugguggaugaagcccuccuggguucuguccacgagggacaagcccacacccagcacucaggaccccagacuaccgcccuucaaggagagggggagacccucccucaucuggggcgccuguguacaaugggccagccucgccagguggagcuggaggccuggacgggcuggcgcgugccuggcauccuugucaugaguagggaagucacagggaugcagcgguggccucgggaggcugaggucuggcgcgggcaggggcggccggcagggucggggugcaccugggcuugagaaagccgggcggggcgaggccucaccuugaccagcucgucccggcucagccggucgaugaccuugacgacgaaguccuuggcaaucucgaaguucugcaggccaaugcucucugagcuguccagcacgaacaggaggucgauggggccgcacuugcauucugcaggcgggggcggugucagcagagcacgccccuccccuccagugcccuggccccuccccuccaccgcccuggccccuccuuggcugccacauccucaccugacacguugggguccccccgucucagccccagaaaagcccacccccucccauggccccguaaaggcugcucuguccggcggcuggucagggcuggcguugcucagccaggcuaggguggggccugugggccagaaugauggagcagggacccccccaagccugcuccugguuauuucaguuaugggugaaagagggcggggcccagcccaacacccgggaacccugcuggcuuggagcaggccccagagggggcgggcaggugcagggagcugcgggcggggaccagagugccaugugcuguccugugacaugugugggacccaggccucgcuccccgacccccgggauccauucucucaggagcuagagccugggucucaccacagcaagcugaggagaagagaaagagucaguuagaccagucagggccgcguccugcgcacgucagaaaggcuuuuacucuuggggcagccuccccgccuccccggccgcccuccuuccccggccuccccccuuccccggccuccugccccgccuccccgccuccccggccgcccuccccacguggcagcucugcaccgcaccggggacucucagccugugcggggacccgggggccugggagggcuuuggaggccgguaggggcuggcugaggagccuccucaaggauguacccagagacccaggcccccaacaguggagacacccuucuaggaguggaacaggccaggcuggcggcccugcucucccuaacgaggacggcuucucagagauacucacagcacauuuucaugaugauguccaaaaucucgcauuccuggggagggagagacgaggguacuggggccauagacagccccucccagcggggacugugggcugcuggaucuccaggucacccucccuggggcccccacagggcgggguuugggcaggagguucuuugcaggugugcccggcucugcccacuacaccccugcuacugggcuggaccccugacguggucauagaaacagcgcagucaugggucuccccguggccgucacggguccccucaugguccucauggguacagguccccccaugauccucacacguccccccccaugauccucacacgggucccccaugauccucacgggucccccaugauccucacaugucccccuccaugauccucacguccucccaugauccucacacgucccccccaugauccucacaugucccccaugauccucacauguccccucuaugguccucacacaucccccuaugauccucacggguccucccauggccgucacgggucccuagggccuggcaccagcucuuuguccacaacccacccccccgugagcagcgucuacaggagcacccauggacaggacccacaccccaagggauggaagcuacaguggucgcccccagcaauguucacagagccccacuuacguccggcccaggcgguccuugguguccugggggucccuguccgagaaacggaguagaggagcucugagggugaggagcccacugugcuuccugagcugagacagcccccacccccagggcccugccccucaucaagcccaccccugcccggucccucccuacccagccccucguccuccagugacggugcugugagggcagcuggggcuucgcacacuggugguccaggcggccaucccaggugggccccacccugaggacccgcugugucccugggcucggcucugcugcccuggccaccaccuggcccuggugaccggcaccucccacccccagggccucccagaugacgugcuccccaaaauucccucccgccgccucccacucucccagccucuuccagcauuccccagccccagcauccggcgucccaggcacagcccaccguggccucacccagccacauccacccaccugggggcccucgggaccccgguaccccuuugcuccuuugacuccucggggugcaaugucguuguucuagaagggaacagcguugugucaacagaccgugcaccacccgggcaucugcgcgcuggccccguccacagagcauccagcagccggggcccaugaggccuccccaagcggguccugguccacugcccuucaagggcccagcccucuggcucagguggacuuggggcuggcccugccucccauccacacuuacaucgucuccgggguccccggcuucucccucgucccccuugaggccgggguagcccuucgugcccugcagugacgggagagcacuugguuaacaaggguuuuauuuuguuuuuaggaaguggaaauuuuaaaaggaaaaaaauaaagauaagagaggcacucuucucuucccuucccccaccacacacauuuccugggcuggagaaacugggucccggaguggccuagagagccguggggcggccucuggggcugggccugcccugcgcaccgaggggagaucggucaccgggcagucagggccgugaggagacccacaggccacaccacagugggagccucgcagggccugcaggagccgaugccaacuggggcuguggccacagacaguggggcagccgugggugccuguguaccccguguguuugcucgggagccugugugcacauguguguucacacgugcgugucccugugacugugaauguuugugugcccacagccagauggaggagggggcguacucacguuuaucccgggagcgccccuguugcccggauaccccugucauggaaaagcagggcagugauaccggguucugauuugagaggggaggcugugaggggcgcacagcggaagggccugagcugacagaaucccggccauggaauuccugggccagccggcgguccuggggccagcccgcccacccaagagugcccaguccacuaaagagggcgccgcaggcagcuugggcauguuccugugggcucagccuccggacacuuacggggaagccggggaagcccucggugccauuuccagcggggccgucuucucccugggggagcagaguagccgucaccgugcgaaucggccuggccugggauacccacuggcuggcacaggcccgggagcaccucacccgcagggccccuccgucagcccagaagccggcucccuccccuggggccacccugcugguccccguggacccugggacccggaucucggggcaggaggggcccugccgaggcggccucuggcucaggugccgacuguggccaggagccagugaugcugcgggcacucccggcccggucagggaccccaggcagcuccacagugcggggcuggggcuucccagggccucuggcggccaggccuccgcccuagggcccgagcuguuggacacucacccuuucacccaucagccccgggucuccaggggguccggcagguccuggggcuccucuggcacccugaggaggaagaggaggcgugaggggagcaggcuuagcauggugaccuuggagggaagcagggcccuccuggggccgggagaggucccaucgggagccaggacacccagggccauagaguccucagagggcacggggccagcacugggcagacaguggguucuggauccucaggccccccugggugggcggguguggguggggagugggacucaccucggacccugggggacccucaucgccucgguagccuuuagguccgauagggccagccucgcccuguagagagauggauauggcacguuggaccacaggccucacccagccugagcccucccugacccuaagcugagggucucagaccaagaggcaucagggcccccaggcucuggccccagucccaucagugcagggggagagccaggcccacucuugggucugacgaagggccugcacgaagggccugggcacaaguguugaagcccuucggugggcgcccagcuggugccucaggcccccacggaggggugaagccucucccagaugacuuuggugggcgcccggcuggugccucaggcccccacggaagggugaagccugucccagaugacuucggugagugcccggcuggugccucagguccccacggaggggugaggcuacagguccccaggccgcagaccaccugccccuucuccuaucagaguggccccagacugcccucccucaugguccccuuugggccuggccugguccccuuagcccacccccaaccgcaggacccucugugggcugagccuggacaccacccugcccccaccugcaccugaggcugccugcuggacuuccuugggucccccacaucucaugaggacccugugggggucuauuuccagagcuggccccagcucccaccuuugagggccugcuccguggacaacuccagcggcgagucccugcccuucggagucuagcccaggcaccccaagcacuucccagcgcgcccagcugagccaagaagggagccguguacacaucgcccggcccaccuggcccaccuggcccaccuggccccagccaugagccuggucggacgccugucccuggccugugccugcucagacgccugucccuggccugugguuaggcugaugcuucccgaugaggccuguccggugguucaaauguuuacaacuuccccacuaccagacuuggcccauucaccauccugaccccguggccuccaccaggcagacaggaggcaucuaguguauugcucucucuaccccgacugugcaagcacccaggccuggcugugaagcuccugcacccuucguggucaacgccccagcagucaggacugcacacuugacuggggacuuugcacacgggccucaaggagguccagaagcucaccaaacuugggguucaacagggguuagucugguacccugagauccugccuugggaacacgaaaagggggccaggaggaaggauggaaaggaggucucugugcccugggccagguaagugggaggcagaaggccuggaccucaccacacacagucagacugugccacagacagcaggaggccagacugggcaguuucugcagagcaccucacugggggcaccuccugggaccagcccugagggcccaacugcuucuggcauccacacagggagagccccaugcugggcaggguggaggggagggguaaggcuggcaagggcugagcagggagguucugggagcagggaaagcccggaaggccagcugggagcccaacgucccgauggacaaauguggcuccaaagccaccuauccacacccccgggccccgaaaggccccagggaggcuccaggugaacaagugccugccucagccaggcaacugugagucaugggucacauggugcccuggucucaggcguugggggaaaccuccuccaggacagcagccuagagacuauucccagacccccaggcaugggacccaccagccccugugcagccugccccacagcccuggaggcccugcagccggccugcucacaggacugccucuuaccacaacccuuugaaaguggcuuuguuuuuuucuuauaguggcuauugauuacuuugaaaacugaacauauaaaacaggcagggugugguuagaauucuccgagcaaguccuggccucugaacgcucauucccacugagacuuucagcuaccaaggucuggagcagccucccaagccuggaacguggcccugggccguccccuccccacaaucugccacuggcugcauggccucuuccacgcacugugcccugcaccuggcccuguccugggugaccacaugggaggucagaucauccucagggcuggagccccgggagcucaaagagcaaagaggaucagagacugaggccgugcacuuccccaggaaggugucgggagcccuuucugccccugccgugagcggcacgcaggaccagguggacgaacggcccagaccccgccugccaagcccugcccugguccucaucuaugacacagguauuuuuaacagcuguguaacacccguuggcaccacaaaagcacgauuucaccucgugcacagaaauacaaaugugacuugcacugggacggccucucccaucucccugggucugaggccccaucuugcuggacgucugagacagcugccgugcccagggucuggccuugugcucggugugugggcagcugcgcacauggagccguaaggucgauuuguccacagaagcagacaagcucgggagcacagacuugcugucuccgggcgugaccguguggaggccuuccuguccccguggggcaggugagcuccgggaggaugcaacggcccagcccagccugcgggcaacaccacacuggagccaccaucauggcagucaucagaaugggggaagagacagaaagccgugcggcgugcacagcgauuccagaggcucggagaagggaauuuagaaugagaugaaagugcauuuucauccugacacccugggauucuggaaaccuccauagccucacacuccccaguugaccuccagccacagucaugccuggcuccugacccagaaaaacagaugcugaccaagcucccagugucucccaggggcuccaacaccucuuccucacugugaggcacccuugccccggaugggcccccagacagcgcuucuccaccugggcugagcgucucagcgucaggcccccgggcgcugggccugcucucaacaauccacaccagcccggcccaggccgcgccucacccccugcagccggcucccacgcagggacacccccgagaucuacggaaacacagaggcccucaaacggaaaugaacagacccccagugcgugagcugcuggagcacuucuacccccaaaacccaaauuggccaacgccccccaaccccacagcgcuuccuaccgggucuccagggacaccaacggggccuucucuucccugaucacccugcgggccagcuucacccugaagagaaacgagccgugaguguggagcugggccauccuuggggaggauggcugcccgggcacgcugggagccacagcaugcuguccagguggucacugggcuguuccggccuucccuccccgcacagccccuuccuggccucgccaagcguuuccucggcccacgugcguggccaucggcguggcuggcuauggcuaucuucauucaggaggccggcagcuccuccuggggccccagaggcgucccugcgugcaucccugcuucuccagcaagcuccguggacccggcaaguguuuguagccauggacuuguggcccgccgggaagcuggagcugcguggcuggcccuuccucugggcucugccuggcugucagucucauauccugaucucagaggagugggccuagaaggcagucugagucacuaagucacacgaucccugcuuugacguccccccgaccccuccacgggggcugugcgcuucuggggagcucccagggaggaggucagaaaucccccaccccccacuggggagccaaaucccucgguggcggcgacucuggccccggcucagcucucuggcccugcuggagccccgccugucugucacagcacacgacagucgcaugucuugauucucggacaagggggcacccgggggcgcugccucugaggccuggcagcucggcugggcacacuagggcauucucuccccuucacucugcccgccaggcccuggcucucccugagccggaugggacugagacgcccggagucugccagcugccccgccccacauccagcacagauuucccagcaagucacagggacagagaagggcccugugcuucugcacccugaggcugggcugugggguggccuagcgaggcccacgguccacggagcugaaggugggggguggccucugaggccgccggcaucucggcucuggggugaguuuuccaugucaagccuucccaggcaggcgcccugcaggccuagcuucccgucugggguacugacccaacuuccucacgcugggaauuuuaacuaaggaaaauuauuccaaagaagaacccaagcucggaugcagaaacguggaagccgccuggugggaaagugggcaccggguccacgggcaacgccuucacaugaaacaggucccagcaucaggcacauggcugggcgccggcuucaggggcugcccucccugacggcguggggaugggcuggccacguugaggggccacaggggcuucaugauguguccuguggcucuggaggccugacccagccccagccuccgccugccccuuccuggggugguucccagcuccaggaacugugacucacagggucuccucuugguccccgcgugccuggggucccccgugguccucucucuccagggccacccugaguggagagacauggaggggagaagccucagcugcuggaacucacacccagcugggguggggcuugaggccuggccuggacugacucccccagcaggaccccugggaggggccaccccuccaccgcaugccccacgguugcagaggccggaaucuccugguuccccaggucccacccgcucugagacugugggaagaggcauccuggacgugugggugaagaaacccauuugucuugggcaggaggccauggcucucagugcugggagggccagacugggccgcagaggccacguccacagcuacauggugaggccaacagcgcaggcugccccugccccacucacccgcuccccgggggcaccgucagguccuggguuccccugggaugaagagaaacagacgccggcguuagucugguggacacacugcauuuggucucagggacguggaguagaccccgagcaaagaggaucagaagcugaggccaugcacuuccccaggaaggugucaggagcccucacucaccucgucgcccgccucuccuuucucuccggggggcccaggcucucccggcuggcccuguggggaacaaggguugaauggucgcuccaucuccuugacccucccugggcccauaccuggcaugugugggggcugugaagcuccucaccucgucuccagauggucccgagcucccuggucuccccgccuccccgucagcuccaggcucgcccuggggaagaccgggggagucacacacgcuggcaggggugugcaccaggggugcagccaucagaggccacauccagggccucucacccauacuucaggccacucccucugaccaacacugucugagcccagaccccccagcacccucagccauccacaacccugcacaaagaccuccuggaaugcuccaaccuuguucccugugaggcccagccaagggccaucuugucuaaggggcaggauuugguucccauuagagaaggcacagcuuugccaggcuggcaaauuggcaaacucaaaucuagggccuggaggguaaucugggaacuugaagaugagauuuggaaaccgucugcuggguucuaggagcucgucugggaauguuugggguggggucagcauucgccuuugucuuccccaacacuucagcuucaacaaagaaacuccagagaaaacaccagcaacggcagacucagcugucagacgaaaaagcuccuucucccgccucgugcucccgcccucccgcugcccacucgcccucccacccgcucaccacccuccucccgcccccgcucaccacccucccgcccacucgccacccucagugccacccagcccauucucaguucugagagccauucugggcugcggcucgcaggcuaggagugacgcgguggggucccaucugugccgagcgagcggcaggugcgggggacagaauggcggaggccugaaggcccucgggcugcagggaaggcucugggcgggagcgccacggccacuguccccacggugggcacuguccccgcugcuccucugccugccuccagccuccaccagcuccuccccucugaggccgcacggguggccgacaugcucggaccaggacuugcuuccaggagagguuuccaauucagcgcuuggccaaccgugaaggcccugguccuccaggggccgcaagucacucaccuuuucuccuuucaguccaaaggcaccggggucucccuuggggccaggggguccuugaaugcccuggagaaaagagggcagcaugacaccaccggcagaggccaccgcggccucuggcagcagccccagaccgcccagacagaagucaaaacgguccacacgaggugcugcugacagcgcuaguuuuaaaguaucagugagaggaagugacuuacgucaaacccgggcgagcccuugcagccuggcaggccuggguaccccaucucccccuggaaagaggaagaaaacuagaaaaucugacggccaaguggguaaacugaggccaaucaacugucagacuuggugcccuccaugcccuccacacccucccuggaaagcccugccuagcagacaccccccuggggucaccuucacaccguccaccccacuccucccugucccuccugccgggaucaccucaccccaucccuccccgucccuccccguccuuccccuggucaccuucacacuguccaccccaucccuccccgggucaccuucacgccguccacuccgucccuccccaucucgccccauuccuccucgucccuccccguccauccuaucuccccccagucaccuucacgccguccaccccgucgaugccacgcuugcccuucucucccugugaggcgggaaaacgaaggcaggagucagaugcaggucagacaugcugccgugggggcagaacuccccccucccagcagcccacgcucaccuuguagcccuuggguccccuggagcccugcggagacaggaagcgggugugaggggguauuugggguggggagggcagggcaagccuggcuuaggcccacgcgaggcaggggcuugggugcccccaacccgaggggacaacaucacugcugagaaucauggggacugacagugauggggaggggccgcucugcagaggguaaccgcccgggggacccccggcuccgcagaggguaaccgcccgggggacccccggcuccgcagaggguaaccgcccgggggaccccugcucugggguggggugaaagugacacaggcgccuuugcugggugccuggguggcuguccuuguccuuccagauggaggggacggcgaggggcgguggagcgggucugcaggacacguggucuccugucagggacacuguccucauccccggggacacccucguccaggauggcacaucugcgccuggagagaccagcuccgaggucgagccucacucaccuucuccccacggcucccuuuuucucccuacacacccagcggaagaagaggaagaggaaggcuuguuagugcugugcaaggcugagggcaccaccgggcucgggccaggaaagggggggcacguaccuucauucccugguacccaacagguccgagguccccgggucuucccuggaacacaggaggagauggugagacacccccggaggagcaggggcaggggccagucccacccagccccacaccccucccuccagcccaggccuggucaggccgagagaggggcccugcugcacggggcccauggugccgaggcccuccaagguggagcugggggagggaagucuauggauaggauuugggccaaggagccacggcaggggccccggacggugccggccugagcacccugggccaccuccccacccagccccucccuggcaggggggcuuacgggcugccuggggggcuguguggaaggauggcugggcuguggccccuccaggucugcucccacccacaaggaacaggcagugugacuuuggcacucagaacccagccacucuuccggaaguuuccgaggccuagucguuccccgccuccagcuucuuagggcccccaccccacagucaggcacucacaggaucuccggcuucucccuucucuccugggagccccggcuugccucguucucccuggaacacaaaacaggucaagguuggggcagccccguuucuuucuaaaaagcuggcucacgaaacagguuuuuaaaaagacgcuucauccagccuucagggaucaagggcuuuaaagcaccuuccccaucacaucuggucagccugggucugggagcuccaacccgcacgccagcuccccccacucccugccuucguuccugucugcucggcuuugcugacccccaggcacaggugggagggacgugcagcacagaagccccccagggucacagcucgacccccaggaaauggccaugggacucgggcccacagcugcuggguuugaugguuuuuaggagaagccagaaaucugagguccaugagcagccucauggcaaguuuuaauuaucagcagcuaauucuaacguuuaaggucauccuaugugagccacacagaagcaggggacccacauucucacccuccuaccuccagaaagguccuucugaacagagugcggcugagggcagggcggacagagacacccucagaagcccccagcgcccccgggacaguccacacccugcacggccggagccugccugcuggaccccgccgucccuuccaucuggaccccgacauccccuccaucuggaccccgccguccccuccaucuggagccccgacguccccuccaucuggaccccgccguccccuccaucuggaccacgccguccccuccaucuggacucccgccguccccuccaucuggaccccgccguccccuccaucuggaccccgccguccccuccaucuggaccccgccguccccuccaucuggaccccgccguccccuccaucuggaccccgccguccccuccaucuggacccccgccguccccuccaucuggagccccgacguccccuccaucuggaccccgccguccccuccaucuggaccacgccguccccuccaucuggacucccgccguccccuccaucuggagccccgacguccccuccaucuggaccccgccguccccuccaucuggaccccgccguccccuccaucuggaccccgccguccccuccaucuggacucccgccguccccuccaucuggagccccgacguccccuccaucuggaccccgccguccccuccaucuggaccccgccguccccuccaucuggaccccgccauccccuccaucuggaccccgccguccccuccaucuggaccccgccguccccuccaucuggaccccgccauccccuccaucuggacucccgccguccccuccaucuggacccccgccguccccuccaucuggacccccgccguccccucuggauccucaugguggacuugggugcccaggaggcuuugguccugccacccccacucccaggccccacaacacaugggaggagcaggagucaccacucaccucaaagccggggucgccccggagccccggagguccucuugcaggcugcaaggcagaggggacggucagccaggaccccagacucagguucccagggugcagggcgcggggucaggggucggggggcacacucaccuggcauucgaaggagcagcacuguggggggaaagcauggagacgagucagugggaaagccacggacauacggcugggacacagggugacaugcgacccaggcacaugggcagacggacacacggauggacgcacaggcggacacaugucccaggcacaugggcagacacacagguggacacgcagggggacacacaucccgggcacacgggcagacacgcaggggacaugugucccgggcacaugggcggauaugcauagggacaugcguccugaacacacagguggacguguggguggacgugugcagacucacggcugggggugguggggagggcucuuaccacuugcuccacguuauuuuucuggaaagagaaauggaaacgcagaauuacuuuccaccugcggccgccgcgggccuccccgucuccugggcaggggccucacgaucauguccacgauggugucgauggucuggcugauggccuccucugcgucgcggcucuggccccagucagccgccgugaaguugcgccgguacgugugguccguggcgaugaugcucagacgcggcuccugggggcaguguucagggugggcugagcagggcugggaccccugacggccggggccgcuucccacagggccagaggggaggcugggcuggggcgcuccaggcuccucagcaggaggggcuggccucucaggggcaaggguggccggcuggagaacccacacccucccgaggaccaaaagacggucccagcugccgggggccuugcagccgccacucccugugguugggggcaucugccggggggggccggugccuaccagguggucgggugugauggccaccgagaagacuuugacgcccaggugcuuggccucguucacagcauccuccagccccccacaggguuccuuguagcccuccagggggugcccgucggucaccacaaucagguacuuauucuccuucaggugggagccccuggacaggagagggcagcgugagaccucgagacuaggugggggaacuggagggagacccaagccuguccgggaggugcuggucccugucucaccgggaggagccgccucucuuugcugauccuggcuauacgguggggguuacugaaaagaaccucaccaugggaaauaacgccugugggucucauuucucuaaacugcuuuggaaaauccacgcccucccaggagaggcacccaugaccccaaaggaggcucgguuccuggggugcccuggggcgcaaagccccugaccagugaguggaggcugaggguggcagggagcgugccccuccgagaugcccgccgcgucuacccacaagcugccucaacucaaggcugcucggucaccguggcucuugcaggaaaugggugugaugagcaaacaacagggcgaucccugaaugccccaaauccaaccccccgaaagggaaagugggagcagcaggaaggagggcaguaucgcagggcagucgggcagccugcuggggacgcugagcaucucggccagaagggcgagcucauuuaggggagucgugucugucuguggcuuccacagggggccgcacucugacguguguggccacaucccccaugcacccccugcagacagcggacgacuuccugagacuccaagucccccaggucccagcuuggcaccaacucuggagggaagugggcacaaccauuggaaagggaauguccggcccacaccggccauguggcccucugagaccgaccucggggagaggcucuccccaaaccccccgcaccgccuggcuggacagggcagccucggguacccccacugggauccugaggccucgugaagggcuggguguggggaggccacguuccccucuggacacuccggggcuugcggccccugcguccccacagcuggacacugggaugagaggaaaccccucaguccagaaaaaccccgagaaagcgcaugcuucgggucugaugagucuguuucagugauccuagcccugcuugguguugaugcuguggggaaaaccaccccgucucucucagucucucagucucucugccucuguuuccggucucucugucucugucugucccugucucucugucugucucugucugugcuucucucucugucucucugccucugucuuugucucucucucucugcuucuaucucucugucucccucucugucucuaucucucugucucugucccucugucucuaucucucuauuucugucucugucucugucccugucucugcuucucucugucucucugccucugucugucucugcuucucucugucucucugucucuguauguuucugucucuguuucgcugucucugucucugucucucugucugccugucucugccccucugucucugucucucugucucuguuucugucucugucucugucugucucugacugucuuuguuucucugucucugcuucucucugccucugucuuuuucuaucugucucugucucucucuguuucccucugucucucucucuuucugucucugucccuguuucugucucucugucucuguuugucugucucugucucugucucucugucucucucugccugucucugucccucugucucuguuucugucucugucucucucugucucugucugccugucucuguucccgucucugucucucugugucucucucugugucucugucucugucucuguuugucucugucugccugucuuggucccucugucacucuuugucucugucucucucugucucugucucuaucucucucugucucugucucucucugugucuguuucucccuguuucuguuucucucugucucugucugucuccgucucuuuccugcccacaaagugggucagggaggccgugcagccuccaagagaacagggaggcugcagcugaagccgcacagggaccccaggccaaccccagcccaggcuggguaccacgcgugagaacuggcgugggcaggaggcugggggccacucaccccacgaggagcugcuccagccccuucuugauagcgcagucgguguaggugcccuucccaaaguacuugaccgcguccacgcugcuuuugagugcgucgcggccgccaggcaugcgcgugaggccuuggaugaucuccaccucgucacuguagugcagcgcgccugcguuccacaccagguuucggucacagcgguaguaccugccaggaacaggcacggcgggcgugaggcgggcggccccuggcgccaucgcuacccgucccagggcgcgacgucacccagauggacaggcugccccacccuggccguggcugacacacagcuggacuugcccuguggcccugaggccggcccuccuggaaggcugugcaggcggguguggccagcaagcgaccugcgccccgaucccucaggcccucagaccaggagcccugaguguguggcccugcuggggugggguccuugggccugcaguggggcagcaugacagugggggaaggaggcaccccggggaucugagcagcccccucgcugcccucugagcaccugagccugaggcucucaggggucugcucugccccagccuggggugggcccaccucugccccacccacccucccauccauucagcagagugaccacggcgccugcaggaauccaguggcagcgacauggggaugacuccgccccauuucacaggugggaaacugagucauggggagacugaguaaaggcaacaagggcgacucgggggacgcugggccacgcggccgccccuccccggugccauccacagccagacccccccccaaacacugccgcacgggccuggccauguccacuaagcucaggguuccugguaccaauggcuccugcugggcacggugugggcuggaagguccacccugcuguuaccggcagccucugacugugccccuucugguggcgggaggcuccggcccagcggccagucagcagggucaaggaggacggggguuccuacgccggcuaagcuguguccccacugccaggacccgucucagugggggagccccguucuacaugccccccccucagcggcccugugcacccacaggaccgacuccccucuccccccggucuguccucagccacacgcacagauggaggaacguggagcagagggugccgugucccaagcccagaaccaagccugggggcccuggggcugcagagcgacaccccuccuggcucccgagucggggaccuucagaacgugggauccaggacccagguagaggcucucacugcccacggaacaaaccaggguccaggugguuagugaggggcucccgcgcaccaggcaggacugcgugucugggccagugcgcugagcccucucggucagccugcgggagccucucuucccuacaucucagccucacugucaccucggcccugcugaacaggugccacccccgcgagcagggucucaaaccagcucacucuggaaggcgcugggagaggcucagaccagcucacucuggagggcgccggaaagggccccggccucacucuggagggcgccgggaggggccccggucagggcaacgcucgcccaaccuuaggagguugaggccgucgcacccguguuccccugggcccccaccccucccuccaagaggcccagaagcacaggaggaaggucacggggcgucccuccuaccugucccucagguugucgaugaagcgcuuggugaaggacuugacuuuguccacgagggccccguagggcuucagccucagggccacgcucucagagguguccagcacaaagaacagguccacggggcagucuggccgaagauggaggagaggggccuucaagcucucgccccauuccccgagucucugcugggccugcccucccggccagcccagcgccugcagcacagagccccgggcccggagaggcucucccgggaaaaggcagcaggacgucccucgguggggacgguggggaggggguggagugagagaccccaaaccgcuccugugccucgaggggagucagaaaccuucacaaccucccccgaagggcagggcguccccggcacgggaccggacaagugagaccucacgggaagguuucucgcuggauucagaaccagcagcgcacgacuucuucuagaacgggggucgggggggccgugcgucuggacucacugccaggugaggggucaaacggauucacggggcgccgagacagccccgcaccagcucccccucgccagggagccccucccgagcugccugcgguccggccccgcugagaaugcugaaugcugagccucuaggggccccggccaaggcccgguggggcagagcugggcgcugcagccgccccgagcggggagugggguucaggggcuccaggcccccagucugcaguuccacgcgugggaggggaccccgcgcaucuggcccuggccggcagcaaagagcggggggucuggagccugcaccccaagccaccacucacccuggaaggccacggcccucggggucuccggcucauccugcgcggcuguccagcaggccugcagcagcaggggcagcagagcacgggccgcccucaugucuggggccugcggucaccacacagcgcggccagggcagagugggccgccgccgccgcccagagaccgaggcugccuucugcucccagccagagugagagcggagggcaaggaggggaggggcggggcgagaggggcgggaggggaggggaggggcgggaggggaggggaggggcggggcgggaggagaggggaggggaggggaggg

SEQ ID NO: 16298 - RNA, 22569 nt, Homo sapiens
cccuccccuccccuccccucuccucccgccccgccccuccccuccccucccgccccuccccuccccucccgccccucucgccccgccccuccccuccuugcccuccgcucucacucuggcugggagcagaaggcagccucggucucugggcggcggcggcggcccacucugcccuggccgcgcuguguggugaccgcaggccccagacaugagggcggcccgugcucugcugccccugcugcugcaggccugcuggacagccgcgcaggaugagccggagaccccgagggccguggccuuccagggugagugguggcuuggggugcaggcuccagaccccccgcucuuugcugccggccagggccagaugcgcgggguccccucccacgcguggaacugcagacugggggccuggagccccugaaccccacuccccgcucggggcggcugcagcgcccagcucugccccaccgggccuuggccggggccccuagaggcucagcauucagcauucucagcggggccggaccgcaggcagcucgggaggggcucccuggcgagggggagcuggugcggggcugucucggcgccccgugaauccguuugaccccucaccuggcagugaguccagacgcacggcccccccgacccccguucuagaagaagucgugcgcugcugguucugaauccagcgagaaaccuucccgugaggucucacuuguccggucccgugccggggacgcccugcccuucgggggagguugugaagguuucugacuccccucgaggcacaggagcgguuuggggucucucacuccacccccuccccaccguccccaccgagggacguccugcugccuuuucccgggagagccucuccgggcccggggcucugugcugcaggcgcugggcuggccgggagggcaggcccagcagagacucggggaauggggcgagagcuugaaggccccucuccuccaucuucggccagacugccccguggaccuguucuuugugcuggacaccucugagagcguggcccugaggcugaagcccuacggggcccucguggacaaagucaaguccuucaccaagcgcuucaucgacaaccugagggacagguaggagggacgccccgugaccuuccuccugugcuucugggccucuuggagggaggggugggggcccaggggaacacgggugcgacggccucaaccuccuaagguugggcgagcguugcccugaccggggccccucccggcgcccuccagagugaggccggggcccuuuccggcgcccuccagagugagcuggucugagccucucccagcgccuuccagagugagcugguuugagacccugcucgcggggguggcaccuguucagcagggccgaggugacagugaggcugagauguagggaagagaggcucccgcaggcugaccgagagggcucagcgcacuggcccagacacgcaguccugccuggugcgcgggagccccucacuaaccaccuggacccugguuuguuccgugggcagugagagccucuaccuggguccuggaucccacguucugaagguccccgacucgggagccaggaggggugucgcucugcagccccagggcccccaggcuugguucugggcuugggacacggcacccucugcuccacguuccuccaucugugcguguggcugaggacagaccggggggagaggggagucgguccugugggugcacagggccgcugaggggggggcauguagaacggggcucccccacugagacggguccuggcaguggggacacagcuuagccggcguaggaacccccguccuccuugacccugcugacuggccgcugggccggagccucccgccaccagaaggggcacagucagaggcugccgguaacagcaggguggaccuuccagcccacaccgugcccagcaggagccauugguaccaggaacccugagcuuaguggacauggccaggcccgugcggcaguguuugggggggggucuggcuguggauggcaccggggaggggcggccgcguggcccagcgucccccgagucgcccuuguugccuuuacucagucuccccaugacucaguuucccaccugugaaauggggcggagucauccccaugucgcugccacuggauuccugcaggcgccguggucacucugcugaauggaugggaggguggguggggcagaggugggcccaccccaggcuggggcagagcagaccccugagagccucaggcucaggugcucagagggcagcgagggggcugcucagauccccggggugccuccuucccccacugucaugcugccccacugcaggcccaaggaccccaccccagcagggccacacacucagggcuccuggucugagggccugagggaucggggcgcaggucgcuugcuggccacacccgccugcacagccuuccaggagggccggccucagggccacagggcaaguccagcugugugucagccacggccaggguggggcagccuguccaucugggugacgucgcgcccugggacggguagcgauggcgccaggggccgcccgccucacgcccgccgugccuguuccuggcagguacuaccgcugugaccgaaaccugguguggaacgcaggcgcgcugcacuacagugacgagguggagaucauccaaggccucacgcgcaugccuggcggccgcgacgcacucaaaagcagcguggacgcggucaaguacuuugggaagggcaccuacaccgacugcgcuaucaagaaggggcuggagcagcuccucguggggugaguggcccccagccuccugcccacgccaguucucacgcgugguacccagccugggcugggguuggccuggggucccugugcggcuucagcugcagccucccuguucucuuggaggcugcacggccucccugacccacuuugugggcaggaaagagacggagacagacagagacagagagaaacagaaacagggagaaacagacacagagagagacagagacagagagagauagagacagagacagagagagacagagacaaagagugacagagggaccaagacaggcagacagagacaaacagagacagagacagagacacagagagagacacagagagacagagacgggaacagagacaggcagacagagacagagagagacagagacagaaacagagacagagggacagagacaggcagagagagacagagagacagagacagagacagacaaacagagacagagagacagaaacagggacagagacagaaagagagagagacagagggaaacagagagagacagagacagauagaaaaagacagaggcagagagaagcagagacagagaaacaaagacagucagagacagacagagacagagacagaaacagagacagagagacagagacagaggggcagagacaggcagacagagagacagagacagagacagcgaaacagagacagaaacauacagagacagagagacagagagaagcagagacagacagaggcagagagacagagagaagcagagacagggacagagacagagacagaaauagagagauagagacagagggacagagacagagagauagagacagagagggagacagagagauagaagcagagagagagagacaaagacagaggcagagagacagagagagaagcacagacagagacagacagagagacagggacagacagagacagagagaccggaaacagaggcagagagacugagagacugagagagacggggugguuuuccccacagcaucaacaccaagcagggcuaggaucacugaaacagacucaucagacccgaagcaugcgcuuucucgggguuuuucuggacugagggguuuccucucaucccaguguccagcuguggggacgcaggggccgcaagccccggaguguccagaggggaacguggccuccccacacccagcccuucacgaggccucaggaucccaguggggguacccgaggcugcccuguccagccaggcggugcgggggguuuggggagagccucuccccgaggucggucucagagggccacauggccggugugggccggacauucccuuuccaaugguugugcccacuucccuccagaguuggugccaagcugggaccugggggacuuggagucucaggaagucguccgcugucugcagggggugcaugggggauguggccacacacgucagagugcggcccccuguggaagccacagacagacacgacuccccuaaaugagcucgcccuucuggccgagaugcucagcguccccagcaggcugcccgacugcccugcgauacugcccuccuuccugcugcucccacuuucccuuucgggggguuggauuuggggcauucagggaucgcccuguuguuugcucaucacacccauuuccugcaagagccacggugaccgagcagccuugaguugaggcagcuuguggguagacgcggcgggcaucucggaggggcacgcucccugccacccucagccuccacucacuggucaggggcuuugcgccccagggcaccccaggaaccgagccuccuuuggggucaugggugccucuccugggagggcguggauuuuccaaagcaguuuagagaaaugagacccacaggcguuauuucccauggugagguucuuuucaguaacccccaccguauagccaggaucagcaaagagaggcggcuccucccggugagacagggaccagcaccucccggacaggcuugggucucccuccaguucccccaccuagucucgaggucucacgcugcccucuccuguccaggggcucccaccugaaggagaauaaguaccugauuguggugaccgacgggcacccccuggagggcuacaaggaacccuguggggggcuggaggaugcugugaacgaggccaagcaccugggcgucaaagucuucucgguggccaucacacccgaccaccugguaggcaccggccccccccggcagaugcccccaaccacagggaguggcggcugcaaggcccccggcagcugggaccgucuuuugguccucgggaggguguggguucuccagccggccacccuugccccugagaggccagccccuccugcugaggagccuggagcgccccagcccagccuccccucuggcccugugggaagcggccccggccgucaggggucccagcccugcucagcccacccugaacacugcccccaggagccgcgucugagcaucaucgccacggaccacacguaccggcgcaacuucacggcggcugacuggggccagagccgcgacgcagaggaggccaucagccagaccaucgacaccaucguggacaugaucgugaggccccugcccaggagacggggaggcccgcggcggccgcagguggaaaguaauucugcguuuccauuucucuuuccagaaaaauaacguggagcaagugguaagagcccuccccaccacccccagccgugagucugcacacguccacccacacguccaccuguguguucaggacgcaugucccuaugcauauccgcccaugugcccgggacacauguccccugcgugucugcccgugugcccgggaugugugucccccugcguguccaccugugugucugcccaugugccugggacauguguccgccugugcguccauccguguguccgucugcccaugugccugggucgcaugucacccugugucccagccguauguccguggcuuucccacugacucgucuccaugcuuuccccccacagugcugcuccuucgaaugccaggugagugugccccccgaccccugaccccgcgcccugcacccugggaaccugagucugggguccuggcugaccguccccucugccuugcagccugcaagaggaccuccggggcuccggggcgaccccggcuuugaggugaguggugacuccugcuccucccauguguuguggggccugggaguggggguggcaggaccaaagccuccugggcacccaaguccaccaugaggauccagaggggacggcggggguccagauggaggggacggcggggguccagauggaggggacggcgggaguccagauggaggggauggcgggguccagauggaggggacggcgggguccagauggaggggacggcgggguccagauggaggggauggcgggguccagauggaggggacggcgggguccagauggaggggacggcgggguccagauggaggggacgucggggcuccagauggaggggacggcgggaguccagauggaggggacggcgggguccagauggaggggacggcgggguccagauggaggggacggcgggguccagauggaggggacgucggggcuccagauggaggggacggcgggaguccagauggaggggacggcgugguccagauggaggggacggcgggguccagauggaggggacgucggggcuccagauggaggggacggcggggguccagauggaggggacggcgggguccagauggaggggacggcgggguccagauggaggggacggcgggguccagauggaggggacggcgggguccagauggaggggacggcgggguccagauggaggggacggcgggaguccagauggaggggacggcgugguccagauggaggggacggcgggguccagauggaggggacgucggggcuccagauggaggggacggcgggguccagauggaggggaugucgggguccagauggaagggacggcgggguccagcaggcaggcuccggccgugcaggguguggacugucccgggggcgcugggggcuucugagggugucucuguccgcccugcccucagccgcacucuguucagaaggaccuuucuggagguaggagggugagaauguggguccccugcuucuguguggcucacauaggaugaccuuaaacguuagaauuagcugcugauaauuaaaacuugccaugaggcugcucauggaccucagauuucuggcuucuccuaaaaaccaucaaacccagcagcugugggcccgagucccauggccauuuccugggggucgagcugugacccuggggggcuucugugcugcacgucccucccaccugugccugggggucagcaaagccgagcagacaggaacgaaggcagggaguggggggagcuggcgugcggguuggagcucccagacccaggcugaccagaugugauggggaaggugcuuuaaagcccuugaucccugaaggcuggaugaagcgucuuuuuaaaaaccuguuucgugagccagcuuuuuagaaagaaacggggcugccccaaccuugaccuguuuuguguuccagggagaacgaggcaagccggggcucccaggagagaagggagaagccggagauccugugagugccugacuguggggugggggcccuaagaagcuggaggcggggaacgacuaggccucggaaacuuccggaagaguggcuggguucugagugccaaagucacacugccuguuccuugugggugggagcagaccuggaggggccacagcccagccauccuuccacacagccccccaggcagcccguaagccccccugccagggaggggcuggguggggagguggcccagggugcucaggccggcaccguccggggccccugccguggcuccuuggcccaaauccuauccauagacuucccucccccagcuccaccuuggagggccucggcaccaugggccccgugcagcagggccccucucucggccugaccaggccugggcuggagggagggguguggggcugggugggacuggccccugccccugcuccuccgggggugucucaccaucuccuccuguguuccagggaagacccggggaccucggaccuguuggguaccagggaaugaagguacgugcccccccuuuccuggcccgagcccgguggugcccucagccuugcacagcacuaacaagccuuccucuuccucuucuuccgcuggguguguagggagaaaaagggagccguggggagaaggugagugaggcucgaccucggagcuggucucuccaggcgcagaugugccauccuggacgaggguguccccggggaugaggacagugucccugacaggagaccacguguccugcagacccgcuccaccgccccucgccguccccuccaucuggaaggacaaggacagccacccaggcacccagcaaaggcgccugugucacuuucaccccaccccagagcaggggucccccgggcgguuacccucugcggagccgggggucccccgggcgguuacccucugcggagccgggggucccccgggcgguuacccucugcagagcggccccuccccaucacugucaguccccaugauucucagcagugauguuguccccucggguugggggcacccaagccccugccucgcgugggccuaagccaggcuugcccugcccuccccaccccaaauacccccucacacccgcuuccugucuccgcagggcuccaggggacccaagggcuacaaggugagcgugggcugcugggaggggggaguucugcccccacggcagcaugucugaccugcaucugacuccugccuucguuuucccgccucacagggagagaagggcaagcguggcaucgacgggguggacggcgugaaggugacuggggggagauaggauggacggggagggacgaggaggaauggggcgagauggggagggacggaguggacggcgugaaggugacccggggagggaugggguggacagugugaaggugaccaggggaaggacggggagggacggggagggauggggugaggugaucccggcaggagggacagggaggagugggguggacggugugaaggugaccccaggggggugucugcuaggcagggcuuuccagggaggguguggagggcauggagggcaccaagucugacaguugauuggccucaguuuacccacuuggccgucagauuuucuaguuuucuuccucuuuccagggggagaugggguacccaggccugccaggcugcaagggcucgcccggguuugacguaagucacuuccucucacugauacuuuaaaacuagcgcugucagcagcaccucguguggaccguuuugacuucugucugggcggucuggggcugcugccagaggccgcgguggccucugccgguggugucaugcugcccucuuuucuccagggcauucaaggacccccuggccccaagggagaccccggugccuuuggacugaaaggagaaaaggugagugacuugcggccccuggaggaccagggccuucacgguuggccaagcgcugaauuggaaaccucuccuggaagcaaguccugguccgagcaugucggccacccgugcggccucagaggggaggagcugguggaggcuggaggcaggcagaggagcagcggggacagugcccaccguggggacaguggccguggcgcucccgcccagagccuucccugcagcccgagggccuucaggccuccgccauucugucccccgcaccugccgcucgcucggcacagaugggaccccaccgcgucacuccuagccugcgagccgcagcccagaauggcucucagaacugagaaugggcuggguggcacugaggguggcgagugggcgggaggguggugagcgggggcgggaggaggguggugagcgggugggagggcgagugggcagcgggagggcgggagcacgaggcgggagaaggagcuuuuucgucugacagcugagucugccguugcugguguuuucucuggaguuucuuuguugaagcugaaguguuggggaagacaaaggcgaaugcugaccccaccccaaacauucccagacgagcuccuagaacccagcagacgguuuccaaaucucaucuucaaguucccagauuacccuccaggcccuagauuugaguuugccaauuugccagccuggcaaagcugugccuucucuaaugggaaccaaauccugccccuuagacaagauggcccuuggcugggccucacagggaacaagguuggagcauuccaggaggucuuugugcaggguuguggauggcugagggugcuggggggucugggcucagacaguguuggucagagggaguggccugaaguaugggugagaggcccuggauguggccucugauggcugcaccccuggugcacaccccugccagcgugugugacucccccggucuuccccagggcgagccuggagcugacggggaggcggggagaccagggagcucgggaccaucuggagacgaggugaggagcuucacagcccccacacaugccagguaugggcccagggagggucaaggagauggagcgaccauucaacccuuguuccccacagggccagccgggagagccugggccccccggagagaaaggagaggcgggcgacgaggugagugagggcuccugacaccuuccuggggaagugcauggccucagcuucugauccucuuugcucggggucuacuccacgucccugagaccaaaugcaguguguccaccagacuaacgccggcgucuguuucucuucaucccaggggaacccaggaccugacggugcccccggggagcgggugaguggggcaggggcagccugcgcuguuggccucaccauguagcuguggacguggccucugcggcccagucuggcccucccagcacugagagccauggccuccugcccaagacaaauggguuucuucacccacacguccaggaugccucuucccacagucucagagcgggugggaccuggggaaccaggagauuccggccucugcaaccguggggcaugcgguggagggguggccccucccagggguccugcugggggagucaguccaggccaggccucaagccccaccccagcugggugugaguuccagcagcugaggcuucuccccuccaugucucuccacucaggguggcccuggagagagaggaccacgggggaccccaggcacgcggggaccaagaggagacccugugagucacaguuccuggagcugggaaccaccccaggaaggggcaggcggaggcuggggcugggucaggccuccagagccacaggacacaucaugaagccccuguggccccucaacguggccagcccauccccacgccgucagggagggcagccccugaagccggcgcccagccaugugccugaugcugggaccuguuucaugugaaggcguugcccguggacccggugcccacuuucccaccaggcggcuuccacguuucugcauccgagcuuggguucuucuuuggaauaauuuuccuuaguuaaaauucccagcgugaggaaguugggucaguaccccagacgggaagcuaggccugcagggcgccugccugggaaggcuugacauggaaaacucaccccagagccgagaugccggcggccucagaggccaccccccaccuucagcuccguggaccgugggccucgcuaggccaccccacagcccagccucagggugcagaagcacagggcccuucucugucccugugacuugcugggaaaucugugcuggauguggggcggggcagcuggcagacuccgggcgucucagucccauccggcucagggagagccagggccuggcgggcagagugaaggggagagaaugcccuagugugcccagccgagcugccaggccucagaggcagcgcccccgggugcccccuuguccgagaaucaagacaugcgacugucgugugcugugacagacaggcggggcuccagcagggccagagagcugagccggggccagagucgccgccaccgagggauuuggcuccccaguggggggugggggauuucugaccuccucccugggagcuccccagaagcgcacagcccccguggaggggucggggggacgucaaagcagggaucgugugacuuagugacucagacugccuucuaggcccacuccucugagaucaggauaugagacugacagccaggcagagcccagaggaagggccagccacgcagcuccagcuucccggcgggccacaaguccauggcuacaaacacuugccggguccacggagcuugcuggagaagcagggaugcacgcagggacgccucuggggccccaggaggagcugccggccuccugaaugaagauagccauagccagccacgccgauggccacgcacgugggccgaggaaacgcuuggcgaggccaggaaggggcugugcggggagggaaggccggaacagcccagugaccaccuggacagcaugcuguggcucccagcgugcccgggcagccauccuccccaaggauggcccagcuccacacucacggcucguuucucuucagggugaagcuggcccgcagggugaucagggaagagaaggccccguuggugucccuggagacccgguaggaagcgcugugggguuggggggcguuggccaauuuggguuuuggggguagaagugcuccagcagcucacgcacugggggucuguucauuuccguuugagggccucuguguuuccguagaucucgggggugucccugcgugggagccggcugcagggggugaggcgcggccugggccgggcugguguggauuguugagagcaggcccagcgcccgggggccugacgcugagacgcucagcccagguggagaagcgcugucugggggcccauccggggcaagggugccucacagugaggaagagguguuggagccccugggagacacugggagcuuggucagcaucuguuuuucugggucaggagccaggcaugacuguggcuggaggucaacuggggagugugaggcuauggagguuuccagaaucccagggugucaggaugaaaaugcacuuucaucucauucuaaauucccuucuccgagccucuggaaucgcugugcacgccgcacggcuuucugucucuucccccauucugaugacugccaugaugguggcuccagugugguguugcccgcaggcugggcugggccguugcauccucccggagcucaccugccccacggggacaggaaggccuccacacggucacgcccggagacagcaagucugugcucccgagcuugucugcuucuguggacaaaucgaccuuacggcuccaugugcgcagcugcccacacaccgagcacaaggccagacccugggcacggcagcugucucagacguccagcaagauggggccucagacccagggagaugggagaggccgucccagugcaagucacauuuguauuucugugcacgaggugaaaucgugcuuuuguggugccaacggguguuacacagcuguuaaaaauaccugugucauagaugaggaccagggcagggcuuggcaggcggggucugggccguucguccaccugguccugcgugccgcucacggcaggggcagaaagggcucccgacaccuuccuggggaagugcacggccucagucucugauccucuuugcucuuugagcucccggggcuccagcccugaggaugaucugaccucccauguggucacccaggacagggccaggugcagggcacagugcguggaagaggccaugcagccaguggcagauuguggggaggggacggcccagggccacguuccaggcuugggaggcugcuccagaccuugguagcugaaagucucagugggaaugagcguucagaggccaggacuugcucggagaauucuaaccacacccugccuguuuuauauguucaguuuucaaaguaaucaauagccacuauaagaaaaaaacaaagccacuuucaaaggguugugguaagaggcaguccugugagcaggccggcugcagggccuccagggcuguggggcaggcugcacaggggcuggugggucccaugccugggggucugggaauagucucuaggcugcuguccuggaggagguuucccccaacgccugagaccagggcaccaugugacccaugacucacaguugccuggcugaggcaggcacuuguucaccuggagccucccuggggccuuucggggcccggggguguggauagguggcuuuggagccacauuuguccaucgggacguugggcucccagcuggccuuccgggcuuucccugcucccagaaccucccugcucagcccuugccagccuuaccccuccccuccacccugcccagcauggggcucucccuguguggaugccagaagcaguugggcccucagggcuggucccaggaggugcccccagugaggugcucugcagaaacugcccagucuggccuccugcugucuguggcacagucugacuguguguggugagguccaggccuucugccucccacuuaccuggcccagggcacagagaccuccuuuccauccuuccuccuggcccccuuuucguguucccaaggcaggaucucaggguaccagacuaaccccuguugaaccccaaguuuggugagcuucuggaccuccuugaggcccgugugcaaaguccccagucaagugugcaguccugacugcuggggcguugaccacgaagggugcaggagcuucacagccaggccugggugcuugcacagucgggguagagagagcaauacacuagaugccuccugucugccugguggaggccacggggucaggauggugaaugggccaagucugguaguggggaaguuguaaacauuugaaccaccggacaggccucaucgggaagcaucagccuaaccacaggccagggacaggcgucugagcaggcacaggccagggacaggcguccgaccaggcucauggcuggggccaggugggccaggugggccaggugggccgggcgauguguacacggcucccuucuuggcucagcugggcgcgcugggaagugcuuggggugccugggcuagacuccgaagggcagggacucgccgcuggaguuguccacggagcaggcccucaaaggugggagcuggggccagcucuggaaauagacccccacaggguccucaugagaugugggggacccaaggaaguccagcaggcagccucaggugcaggugggggcagggugguguccaggcucagcccacagaggguccugcgguugggggugggcuaaggggaccaggccaggcccaaaggggaccaugagggagggcagucuggggccacucugauaggagaaggggcagguggucugcggccuggggaccuguagccucaccccuccguggggaccugaggcaccagccgggcacucaccgaagucaucugggacaggcuucacccuuccgugggggccugaggcaccagccgggcgcccaccaaagucaucugggagaggcuucaccccuccgugggggccugaggcaccagcugggcgcccaccgaagggcuucaacacuugugcccaggcccuucgugcaggcccuucgucagacccaagagugggccuggcucucccccugcacugaugggacuggggccagagccugggggcccugaugccucuuggucugagacccucagcuuagggucagggagggcucaggcugggugaggccugugguccaacgugccauauccaucucucuacagggcgaggcuggcccuaucggaccuaaaggcuaccgaggcgaugagggucccccaggguccgaggugagucccacuccccacccacacccgcccacccaggggggccugaggauccagaacccacugucugcccagugcuggccccgugcccucugaggacucuauggcccuggguguccuggcucccgaugggaccucucccggccccaggagggcccugcuucccuccaaggucaccaugcuaagccugcuccccucacgccuccucuuccuccucagggugccagaggagccccaggaccugccggacccccuggagacccggggcugaugggugaaagggugaguguccaacagcucgggcccuagggcggaggccuggccgccagaggcccugggaagccccagccccgcacuguggagcugccuggggucccugaccgggccgggagugcccgcagcaucacuggcuccuggccacagucggcaccugagccagaggccgccucggcagggccccuccugccccgagauccgggucccaggguccacggggaccagcaggguggccccaggggagggagccggcuucugggcugacggaggggcccugcgggugaggugcucccgggccugugccagccaguggguaucccaggccaggccgauucgcacggugacggcuacucugcucccccagggagaagacggccccgcuggaaauggcaccgagggcuuccccggcuuccccguaaguguccggaggcugagcccacaggaacaugcccaagcugccugcggcgcccucuuuaguggacugggcacucuugggugggcgggcuggccccaggaccgccggcuggcccaggaauuccauggccgggauucugucagcucaggcccuuccgcugugcgccccucacagccuccccucucaaaucagaacccgguaucacugcccugcuuuuccaugacagggguauccgggcaacaggggcgcucccgggauaaacgugaguacgcccccuccuccaucuggcugugggcacacaaacauucacagucacagggacacgcacgugugaacacacaugugcacacaggcucccgagcaaacacacgggguacacaggcacccacggcugccccacugucuguggccacagccccaguuggcaucggcuccugcaggcccugcgaggcucccacugugguguggccugugggucuccucacggcccugacugcccggugaccgaucuccccucggugcgcagggcaggcccagccccagaggccgccccacggcucucuaggccacuccgggacccaguuucuccagcccaggaaauguguguggugggggaagggaagagaagagugccucucuuaucuuuauuuuuuuccuuuuaaaauuuccacuuccuaaaaacaaaauaaaacccuuguuaaccaagugcucucccgucacugcagggcacgaagggcuaccccggccucaagggggacgagggagaagccggggaccccggagacgauguaaguguggaugggaggcagggccagccccaaguccaccugagccagagggcugggcccuugaagggcaguggaccaggacccgcuuggggaggccucaugggccccggcugcuggaugcucuguggacggggccagcgcgcagaugcccggguggugcacggucuguugacacaacgcuguucccuucuagaacaacgacauugcaccccgaggagucaaaggagcaaagggguaccggggucccgagggcccccagguggguggauguggcugggugaggccacggugggcugugccugggacgccggaugcuggggcuggggaaugcuggaagaggcugggagagugggaggcggcgggagggaauuuuggggagcacgucaucugggaggcccugggggugggaggugccggucaccagggccaggugguggccagggcagcagagccgagcccagggacacagcggguccucaggguggggcccaccugggauggccgccuggaccaccagugugcgaagccccagcugcccucacagcaccgucacuggaggacgaggggcuggguagggagggaccgggcaggggugggcuugaugaggggcagggcccugggggugggggcugucucagcucaggaagcacagugggcuccucacccucagagcuccucuacuccguuucucggacagggacccccaggacaccaaggaccgccugggccggacguaaguggggcucugugaacauugcugggggcgaccacuguagcuuccaucccuugggguguggguccuguccaugggugcuccuguagacgcugcucacggggggguggguuguggacaaagagcuggugccaggcccuagggacccgugacggccaugggaggacccgugaggaucauagggggaugugugaggaccauagaggggacaugugaggaucaugggggacaugugaggaucaugggggggacgugugaggaucaugggaggacgugaggaucauggagggggacaugugaggaucaugggggacccgugaggaucaugggggacccgugugaggaucauggggggggacgugugaggaucauggggggaccuguacccaugaggaccaugaggggacccgugacggccacggggagacccaugacugcgcuguuucuaugaccacgucagggguccagcccaguagcagggguguagugggcagagccgggcacaccugcaaagaaccuccugcccaaaccccgcccugugggggccccagggagggugaccuggagauccagcagcccacaguccccgcugggaggggcugucuauggccccaguacccucgucucucccuccccaggaaugcgagauuuuggacaucaucaugaaaaugugcugugaguaucucugagaagccguccucguuagggagagcagggccgccagccuggccuguuccacuccuagaagggugucuccacuguugggggccugggucucuggguacauccuugaggaggcuccucagccagccccuaccggccuccaaagcccucccaggcccccggguccccgcacaggcugagaguccccggugcggugcagagcugccacguggggagggcggccggggaggcggggaggcggggcaggaggccggggaaggggggaggccggggaaggagggcggccggggaggcggggaggcugccccaagaguaaaagccuuucugacgugcgcaggacgcggcccugacuggucuaacugacucuuucucuucuccucagcuugcuguggugagacccaggcucuagcuccugagagaauggaucccgggggucggggagcgaggccugggucccacacaugucacaggacagcacauggcacucugguccccgcccgcagcucccugcaccugcccgcccccucuggggccugcuccaagccagcaggguucccggguguugggcugggccccgcccucuuucacccauaacugaaauaaccaggagcaggcuugggggggucccugcuccaucauucuggcccacaggccccacccuagccuggcugagcaacgccagcccugaccagccgccggacagagcagccuuuacggggccaugggagggggugggcuuuucuggggcugagacggggggaccccaacgugucaggugaggauguggcagccaaggaggggccagggcgguggaggggaggggccagggcacuggaggggaggggcgugcucugcugacaccgcccccgccugcagaaugcaagugcggccccaucgaccuccuguucgugcuggacagcucagagagcauuggccugcagaacuucgagauugccaaggacuucgucgucaaggucaucgaccggcugagccgggacgagcuggucaaggugaggccucgccccgcccggcuuucucaagcccaggugcaccccgacccugccggccgccccugcccgcgccagaccucagccucccgaggccaccgcugcaucccugugacuucccuacucaugacaaggaugccaggcacgcgccagcccguccaggccuccagcuccaccuggcgaggcuggcccauuguacacaggcgccccagaugagggagggucucccccucuccuugaagggcgguagucugggguccugagugcugggugugggcuugucccucguggacagaacccaggagggcuucauccaccaaggaagauugcuuugcaggguacccaggucccgggggcugugccacccucugggcacccggagccaaucgcaggguacccaggucccgggggcugugccacccucugugcacccagagccaaucgcaggggacccagguccugagguccugggggccaugccacccucugggcacccgcagccaauagagucacccuugggaagcuuaugcggaccuggggcagcacucgcguccugaccccggugccggucccacaguucgagccagggcagucguacgcggguguggugcaguacagccacagccagaugcaggagcacgugagccugcgcagccccagcauccggaacgugcaggagcucaaggagugagugccccacgcggccaggacccucccaccccucgccccgaccgcuguucccacggcaggucggcccugaccccugaucccaggugggcucggccccgcggcaggccuggccccaaccggcccuuccugcccuuugcuaugcagagccaucaagagccugcaguggauggcgggcggcaccuucacgggggaggcccugcaguacacgcgggaccagcugcugccgcccagcccgaacaaccgcaucgcccuggucaucacugacgggcgcucagacacucagagggacaccacaccgcucaacgugcucugcagccccggcauccaggugggguggccacccccaggcugcaccugccccgccuagggcgccccgccagccaggguggccuuguccccagaaagacgagggcagagcaggcugcgccacaccgauacugucuguccccacagguggucuccgugggcaucaaagacguguuugacuucaucccaggcucagaccagcucaaugucauuucuugccaaggccuggcaccaucccagggccggcccggccucucgcuggucaaggagaacuaugcagagcugcuggaggaugccuuccugaagaaugucaccgcccagaucugcauaggugcgcauggggccacccgggcagucccagaucugcguaggugcgcgcggggccgcccgggcagucccagaucugcguaggugcacgcggggccgcccgggcagucccagaucugcguaggugcacgcggggccgcccagggccgucccagaucuguguaggugcgcgcaggcgcccagggcugucccagaggccuccucccagcucacuguuaccuccaggggcacggccacccuguaggugcgcacggggccgccuggggcugucccacaggcauccuccucccggcucgcugugacuuccgggggcacggccaccccugugcucggccgggagguccugugacaucuccuugcgggguuauagguggagcagugggcucacacugcacggcuuuucucuuuuacagacaagaaguguccagauuacaccugccccagugaguaccucggcggccgggacacguggggaggagggcaccgugguuggggcgagggcucugagaggacggggcucugggaggagggccuggcggucacgagaguaggugcauggcucacuccgguggcugagcaccaccgugccgugcccucucuggggagcuuagacgcucucuggccggcccacugcggcugcaucaccagggccucaugcuaacggcugcccaccccgccccgcagucacguucuccuccccggcugacaucaccauccugcuggacggcuccgccagcgugggcagccacaacuuugacaccaccaagcgcuucgccaagcgccuggccgagcgcuuccucacagcgggcaggacggaccccgcccacgacgugcggguggcgguggugcaguacagcggcacgggccagcagcgcccagagcgggcgucgcugcaguuccugcagaacuacacggcccuggccagugccgucgaugccauggacuuuaucaacgacgccaccgacgucaacgaugcccugggcuaugugacccgcuucuaccgcgaggccucguccggcgcugccaagaagaggcugcugcucuucucagauggcaacucgcagggcgccacgcccgcugccaucgagaaggccgugcaggaagcccagcgggcaggcaucgagaucuucgugguggucgugggccgccaggugaaugagccccacauccgcguccuggucaccggcaagacggccgaguacgacguggccuacggcgagagccaccuguuccguguccccagcuaccaggcccugcuccgcggugucuuccaccagacagucuccaggaagguggcgcugggcuagcccacccugcacgccggcaccaaacccuguccucccaccccuccccacucaucacuaaacagaguaaaaugugaugcgaauuuucccgaccaaccugauucgcuagauuuuuuuuaaggaaaagcuuggaaagccaggacacaacgcugcugccugcuuugugcaggguccuccggggcucagcccugaguuggcauc

SEQ ID NO: 16299 - RNA, 40327 nt, Homo sapiens
ugagugaagagaaauugcguauguuuuauauauaaaaauagcaaggaucaagaaaguccaaaaauccaaaguuaauucuuugcaaaggcgaacaacauuccugcaccucugccgggacugaggaaaaggagagaagcagcaacaagcagggauuucagcaaagggcuccuccguggucuggaaggagccaccuggaacugccacagcuucacccuuggagaggguggagggacccucaagucagggccaagacacagcugccugcccacccugggaggaggcagaggagagaugggaagggcaggacgcugggaggaaagaagcgcguugcucuuuucucagcacgucucccacguaagccccacaaguggaucugcaggugaacucucaggaugaguaagucaauguaccgaagucaccagauggaagggcagucuagaaaaaccaccaccgaguccuaagcaauuaaaaaugaaguuuuaaaaaggcaccauugugaauaaugucgcaauaaacauacgugugcaugugucuuuauagcagcaugauuuauaguccuuuguguauauacccaguaaugggauggcugggucaaaugguauuucuaguucuagaucccugaggaaucgccacacugacuuccacaaugguugaacuaguuuacagucccaccaacaguguaaaaguguuccuauuucucuacauccucuccggcaccuguuguuuccuuacuuuuuaacgaucgccauucuaacuggugugagaugguaucucauugugguuuugauuugcauuucucugauggccagugaugaugagcauuuuuucauguguuuuuuggcugcauaaaugucuucuuuugagaagugucuguucauguccuuugcccacuuuuugaugggguuguuuguggcacauauacaccauggaauacuacgcagccauaaaaaaugaugaguucauguccuuuguagggacauggaugaaauuggaaaucaucauucucaguaaacuauugcaagaacaaaaaaccaaacaccgcauauucucacucauaggugggaacugaacaaugagaucacauggacacaggaaggggaacaucacacucuggggacuguugugggguggggggaggggggagggauagcauugggagauauaccuaaugcuagaugacgaguuagugggugcagcacaccagcauggcacauguauacauauguaacuaaccugcacaucaugcacauguacccuaaaacuuaaaguauaauaauaaauuuaaaaaauuuaaaaauaaaauaaaaauaaaaaggcaccauuaacaaaaacaucagaaaguaucgguuaacuaggaagaaccuaauuaaauacgcgaucucuaccgcgaaauggcuagaagggccucaggcaaacccaccagugcugggggcugcagagggaacccggcgcugucagacaccaccucagcgagaccccgccugucucucucuugcagggcaguuuccguuugacuuucuucaguuggaggcugaaaugaaggugggugaccucccugugggguugggggcccccaagguccuguacaucccgcuggguggcugcucccaauuucucgccccauccggcccaagcccccuuccuguucagcccugcgaggggcgcuggcuccagagggugucgagggcgucccucaggauguuccuguccccggcucaguuuuugggggacucggcugaugcagugggagguggggagucgagcccuauucuaugcagccagcagcucccaggccugggcuccggaagcuucugacugcccagcccuggcucggggggaugggaggccaccuguggcuuguagggguucagggcucccguguaacaaguguuuccguccacagggggagaagggagaccgaggugaugcaggacagaaaggcgaaaggggggagcccgggggcggcgguuucuucggcuccagccugcccggcccccccggccccccaggccccccaggcccacguggcuacccugggauuccaguaagucccagccugugcaggcagagcccaugucccaggggucugggugcaggagccgagggcagguccagcccggccuucgacacccgcgaaggccggagcugccccugcaagcucagcagccccgacaugucccuguccccguguggggacgcagcaggccacaugggugugggugcacugaccccggacaccccccgucccccugcagcguuccauggccugcccuccugcuggggccacgugcauccaccucugcuccugggccgggucaggucagaucaggguuuaggcccaucaguccugaaagacuccagagagccaugggccccagcuacugccugggggcccacacuguugucaggucucugcuggucucucccccgggaucgcacccccagggaagaaggggugaugguguggggguuucucaggcuauggcgugggcagggaggggaccggugacucagaggcugcgcucgccaagggggucuuggcagcugcagccccacaagcuugcccgcccccaguccagggcacgagguaaccaggaagcgucucuugucgccguccguagggucccaagggagagagcauccggggccagcccggcccaccuggaccucagggaccccccggcaucggcuacgaggggcgccagggcccucccggccccccaggccccccagggcccccuucauuuccuggcccucacaggcagaguaagucaguggggagugggccccgggcagaggccgccucguguggcuucguguucccaccuugguuucucuccugcagcuaucagcguucccggcccuccgggccccccugggcccccugggcccccuggaaccaugggcgccuccucagggguaagugucugggcagccggcugggcaccugcgucccgugcccuggcugguucugcagccccugccccucagagacacucucccacggaccccacagggagauauacaggaggccaagaugcgguuuccaggguggaagcggggccaggccaugggggaaucagguggacccaggaggacgaccaccagccgggaagugcccagggccuguacauuguccacggaggcgcaggagcuggcggcaggcagggguccccauggugcucaugggggcagccgccucaguccacaccuguccaaagcccugcggccccugcccagcacccugaaacgggcauuccuuccuuccgccccugccccccgcccuccccgccaagccccacaccucugcauuuggucccagcaggugaggcucugggcuacacgccaggccaugcugggccaggugcacgagguucccgagggcuggcucaucuucguggccgagcaggaggagcucuacguccgcgugcagaacggguuccggaagguccaggugagcgcucugugugacggguucuggacccguggaagggccgaagccgccuccuggggcuuaaggaaggcgagaggcucaggccccggacagggaugggagcagguggcagccagcgcuucuuaaacuuucaaacuuuugguaaaguuuaguaaaauacuuuugugagcaguuuuggguuuaaagaaaagugagcucaagcuucugaaaguggaugaacacauggcgugugaggggcuccuggugggucaugucacagugaacguuuacaaagauaaaugucaccucacacacccgauaauaagacaaggcgccugacgggacgaggcggcaggggggcucaggcccuccagggccacgugacguccacagcacggccccggcuggggggcaggcugucccguggcucugcaccccgcguuauaaacaccaaggugggaugaaaugcauccucucugcuuagcacgggccuugcucaccagccuggcuccucagacacaccugggauugccccuuccaggacaggccagccccuuuccugcuuucccaaaauggucuggguggcaggaguggccgcucugauccaggugggugcggccaugcuugcagggccccgggaagguuuaccuucguguggcaaaggugaggacggguagaagccccaugccgccgaaacggccugugacauccgugggagccuccauggcagaacacugcacacugacacagcccugacuccuggagcccucccaccuuccaacacacccaccuuccuucuagagcccucccaccuucccucuggaacccucccaccuucccucuggagcccucccaccuucccucuagcacucccucccucucgccaccggcccccuccuaggccuggccagccccugcagcaccccagacagugaaucccacuccagucccuucaucuggccagggagaggcugccagucucauagcagaugcugagcuggugcccacugugugccaggugugcuuguaggcacccggaugcagccccauccuaacuuucaggggcuuugguccugacaggaggaggcaggggauggcauccuagcaaacgcgugcugggagggcugggugcugggcagggagggcaaccugccguggacugggagggcugggugcugggcagggagggcacccuccugugggcugggagggccggguguuggggagggagaggcgggugcugggcagggagggcacccuccugugggcugggagggccggguguuggggagggagaggugggugcugggcagggagggcaaccugcuguggacugggagggccgggugcugggcagggagggcacccuccugugggcuggcagggccgggugcugggcagggagggcacccugcuguggacugggagggccgggugcugggcagggagcguacccuggcacaggcuuggaggggcaggugcugggcagggagggcacccuccugugggcugggagggccaggugcuggggcgggagagucgggugcugggcagggagggcacccuggcucaggcccagccgcagguccugggugacccugcugcuuucuuccagcuggaggcccggacaccacucccacgagggacgguaaggagccuuuuuucuguugagacugguggguggucaggacaugaggggguaugugcuguccccuguuugaggaacaacacgugguccuuuggaguccuggagcugaacauguggcucaccaucagccccugcugcagaaacuggugcaggacaccccacuaccucugucucagcgcuggccccccaguaccuccgucucagcugcuggccucacgagggagccccucucaucccucaacuuucccaguugugucugccgcucauugcccuccucaaggucaaaauccuuggggccaaaauccacaucuugugucuuugccuucccucacccaaagugccagacacaagaauggauaucucuaagaguggugggugacugggugggugaaucaauggggagguggauggauggauggguggauggagaggugggugaguggauacguagguagauggggagguggauggaugaguagaugguggacaggugggugaguggauggaugguggucaggcgggugaguggacggguggguggguggauggaaaggugggugaguggauagguagguagcuggggagauggauggaugguggacaggugggugaguguaugaauggguggguggauaguggguaagugggugaguggaugguggacaggugggugaguggauggguagguagauggggagguggaugggugguugcuggacaggugggugaguggauagaugggcagauggaugguggacaagugggugaguggauggguggauggauggugggcagauggaugguggauagguagaugaguggaugaauggguggauggaugguggguaagugggugaguggauggguggauggacaggugggugaguggauggguggguggauggaugguggguaaguggguuaguggauggguggguggauggauggguagaaauauuuucguuuuccuaaguguugcguccagcugcugucggccccuccuugaguagaggucaugauuccuuaauuggcucaggagugaggccugauguggagcagugucaggggcuccacagcggccugucuccucacaggguucagcccagucugcucucacucauuugcugauucauucuuucauucagccagucaauagucauggccccuccugugugccggguggccauggauauugcccuggguaacacacagccuggcccuguggagcagacaguggggacagccauguggacagggugcagguggauggcaauggcagcugggucaggaggggcugagggccguggggaaaggugcagaaucaauaggggcauccggacuggggugcaggccugggggcugggauuucuaggguggaggucaccucugagggagacagagcaaggcccugggagauuagaaggucgaaggucgccguguugaggucaggggcccugaauuggagccgcggcaaaggagagggcaggucagggcacguggugagugauugcugcggcuucugagcacggcugggucuguggggccugagcagaggugacccgcgauccggcgccacggcaggcaggacuccccacccuugcugcugccuacacccccagggcagccccagagucgggggcgcagcucccugcuugccaguucagagcccagccccucucacccagcccagaggaggacacagauggaggaggggcacccggaggguccccccgccgacaggccccacgucucccaccugcaggacaaugaaguggccgccuugcagccccccguggugcagcugcacgacagcaaccccuacccgcggcgggagcacccccaccccaccgcgcggcccuggcgggcagaugacauccuggccagccccccucgccugcccgagccccagcccuaccccggagccccgcaccacagcuccuacgugcaccugcggccggcgcgacccacaagcccacccgcccacagccaccgcgacuuccagccgguggugagugcccccccaaagugggcuuggcuccaucuagccccucggcucucggcagcagaagagggcccagccccugcagagcugcugggggucccaggcuucggccaugggugggggucuggcggcucagggccacucagggcggcuuggcuggcccugggacuugcccucugguggccaagcaguggucaugaaaguccagccgcugucacauccuugaggaaccggcguaccuccgccuacagcggcagcugggggcacccacguggcccggggcugcucugaccuggcagcguaugggggcugcugccugggccccucagugugucacuugcgcgccucccgcucagcgccccucggccgugccuguccacacaggugcggggccgggguggugcgcccggggccugggugcagggggcagcgugggacacagcccgugacgcgccccucuccccgcagcuccaccugguugcgcucaacagcccccugucaggcggcaugcggggcauccgcggggccgacuuccagugcuuccagcaggcgcgggccguggggcuggcgggcaccuuccgcgccuuccuguccucgcgccugcaggaccuguacagcaucgugcgccgugccgaccgcgcagccgugcccaucgucaaccucaaggugggucaguccaguccugagggcgcgggcuccucggcccccacuugaccucuggggugaacucccagcggggagcuccccucuagggccucuggaggccaccauguuacagacacuggcgccuaggcuggcgacuucagggcaggcuccgggugggucacaccccuccaggcucaggccaggccucugcaucccugggcacugccacgucccccagggcaucccaugaggcccccccguggcccccugaccccccgcucccccggcagugccccucagagggucccaugcugcuggaccaaguguccacacaggugauagggcucacauacaagccuggaaucaggaaccguccuuugggccucuagugccaugcgggcugguggccccucugccacagcacccauguggcuuuauucuguggccccuuuucgugcacugggcuguggcuucugggugccccggggagcacccacauuccccagaaccaacagcagaggggucagagacccagggcugggagcaggcggcuguggccuggcguuaggggacaggguccccugccuuagccaaggccucuuggggucugcagaggcugccuggccaggccuggcucccccacgcuuguucccuggcaggacaugcccaggggcugcagaaccccaccccccaaaaaaacacacacccacaacaccccacauacacccccaaacaccccccacaccccacacacacaacacaccccccccccacacauccacaccccacauccacacacccccccacaaacacccacacccauccacacccccacacaccacacacacauacacacgguuucucuuccaggacgagcugcuguuucccagcugggaggcucuguucucaggcucugaggguccgcugaagcccggggcacgcaucuucuccuuugacggcaaggacguccugaggcaccccaccugguagguucccagugccgugugagcagcucugagagccccagccagggaaggcgggcgggcgggcuccuaucugcaguuuccccccgaguuuuuggacaaaucuuauacaugcucauuacuuuaaaauuacaaaauccaaaagagcauugagaaaaaugagaacugcucugagaagucaucauuagcaaugcguuugagagccagguaguuguaagaaggccccgaaggugcccccggcccucugcucauggcggauagacuccaugucucccggaugucaccaagccuguggucagccauguaagcagcgcagcgaguuuauucaccgagaauaaacuccucaaagggcaacacggaguccgagcaugugugcccuuaaaauguugacagaaauuuccaggguaucuagaagaacgcuucgucccaaaugucgcugugcccuccccacgugagcgccgcgauucuuccaacacucaugcauuuaggggugucucggggugccacacagcguguccccagcagugccuggccaucugcuguaacggagaugcaccugccaagggucucugacaggagugcugugggcagggcugggccccagggaaggccugaaagccaggagcccgggaggcggagcugguuccuagcgaggcagccacaggaagccucugcucagcaggcaugagggccagguucacccagccaggccaagcccuggccccucuccccucugccgugggugugucuggcagaagcagcauggggggcagucugggagaugcagcccccuccacaggcagccagcagggaggccauguggcccuccagguugugggagccucugcagcccccugguaaccccagggcuggccuccugccuccaccuuuccugcccggggagcggccucugcccuaagcagagcaggucuggguuugacugacggcccggcgcgucuuacaggccccagaagagcguguggcauggcucggaccccaacgggcgcaggcugaccgagagcuacugugagacguggcggacggaggcucccucggccacgggccaggccuccucgcugcuggggggcaggcuccuggggcagagugccgcgagcugccaucacgccuacaucgugcucugcauugagaacagcuucaugacugccuccaaguagccaccgccuggaugcggauggccggagaggaccggcggcucggaggaagcccccaccgugggcagggagcggccggccagccccuggccccaggaccuggcugccauacuuuccuguauaguucacguuucauguaauccucaagaaauaaaaggaagccaaagaguguauuuuuuuaaaaguuuaaaacagaagccugaugcugacauucaccugccccaacucuccccugaccugugagcccagcugggucaggcagggugcaguaucaugcccugugcaaccucuuggccugaucagaccacggcucgauuucuccaggauuuccugcuuugggaagccgugcucgccccagcaggugcugacuucaucucccaccuagcagcaccguucugugcacaaaacccagaccuguuagcagacaggccccgugaggcaaugggagcugaggccacacucagcacaaggccaucugggcuccuccagggugugugcucgcccugcgguagaugggagggaggcucaggucccuggggcuagggggagccccuucugcucagcucugggccauucuccacagcaaccccaggcugaagcagguucccaagcucagaggcgcacugugacccccagcuccggccuguccuccaacaccaagcacagcagccuggggcuggccucccaaaugagccaugagaugauacauccaaagcagacagcuccacccuggccgaguccaagcugggagauucaagggacccaugaguuggggucuggcagccucccauccagggcccccaucucaugccccuggcugggacguggcucagccagcacuuguccagcugagcgccaggauggaacacggccacaucaaagaggcugaggcuggcacaggacaugcgguagccagcacacagggcagugagggagggcugucaucugugcacugcccauggacaggcuggcuccagaugcagggcagucauuggcugucuccuaggaaacccauauccuuacccuccuugggacugaaggggaaccccggggugcccacaggccgcccugcgggugaacaaagcagccacgaggugcaacaagguccucugucagucacagccaccccugagauccggcaacaucaacccgagucauucguucuguggagggacaaguggacucagggcagcgccaggcugaccacagcacagccaacacgcaccugccucaggacugcgacgaaaccgguggggcugguucuguaauugugugugaugugaagccaauucagacaggcaaauaaaagugaccuuuuacacugacucuugguuugcaagcagccuucacugucacaggaaggacacaauucuccaaaaggaguucucaggagucuuuuaucccuggacugccccacuggcagaucccgagugugcacaggcacgcacgguuacaugggguaugcaugcauggccauacacaggcgugcaguuguacacaggugugcaggagcauccauagugugcacagguacacaggcaugcacggguguguggacacacaccaacacucuuaggucucuccucacagcaggaccugacuugcucccagcaacacuacauccugacagccaucccuguccugguggacgggugagugcaggacucagaggcaggcaggcagugggugcagugagcaggcugcggagggagcaggcccucagguuggggaggcgcugggaggaggauucugauggcggugugggccuccccagugacgcucuagcccauggcacaggcccagcccaccuccacccaucacauccugcuagaucuacgagcccaggaaauggcuggugcagacccccccccaagcaggguccccaggguggccaugacagagccccuggaugcaccugggaccauggcccugucugacuggcaccauccacugacucgggccaucuuccacgugcagccucugccucaacccaggguaccccaagaugccugcuccccugagccaccucgggagaccccuggguccagcagcuccagcagccccuccccagccagagauucucuccccagcucuccgugcugagcagccagccauucaccuggggccgcugagauguggcagaggccccacaggauagggccguugacuaggguugugggggugcucagcucaugggcaccaaggcccugcgugggcuggaggcgggagaaggcugggacgccucuccuggccuccucacugacugcugacccucaacccccaggccaggccggcccugaaucagaagcccugcgcacacucacuuaaguguguuuaauguaugugggaagaguauucacaucacaucagauggucccgcaccugugggcaaggcacuagcgcuccuuagacccugaggccgcugggacguacuuccccagcgcccaccacaaaggcagcccccccaaggcugcccagcccaggcaagccuggcacauaccaaggccagcacguccgcggugaccgggaccaguccccuccgggcuggcacaagugugggagcagcugaggacccgcaggucaggauggacacacuucagaaggacagacaggaccauggagggcugcccuuagggugggagagaggaaccagcuccgaggaccagagccgcugcuccccucugaugacaaugugucugccgccaaccugagauggcuuuuccacagagacagagaagccacaugcaguucuucauucuacgucaguuaaaaaaaaaaaaagcaucuuucaaaaaagcaagagcaccaaggaugaccagcaaugucacagcucagcuacaccugagggucccggcucccacccugcccuagagggcucacaacuccuguggggccaguguccccugagcugguauccaagaggccacuucacuagcccuggggggcagaaaggauuugucucaagccccccaaggggcaugagccagugaggccugguggacgcagaagcccaccacccaccucuuccagcaacaaagcccgcggggcacagugcagggacagcauggccaggcagcugcccugagugucgccagcacgcuguggccaccgccagagugcggcacagggcagggggaauccuagggggccugcuagcaggauaagcggaggcccccauugcuaaggcaggcggcccucgaggcaggggucguggggaugcacugagggccgccugcaaaguuaccacaggggcgcccgagagucacugguucacauucugaacaccgucgcuuggaagacacugcaaacccagcuugcugacaccaggaggauggacagccagcuggggacaagucucaucugcagccucagggccugaggcuugggcggagcacagagugcagggggaagggguugucacugggcucaggaauucagcugccugcggggccggggccugggccagguaugggucgcucugucucugcuccagggaggcuggccccacagcccccaggcugucuucuggggaaagcggcgggcucugggcuggcugcaggccuccgaggcccuuguccugcacgcucagugccugugcugccuucuccuccgcggcacuccucaggcccugggccgggggcugccgcgggugguggccccgcuggcagugccgcaggccauccagcauggcccccaagaaguagaugauggacaggaucaggaaguacacggaguauaacuggaacuggaaagagaggccgggugaggcggguggggagggccuggcugggacacuggcacccuacaccccgacgccugcucccaggcucacccuccuccagcucagaggcugacccugaacacugcacagcggucagaggccagccccaggagcaggugccacagugcucaccacagcccccccgaccuccaccaccuggcacaggccugaagggggguucccaccauuucccaagaaccccucggaaccuggcagguggccugcuucugcguggccugcggugucugcucccgaguccccugcuugguggugcuugcugcccccccauggugcugagacagcggaagggugcccaugagggccagaacgucccgccuggcagagcagggugaggagagccacagcaggugaccaggagcugauccccagggcuucgcgcccagagcaacccccagcagccugcacauggagcccgucuccaucucggcagcggaagcugugcuacgaugaccagaaggagcagcaccagcguuggccacaucucuccugauucucgcagcugccaggggcaggagggacuggagaugucccugggacaccagggagggaccugaucauucccggaggugcagaggguucaggaggcugcagugcccucaggacauccgugggcagagcccagugagucccgcccaagaccccugaggccccagcuccacauccgcaggccagaaucccugcagcccaucggcaccggcacccuuccaggacagcuguuuuuaaagcaaacugaggaagauggggcugacacgcuucucccugcucuucuccuacccaagacacugagauaaacaccugggaagacucugaaagcaggagcgaggaggacagacugaccaggcccucggggucuggggagcugugccacacaagggcagacuggccgggcccucggggucuggggagcugugccacgcaaggacagacugugccacgcagagcucccugggggcuuuucuuuucaccucagauauuuugaaacugaagaaggcagcaggcuggaaaagacaacagaugcagaaaaaagagcccauggaagcagcucucucuggccuaagacccagggaagggucagcccaacaugaggaaagaccuuucgacaggaaucgcccugcuccccgcaaacaccagaccucggcuccacccaccaugucagcaaggaccccccacccucgccagccuguaacaaggacccccgaguccccugcgggguggugucagacaacaccagugggcacuagagcuuucacucccacugguugguaaagacacccacccucacccccaaggagucagcagagaccacagggaagcccaagaugucacccccaaagccucauggagucaguggagaccauguggggagccuagucacccccgaagccucacggagucagcagagaccauauggggagccuggccucuuauccucacccaguaguaagagcgugccuguccugucccccuccaugcuggggggugucagaggaggucaagcgggaguccagacuuucaccuacccagcaauaaugagaaugucccaaccccaggggcaucaagggggccacgaggggagcuggacucccauccuugccuggcaacaagaaggagcccccacccagccacccacccucccucaggugucacaaaggcugagugagagccuggacuuccaccccaccugccuguagcgaggugcacaccccgcuugaccugcaggaguugcgucagccacaacaggaugcugaaauuacaucauacccaaaaugcuugcaucucacuaaaaaaucccuuggcacacuaaaccacaaagaucucaaacugaaaaacaauuaauagacaccaacacuaagacaacacagacaguagaauucgccaagaaagaucuuaaagcagccaccauaaaaaugcuucagugaacaauaacaaacaugcuggaaacaaaugaaaaaacacagucucagcaaagaaauaggagaaauaaaaaaaauuuagaacugaaauguacaauaaucagaauuuaaaaacuuaaugaaucaucucaacaacaaaauagaagaggcagagaaaugaucaaugaacuggagguagaacaauagaaauuauccaaccugaacaaaagaaaaaauggacugaaaaaaaaugaacaaagccucauuccuugugggacuauacaacaugaucuaacauuugugacaugggggaucuagaaaaagaggagaaaaggagugggguucaaaaagcauuucaggaaauaaugguugaaaacuuccuaaauuuggugagauguacacugcagauucaugaagcugagcaaaccccaaauagaaaacccaaacaaaaucacaccaacacauaccauauucaaacuucuauaagcuaacgauaaaaauaaagaaaaaaucuuggaaguggccagagaaaaaugacacuuuacgggcaagcaauuugaauaacaguaauugcucaucaaaaauccugaaagcuaugaggaaggggcaccacauuucucacaggcuaaaaaaaaagaacacugucuacccagcauccuauauccagugaaaacauccuuugagaauaaaagagcaaucaagacacucacagaugaagaaaaacuaagagaagaaauuuguaaccagcagaucugucuaaaauaauggcaaaaaacaaacaaaaaacaaguucucuaaacagaaaggaaauuacuaaagaaggaaucuugaaauaacaggaaagaggaaauaccacaguaggcaacauuauggguaaauaaaacagacuuuccuucuuuaguuuccuaaaauauguuugaugauuaaugcaaaaauuacaauauuuucuuauguagcacuaaagguauguagagaaaauauuuaagauaauuguacuguaagcgggagaugacagugacauaaaggcaacguuuuuauacuucacucaaacuuuauguauuaauguaauccauaaagcaaccaaaaaagcuauacuaaguacauucaaaaacacaauagauaaaccaaacaaaauucuaaaggauguacaaguaacccacuggaagcugcaaaaaauguaaacagaaacuaaaaacagagaauaaaugaaaaauuaaaaacgaaauggcagacuuaggcccuaauauacaaauuaucacauuaaauauaaauggucuaaauacaccaacuguaagacagagauuagcaaagucgauuuaaaaacaugacucaacuacgugcugucuacaagaaacucacuucaaauauaccaagauaggaagguugaaaguaaaacgauggaaaaagauguaucaugugaacauuaaucaaaggaaagcagggguggcuauauuaacaucagguaaaauaaacuucugagcaaaaaaaaaaaaaaaaaaaaaaaagaccagggacagcagagacagagaaggacauuauauaaucccacuauuacacaauugacaagagggucaguccaccaaaacaaauuucaaucccuaacguguaugcaacaaacaaaagagcugccaauaugugaagcaaaaacacaacagaacugaaaggagaaacagauccacaauuauacuuaggagacuucaauacccccucucaauaauaaaacuagacagaaaauccacaagaacugagaggaaaucaauaccaucagccaacaggaucugaucagcauuuacagaacacuccacccaaaagcagaauauacauucuuucaaaguguccacaguauaucaaaacagauaauauucugggucauaagacaaaucuuaacaaauuuauaaggacugaaauaauaauguguuuuccaaucacaacagaaucaaaaaagaaauuaauaacagaaagauaacaggaaaaucucaaaacacuuggaaauuaaacaacaaaauuugaaauaaugaugcaucaaaaaacacacugaaaugaaugaaaaugaaaacacagccuauuaagauuugugggaugcaacuaaagcaguacugaguggggaaauuuauagcauuagaugcauaaauuagaaaagaggaaaagucucaaaucaauaucucaccucaagaaccuagaaaaaagaagagcaaaauaaaucuaaagcaagcagaaagaaggaauuaauaaaguuccagccagugcacuaagucaagaaaaagaaauaaaagauauacagaucagaaaggaagaaauauuugcagaugacauaauuaucuacguagaaaaucucaaggaauuuaaaaaacaaaggccaaaaaauggaaaagccuccuacaacaaauaaguaaucucagcaaaauugcaguauacaagauaaacacacaaauauaucaacuacauuucuauacacuagcaacgaacauguauacacuguuauggaaugaauugugaacccaucacccaauucauauguugaagcccuaacccacaaugucacugcauuugaagacagggccuuucaaaagguaauuacgguuaaaugaggucacaaggauggcaucuuacuccaaccugacuggauguccuuauaagaagacagacacuagccgggcaugguggcucaugccuguaaccccagcacuuugggaggcugaggcggguggaucaccugagguccagaguucaagacuagccuggccaacauggagaaaccccgucucuacuaaaaacaugaaauuagccaggcaugguggcacaugccuguaaucccagcuacuugggaggcugagacaggagaauugcuugaacccaggaggaggagguugcggugagcugagauugcgccauugcacuccagccugggcaacaagagcgaaacuccaucucaaaaaaaaaaaaaacaaacgaaaaaaagauaccagggaggaccauacacagaaaaaaaagaccauaugaagacaaagggagaagaugccaacugcaagccaagaagagaggcaucaggagaaaccaaccugccaacaccuuaaucucagacuucaagccuccggaacugugagagaauauauuucuguuguuugucacccaguuugugauauuuugcuauggcagcccaaacagacuaaugcagauaacaaauuucaaaauaugguuugauuuacuuaagaaaaagcauaaacuaaaaacauguauaguacucauaugcugaaaacuacaaaaugcugaaagaaaucaaagaucuaaauaaauggaaagauauaccauguucauggauuggaaaacaacacaguaaacacgucaauucucccaaaauugauacacuggcuuaauugcaauuccuaacaaaaucugagcaggaauuuuuguagauauagacaagauuacucuaaaauguauacggaaaggcaaagaaacuauaauagucaaaacaauuuugaauaaaaagaaguuggaggaaucaagucuauccacuuucaaaacuugcuguaaagcuucauaaccaagacagugugauauugguacaagaguaaacacauaguucaauggaacaggauaaaaaacccagaaacagacucacauaaauaugcccaacuuuugacaaaggugcaaaaguaauucaauggggagagcuaagucuuuucaacaaaugaugcuggaauaaauggauacgcacaggccaaaaaaaaagugaccucaaccuaaacuucacaucuuauacaaaaauuaaagcuggucagagacuuaaauguaaaaacacgaaacuuuaaaaaagaaauuugaggaaaaucuucugaauuuagggcuaggcaaagaguuuccauaaaaggaaaaacuguuaaaucagagcucaugggaguuaaaaaacacuuguucuguaaaagaccacauuaaguagaugaaacaaccagcuacagaguugaaaaaaaaauugcaaacuguauauauccaacaaaggacuaauaucuggaauacacaaaccaugcuuaaaacucaagaguauaaaaaugaacaauccaaugagaaaaugggcagaagaugugaagauuuugcaaauggaaaauaaggacauaaaaagauguucaacaucauuauccaccagggaaaugcaaauuaaaacaauauuaugccccagggaaaugcaaauuaaaaccacaaugaaauaucacuacaccuaucacaacggccaaaauaaaaacuaguggcaacacggcauaccaaagacgcugugacuggaucucucaaagucugcugguggugauauaaaacgguacgacugcuauggaaagugggcugcuucccugcuucuuuccuggaaagaaacaagcaacuaccuggugacccagcacuugcacuucugggcgucugucccagggaaaggaaaaccuauauucacacaaaaaccuauaaaagaauguccauagcagcuuuauugguaauaccucacacuggaaacaagucuuucaacggugaauaaauaaagugugcuguaccuacacccuggaacagcacucagcagcaagaaggaaucagccacagccacaguaacaacauggaugaauguucagagaacaguguugagugaaaagagccaaucccuaaacgauacacaaugcauagccguguuuauacaacacuccugaaaugacaaacucauacaagcggagaagaggguaguggcugccagggguuaaagaggacgugaggcugggaguagggugggccuuggcuauaaagagcagcaugagggaucccuguggggauagaauguucuggauccugacugucgccaugcugguugugaugugcuacagaacuguaagacgugaccacugugaaaacuggguacgggguacauggaucucccuguauuauuuauuaaacagcaugugaauauaagauuacccaaauauaaagcuuaauuuaaaaagcaggcaaacccaggcaagcucuagcccugucuguccccccaugcuccaucacggcucccucccgucuccagacucuacccccgaccaagccugaacuccuggcccagcuguucuccccaugcuggaggaaagagaguggacacucggcacccaguaacaggcacgggggcaagaugagcccgcaccaccuccucuagacccaacaggauguccagccaugagcaaaaugccccacuaguuaacuuuuuaaccuagaaaucaaaccagccagagaaaaguccauguguuuuuuuucuaugugacaagaggcagccaggaaccacaggccagaaccugccuccaccuccccagagcugucucccccacagccuccacggccacaccaggaccaggaccagcuaaggaagggaaagggcuuccucgugaccagcucucuggggaagaacugcuccacccccugcaccaagcccccaugggcccuuagaagcccaccgugagggguccccuccacagggcagcuacaggggagcacacgcacagagucccuaaagagcccucaggcaucugccccuccagcugccaagggcugaacaagaggcagucacagagggauggagguggggcggcaacgguagucaggggcagucagcacccagaggcaggucagaagccaguuccagccuggcuggggccacacagggcccugagggucucccugggacgggcacucccugcccauacaugcuggcagccacugcugucuggggacagagguaacucggggcuccaagaauggggaggaccuccucccgggugcuggagccccuccaaagccagcuggacugcugccagcaccccgcccuggggccaugcauucaacagaagccuucugggcccccuuucugcagaccugagaccagcccggccaccaggaggcuguguccacccaggccgggccuggacacauucacccgugggccuuggagacucaccuguccugagcguucaccccugggcuucggaggcucacccgcccugagcguucaccccugggccucggagacucaccugcccuaagcguucaccccugggccuuggaggcucaucacccugaguguucacgccugggccuuggaggcucaccugcccugaguguucacaccugggccucggaggcucacccgcccugaguguucacaccugggccucagaggcucacccacccugagcguucaccccugggccuuggaggcucaccuguccugagcguucacccccgggccucggagacucaccugcccugaacguucaccccugggcuucggaggcucacccgcccugaguguucaccccugggccucggagacucaccugcccuaagcguucaccccugggccuuggaggcucaucacccugaguguucacgccugggccuuggaggcucaccugcccugaguguucacaccugggccucggaggcucacccgcccugaguguucacaccugggccucagaggcucacccacccugagcguucaccccugggccuuggaggcucaccuguccugagcguucacccccgggccucggagacucaccugcccugaacguucaccccugggcuucggaggcucacccgcccugaguguucaccccugggccucggagacucaccugcccuaagcguucaccccugggccuuggaggcucaucacccugaguguucacgccugggccuuggaggcucaccugcccugaguguucacaccugggccucggaggcucacccacccuaagcguucaccccugggccuuggagacucacccgcccugaguguucacaccugggucggggguguuguacccagagggcucuguggcacagggccacguggccugccagcguggacaggcccuaaugacacucuugggcugaagaaugcauuucgaugagugagcaacagccauccucaccuaacaggcauuugugagccgaaggggaugccugcuauugcccgggccuuacccugagcucuggagucacugaagcugaacagacuccgcacccucagaggaucaggacuaacccugacaguccuccugcccagugagaccugggccccagguggacaaagcccuugucccacccgccaagggcaucugucuagcugcaggcuggggcaguccugaggagccuggaaggaccucucacaccacgcccaccauggcugauuccagcucacucggagacccggccuuggcugggacccucaggaguuaaauguguguuuuccagcucuucucagaagcagcagaggcccgcgagaggugggaaaggggagggcacccgcagaggccugcgcacugacacugcugaguggcucugcucagcucuccuuccugaagaggacaaaggucacguggccuccagccagggcucaaggacaccaaguuccggcagccacaggcagagagcggagacaaggacagcuccgccguggcgagcagaggcucagcugcucccacugaggcccagggccugacggaggcucccgcccacaacaacugagccccgcuagggucucucucacuuccugcucucgcuggccuggugugucccacuggaagccccaggcccgcacccugugcccccagcccacagugggcuccacaucaggcgggcaccaggaggccucaacaauguccccacaaguagcuuccauccccgaggacgcaggccugaaaugggcucaccugcuugcggaccgggaggcccaggccccgcacguccgagacaaugaaagugaugauggucuugacgaugguggcaaagaacguguugaccccgaagaccagggcacagagcucuuuagacagagaagaugcaaucugaaagcugaacgggaagagcgggcagaucaggcgcugcugggagaauaagcagcagccacagggaaaagccugcagcccggcucccaccagcccaugacccgcccggcagccacggggucccagggcacgcacaagccccccaccaggcccccaucucucccacacaugcccgccccugccaggcaggagccagcacccaggccacccucgaggggccauucugggagcugccgugucccccuggcucaguacagagugagggucccuuauccaaaaugccuggggccaguaguuuuggauuugggaauauucacauguccauaaugagaugucuugaggauggaacccaagucuaaacacgaaaugcauuuaugcucauaugcacuguacacacacagccagaaggugauuuuauauaauaccugacaaacauuugcaagccaaagggguugccugcuacugcccagggccucacccugaguucuggaguaauuuugugcaugaagaaacuuuugaccguguucugagacucgucaaacaaggucagguacaggauuuuccaccggguugucuuuccggugcucaaaaacugucagauuuuggaguauuucaaauucuggauuuuuuguuauuuuuuuuuagauggagucucgcucuguugcccaggcgugcaauggcacaaucucagcucacugcaaccucugccuccuggguucaagcaauucuccugucucagccuuucgaguagcugggauuacaggcacgcgccaucaugcccagcuaauuuuuguauuuuuaguagagacagaguuucaccauguuggccaggcuggucucgagcuccuggccucaggugauccacccaccucagccucccaaagugcugggaucacaggugugagccacugcgcccagcugaauucuggcuguuuugauuagggaugcugaaccuauacaaugggugucacaaaacacaaacucgagaagauaccuggaagggcucccaugagcucugggacagaccaggucacgggcgucucaaaacauucagaaaaucaucaucaagagaaccucugggcacagacagaaaagucuagaaugaaagucuuucacgguuaaauguuugauaaauuagaagagcagugaaaccacagagucggugaaugagcagcagccaggcagggcaggcccuggaguugaguggcagcugggcagagcgggcccuggaggugaguagcagcuggguaugcccgggagggcccuggaggugaguggcaauugggggggaggggggccuggaggcggggcaggcccuggaggugaauagcagcuggguaugcccgggcaggcccuggaggugaguggcagcgggcagggugggcccaggaggugagaggcagccaggcagggcaggcccuggaggugaguggcagcagguuaggacgggcccuggaggugaguggcagcgggcagggugggcccuggaggugaguggcagccaggcagggcgggcccuggaggugaguggcagucaguuacugcgggcccuggaggugaguggcagccgggcagggcgggcccuggaggugaguggcagccaguuacugcaggcccuggaggugaguggcagcagggcagggugggcccuggaggugaguggcagccaggcagggcgggcccuggaggugaguggcagucaguuacugcgggcccuggaggugaguggcagccaggcagggcgggcccuggaggugaguggcagucaguuacugcgggcccuggaggugaguggcagcagggcagggugggcccuggaggugaguggcagccaggcagggcgggcccuggaggugagcgguggcaugaacauguccaggaaugaaggcaccacauuccugacauggagaggugacacgccaggcuucuggugcucugcaaagaaacuagucuuccgaugcaguuccaauuaaaaucugcaaagugcuuaaaaaaaaaaaaaaaaaagaacuggacaaaaaauguccuaaaguucaccugaagaaaaaauaaacaaaaaugcccaggaacccuuuggagaagggcagaggugucugugcugcugggcacuggagacggggggacaguggggacaguggaggcucgggggcaggcaggcaggccggcagcagggaggacgagagaagcacacagaggucccggugagcaggucagugggaugaagggcagacgaacaacagggagaacugagcacaaacacgagcuucuggaugccagcgcugggcagggcagagcccaggccagcccccagggugcuuccaaggacacucagaaacacugugaguugaauuaaaggcagacgaguguggggcgugaugggggcacaggugauugaaaauacaugauacagaugaaugcuccccagaucagcagggaggaaagcgagucccaacagagucaggagacacacaggggccacucaguccacagcaggccggccggccucacucugguuaaggaaaggcugggagcccagccggcccgucaggggcucagggaggguggggaggccacuccaccauccugacggggaggaagcccgcaugccggccugcaggguaccugcaauauugacagaaaccugcuuucaaaagcacauacucuccaaccuggccauuccccuuccaggaauccaccugagggucauuauuagaauuuggaaacaaaaauguagguagaagggcauucaucucaguguuuuccucguguaagaaaaauggaaauggugacuuuacccauagacuggggauggguuguaaggcccaccacucaugaccgggagugaccaccugcaucugugagugaccaucugcaucugugucuggcaucaacccaacacagacaagcagaaaaugcugggauuccccguagcaaacagcaguuuucugcuuugcacgcugcggcaccguguuggauuuuuuugcgaugggcaucaaugacuuuauaacuaaaaccuuucaggcguugucccccuggcugcagcaaugggacagcacaauggcagaggcccuggcccuuuccacagugcuggcaggucagugggggggcccaagcaagaucacgcugggccuucacgagccagggacggcaagagcccagugugggccucggggagccuggagaaggcggccacacaggagcagaaggggccccgaguauggcaggggcgggagagaagggugggccgggcugcccaugccgggagacugcugccugcauguggggaggauggggaaguacagggccgggcacauccaggcaggaugcugcaggggugaggccacugacacagagggcccaaugcaagggucaggagggugcucucagcucaaacaggcucgugaccagcauaaggcccagggggaugacccacggagggagggagauagggcucggaggccacccuggaggggaagcccaggaagggguacugagcuggggccaaaguccucccagcgggcaggaaagagggggcagguccagggagcaggacccugugagcacacagggucagugucugagugugucaguguguguggucugaguauguggugggagugugucaaugugugggugucuccaugugugagcguguguccaugugugaacguguccauguguaaacgugugguguguccaugugugaacgugugguguguguccaugugugagcauguguuguguguccgugugguguguguccaucugagcguguagcauguccaugugugcuguguccauguguaagcaugugguguguucaugugagugugguguauccaucugugagugugugguguguccaugugaguguguggugugucugugugguguguguccauguguaagcauauggugcauucaugugaguguggugggugucugugaacauguggugugucccugugaguguguguguguccguguguaguguguguccauggguaagcauguaguguguucaugugagugugguggguguccgugugugugguguguguccauguguaaguaugugaugcauucaugugaguguaguggguguccaucugugagcaugugguguguguucguguguggugugucugugugguguauccaucugugagcgugugguguguucaugugagugugcauuguguguccguguguguguggugcguccauguguaguggguguccaugugugauauauccaugugugaacaugguguguguccgugugugugguguguucaugugcgauauauccaugugugagugugguguguuuguccaugugugcacgugugguauguguucaugaguguguggugaguguccaucugugcgcaugugguguguucaugaguguguguguguccaugugugagcgugugguguguguguggugugagugccuggugugaguguaagcugaggaugaacucacacaggugcaagcucccgcuccugccuggauggggucucagcagcccggggccuagagggugggguugggagcagggcaaggcugugagcccagcaggcuucagagaggagcguggagggccugggggagcagcaagacggcacaggaagggacgcccgaggucccagggagaggcaaguggggacccuggucagcuccagguggcuggcggggccagcaguggcacagccgcuggggcgcagcaggaaggugggagcacccagcgaagcgcggggcuugauccuggcgccugcccgcccccggcuucccacccuucuggaacucacguggcgaugggcacgaggaacugguaggagccgcggaacagcacgaaggccgcauagcacagccagaugcugcucggguggcgcgugugcgccagaaggaagaccagccccgccugcguggccgugacgcccgcgaugagcagcuuggaccagcgcgcccagcggaucuucacgaagcccgcggcgaaggacgugauggcgccugagaggggagggauggggcguugcagcggcccuggggggccacggggcagggggagguagcgggagcuucugaggaaagguauccacggggcagggggcggggacggggagccuccggggaaggauccacggggcagggggagguggcagggagccuccgggggaaggauccacggggcagggggcggggagggggagccuccgggggaaggauccacggggcagggggcggggagggggagccuccgggggaaggauccacggggcagggggagguggcggagagccucugggggaagguauccauggggcagggggcgggagagggagccuccgggggaaggauccacggggcaggcggagguggacgggaagccucugcgggaagaagccucggggaccagggcaugcguacccagcagcguggaggcagcaucugccgcgccguuguagacccgcgcacuguugguggugggguccaccucguuccacaggaugugcacguaguagaccaccagguaguagccggccgaguugaagacccaccagagggaccacaggcgcagcugcggccgccgcaggcugucccccagcucccgcagcauccgcgccagcacugaguccccacaggccacccgcagggcgugucccagcuucccgccugggccaggauucaugcgcuccagcuccgaagccgagguuucgcaccgcccccggucgucgcgguugaagaagaggcugcgcuuggggcgcuucaggaagagggcgaggaccacgcugaaggugaggaaggccagcgagauguaguugagcguggagaaggagacucggcccacagugaccagcagcuggcccagcacggagcuggugaacacgcccagcagcaccgcagcgcgcgaguagccggccacacgcugguagcgcgcgggccgcacgagagagaagauguaggaggaauaggcgaugcgcgcggccauggugacgcuguagaagagcuccaugagcugcaugugcgccaccgaguggcccagcagcagcagcagccacaccgacacgaagcugagccccugcagcagcagcaccggcguguagcgcagguagucggugagcaggaacacgggcaccagcacggccagguaggaguacgacagcaccggcgugaucucguucgugaccugcggacaggcgggcgugcgccccaccagguguuagcaaugcugccgcugcggcagacacagcccgcccgaggugauggcugcugacggcuuccugccccaacacugccuggugggaccccucuccccaacacgccccugucccaugucccacugcaucguccucucugaacagggaccucuggcucccgaccgucccggcagccugggagcguucgccugcggaaagcuggcaguggccacagaaggaaucguuauuaacaagccuguucaucuaagcuucucuauuuuuaucucuuucuugggacagagucuugcucugucgcccaggcuggagugcaguggcacgaucuuagcucauugcaaccuccaccucccagguucaagcaguucuccugccucagccucccgaguagcugagauuacaggugcguaccaccaugucuggcuaauuuuuguauuuuuaguagagauggggguuucaccauguugggcaggcuggucucgaacuccugaccucaggugaucugcccaccuuagccucccaaagugcuaggauuacaggcaccagccaccacacccagccagcuucucuauuuuuaauagaaucaaaacaugguuuuauuucauuuuaaacaauauggaaaacacagcuguaacccauacacauucacaccagcacaagcuucuuccauccuuccuggagagagacaaaaacagaagacacagaaaggaagggcaggaucagggacagcagguucgugggagggacuguucgugggggaacccggcaggggaagaaagacaggaaggggaagaaggggaaagagaggaagugggguagggcagagggcccugggcugugcacucccaucucacacuuguccccagagcaaggucuuuaaggccagacuccaacccaggagcagggaggggggcaaacgccccuguagccgcccugcacccucccaggagggggagcacaggcugucagccugcccacccccaccuccuccaucacauguuaugugggaacccagcuccacagccuuggccacugagcugcugguggacacuccaggccuggcuuccaugccuguggccucaacacacauccaccuuccaugggaacguggagcugggcacggggcugggggugcuaccuccuacaggacaaggucagaggacacugccccagacuacuacaggcaggcaccaaacguccucagcugucuuggcaggggccagggcugcugugggcacaccugggcacaccugggcacaguccagaggaagaggccccaccccugugaggccaagccgcuugccuugccccucccuggggacugaugugggagccacccuaugcuuggagccuccccuggggcccaggugcauuuucagcagguggccccgcccacaggccccaccagaccccaccucagauccacuggagguugguaccagaugagccagcagggcccugcuggacucugggccuccagcaggccccacccgacucaggccugaccaccaguaaccccacagccccacucgugcugccccaggugaccucagccccugccagccacacuuggcaggaccaaacccugggucagcacguggggugcugcgccgagccacgccgccuccccgggggcucucagccucgugucuggcacacccaagauguguggcccgaugugcucagagcccggccaccggcuacugugaacagcugggcaauaggacccugcagccaggccggcaugcugagaagcuucccaggggcucaggggaaggcugcccagagaccccaccucagggcacccugaggucgcacccuggagccugcacccucauggaggccaggcugacccaaaggcuguggucccagcagcaccaggcacccaaggucccuccggcacuccguccugcucaggacauuccgggacacucugagggcagguuaugugccaggaggcugagugagcccgccgggucacagagagccucagggccagccaucggcuucugcacuguguuuacagcaauguccuggggacaucaaacagccccucugugggcaagcucuccuggcugauggccugcucgacugggggaggcuccuccucagggccagcccagggaaccccugcagauuccgaaagaagcggcucagaggcagggguccuccuaggaccucagggacccccgacccccagacacaggaggcugcgugggggcaugacagccccagccccuggccggggcacagguucugcccacagcccagagucaaaaugguagacagccagcagagaggcucuccccagaccccacggcucucuggaaaagggcggccagggguccuagaagccucacccaccuccgaaugaauggagcaugccucauuuccucuuccaccaggagcuggcucugcaggcuggggccucaucaggcaccuccuggucuuaguugagggucugagcgcagagcucccccuuggcagccacccagagcccucccgcuccucucccugcaccuccucaacggccccuacucccucuuccucagccuuggcaggcagacagcagggaggcucugcccagagcugugaccugcgucccacuuacaaggcugcugggggaggggcccucacaacggucccagcagggagguggcaucugucaggcggccacgacucugacacgaggacagccuccugcugccugagcccagcgucggcccugcucuccacaggucuugguugggguccaggcugaaugggcagagugcaggcagcugcgcccaaaucuacguccagacggccucagggcggcuucucugaacagggaggcgggaaggugggcaaggcccgaaggcaggcaggacgcgagggcagggccaggcguggggcagcaggacuggaugccacagaagggcacccaacaggggcuggcuggggacggggcaugggccgcaggucaggagggacugcugugcacaggguccugggccggggggucucccuggaggagggcgggggcugcagcucccaccacacagcacaguuccagcgggggcccaggcaaccucagugcacccaggagcaccucacggacucggccggggaaagcgcucucagcugacacucaaagcagaaacccuggagggaaauuuggccaaauucaaaaugacuccagagaaacaccguauguaacacacaaccaguccaaucccaagggcacgggguccccaggaggcagaaaagggaaccagguccgaggaggacagcaaccacagggcugccaggaaacacuggcccacggcgggagaaauggcggcagagcaaaugugagcaaaggaaaccacgcuccucacagcggccagacggccggcgcucagcagcccacccgagcuggugaggggaacgugggcagcccguggcaggcugcagaggaagcagcauucgccccaggagugaacuggaagugccagcccgggccagcugggucaaggcccacugccugaggcugccagcucgugcucuaccugcagccaucaccugcagugggagaagccggaauccccuaaucaccuccagcaaagcagcagauaagcaccuuguaguucaacccaggaggcgcagcuuaagaacagccucgaacccacguggaacgucucucaagucagauugggcaggagagcaacuugcgaaagcugggucacaagacaccacuuacgugaacuuccuagacacaagccuggcaacaacaggggcuggcgaguccuggcaggcugggccucccuugcccccgaagcugcuccccgcccaccuacugguggcugccccugcaccccggcgcccacgugccugcucccgcgugaaguucuugucgggccccaggagggagggcgugaugaagcucuccccgggccucuccugcagccagaggggcugagaucgggggccccaccaaguggcaggugcgcagagcaccugcacccaucgucccucugaugauauccaaggccugguggaauggcuuaauuucuggaaucuacuuuuuaauccguuaauguacaacaugagagggcaggcagaugggauuuaaacauuuuugcucuagagacuuuucuuauuuuguuauuuuaagggaaacgccacacauaaugcucaccccuauaaauaaccuuggcgguggacaguggcccuccacuaagagcagagaugccaucuggucaguggguggcagggagagggacggacuggccaggagcagaaggcauuucaugaggggucaaggagauggcuccgccgcuccagccccagccccgccaccgacagccggagccagggcaagacccuguccucgccuagaaagugacccagccuggcgguuagcagugcuggccgugggacgagacacaaucacaccgcacggugcucugagcugggcacgcgggaagggcagcaccuccacugucccaauagcacacuccucagcugcacaucaguuucacaauucuagggucugggaggguugggguccggcuuccggccaggagacacagggaacaagaggcaugccgagcgucagccaugugggagcagaggacggggucagcggcugggaugggcaggugagcaggcccagggcccugggauggggugucggggugaccagcugggccggcagccugugagagcgcuuuuccaggcucuuccugugcagaugugccuuauggacaaggaccccacagcuccaggaggaaacugcuucggauacggccgcucccgccuccaccgcucaugugaccugagagacccgugacugggcauaagccuauuagaacaguuucaauaagacccuuuguccucauggcugaguaaaaugaaaauuccuucaauaaucucuuuagguaaauagccacuaagucucuguggaaggcaggugcccagcaggguuggacgugggcuuccucaccaggagggccgaugagcacggccuggcgggugggguggggcaggcucucucucugcaggacacaauaucacuuuuuaucuagccugguuacuaggccgaagccaggccccuccaucugauggugcccgcugcugggagugugagaccccagccggguucccuccaggaccauauuaucagcugacacggccacucacccgcuccagccucaagugcucacacauccaacaggaaaagcgcccuggccccugaagcugcuccccgcccacccauaggcggccgcccuggcacccagcacccacgugccuauuccagaagcugcuccccgcccacccacaggcggccgcccagcaccccggugcccacaugccuauuccagaagcugcuccccgcccacccacaggcggccgcccggcaccccggcacccacgugccuauuccagaagcugcuccccgcccacccacaggcagccgcccuggcacccagcgcccacgugccuauuccagaagcugcucccugcccacccacuggcggccgcccccgcaucccggcgcccacgugccuauuccagacgcugcuccccgcccacccacccacaggcggccgcccggcaccccggcacccacaugccugcucccgcgugaaguucuugucgggccccaggagguagggggugaugaagcucuccccuggccguaucugcgccaugaagccguagaagcaaagguagcacacgaggugccgccaggaccggagcucggggucaggcccagguuccacgggcaccugcuucuccaccgcugggcuggagggcaccauccugcucaggccacgugcagcuccggaggggacgaaggugacgcugugccuggaaggagggguggagucagggcaccuuggaagauggucugcaggccucccuaccccgcaaaacgaggcccagugccggccuccucgccacucaggaccaaacgccacccuggagacgaaugcagaccccagacccauccucaccccguagcaccaaacugggagccacccacaccugagcugcuccggagucccccaggccaggcugucaccaccuccagggucuccgaggcugagggaagucuccagccacauggagugauuuaagugccaaucaaaaccaaguuaauuaacuaauugacuuacuuuauuaacuaaacuaacaaaauuuaggguuuggggccacacuagacucauggcacugcugggcaguaccuguggcggucagggggcacaccucaccccacaggccugagggcagcccacgugccugcugcugcucuagcggcacccagguggcccagggagggcacaggcaggaacggacgcugcuggaggccggggucacaccacagguggccagcggcggguggcugcagguaccagccucagguccccaucagccgcgugcccuggcaggagggcgugcaggccaagcccacagugagggaagggcagagggaaaagcagguguccuugagggggcugagagcagccaggguugaaacacgcgugggagggaggaugggauggagccgaggcccagccccugagcccagggaccccagcauccccggcggcagguuacccuagacgaaagcagcuggcaggagccaugaguggaccugacacguuccagauggagcaccccagaccacaggacuucauccacgaggcaacaugcacccaaccuuggggaccaucccgccagcacccccgccccacacggccagggcacgugguggagcagcagcagcacgaagcacacucgagggcgugucucuuucaguccugauucugcccaggagaaaggcuccuccggugcgggcaagggcacgucucaccaccacaaaucgugccuuucagcugcggggcaaaagccuguccacuuaucagaaucaugucuccaggugccacguggcccugguuuuccauuaaggccucgguguaaaguucuccuucaaguaagucaaaagugaacugccauaaacaagugugucagacgcccacaccaagccaaccccgugaggccaggaccuggcccuggucccccacaggugcaccucacgucuguaucagcugaccucugcucccggaggccaggccuggcagagugcacguggaaaggccaucugcugcucaggugggguggggaugcagcgcaugcagagggcagcugagcagccuuguggggcggggucgccgucccaucugcacugggcugacaguuggacaauugugccucgccacagggccggcuugggaggguggcagggggucugcagagggucuggauuugagaagucuccuccaacccuccagcaggggcucagagcaucccucgauguggggccagcuuuggggguccagggaccccuaggaaaaucugccccaggcucucagcauucagucuucacguaucagagaccacucaggcuggaagugcucccugaaccgcccccaaccugacacacaggcuuaggaaaaagguggccuucagggaccagagagagagacccuccccaggccacuuaggcaaagccaucagcaucaucuggggucccgucuugacaccucuacacacucaugucugugacaaaggaacauaggugauggcagggaagcccuuaagaggcagaggcuggugggcuugcaaugggggccgcagggaagagggggaaggguuaggggaaccucgagguuuccggagcuccacggcagggcacagcugggaagaagaugggaccagcacccuccauuggaggcagccaggacccuagaaguucucaaagggccaggaugaaaacagccggccaggcaggaggaagcgcaggcaggggccacugccaggccgaggcagaucugacggucgccugccucggccucaccuuccaugccuccucagggccugucaacagcugggaagaucagugcacaaagguugggcuccaucaccagggacccugaugcccagagaggccacggguagagcuggacauaccucagaccgcacccacuccuccccacugggagacccauuuggcccugggacucccugucaaguucacuuucccaccugucagcagguuuagacaggcgcaccgauccccagacaaccagagcaaccagaucgccgcagacaacggggagccaucaggagcugaacuaagcccagggucugcgcccacaguccauggccgcaggagucagauccccacccacaggacccccaggggcccgggagcccuggguacuugggcccccuguucugaaaggugccaccuccagaagcgaccagaacauuccuuccuuggagagacagccagagucuccgccagcaaggggcugcugcuggucuuaacagucagccucugcugccagcauacucaacuuaugugccgugaacguagcccacugacagaggcuuggccaucacggcccagaccaccuccaagaggaaagauagggaacuuggucaccaucauagaaacgcagccccaagccaggggacgccuagacuccaaguguccagaccccagcccagucccauacagcuugaggccucuucccggcaucugaaggaaguccccgaccagacaggagggccacggggaagcagagagaaucccugccuucaggagaagguuguaacagccccugcaaauccccggccccacuguccacagugaccagccccacccaggcccuguccuuccaagcaccagagaaggccagagacccgcaaucaaaacacaagcaaacgccaccuaucauuccguguuuaaaccagcuccuacucuggaaggcuaaccaagaauguucguuauguuuuuuagaacgccugcuaguuuaaaaagaagaagaagaaagcauugcacacccucccaccccuguucagaugaccaaguucaggguuccuaacagcauaauuagacccuccggcuaucacugcugcaggcccaaacacccgagaagcacucuuucucaucuguguccagcagagauaacuguacuaucuggaauuauaaaaauccaccaaagccccuucggaaagaaagcaauuagcaauugcaacaagcagugcacagguggcacccaggcaaaggcggccagugagaugcagccuggcucccaggccuggacagggcaggcaggugcacugggccagaggcaccucggcucugcugauugaaucugggcugugcggggauccucgggucuccguagggggaggccaccucuuuacagggcggccaacaggcgccuccaaggacuuuaucccaccuucccucuggaugcauucuggauuucggggccagcuuaguuggccuguguccugaggccaggcaggccagacuccccaggacaggaguuuccgauggacaggacccuagggggauggcuuuccugcuguagcgguguuggaaggacccacucgggaaaggcuccagcggcuguccaggcucucucugagacgccucgggauugcuccgcuggauccgcacccacagcugcuccaaggggaaguugcaccuacaaagcuucuggcacaggagacaauggucuggagaugugccaggggcccgccccacgcguggcuggcaggguucacccaccggcuggcccgucccgaagcaacacgugccugggcgcgaacgccggauccacgcuuuccuccagacccgggggugggacuuggcgccccaggaugacgcggagggcaggcugggggccgggacuccccaccccauucgcaggcugcggcggaaagcgagcggcgggaaacccgcugcacagcaacgguucugccaggcgcccgggccaccgcgacccccgcggagaccccggcccacgccccgcacccuccccagggccccccagaccccaggcugcagaccgcagaccccggccacgccccgcacccuccccagggccccccagaccccaggcugcagaccgcagaccccggcccacgccccgcacccuccccagggccccgcggaccccaggcugcagaccgcagaccccggcccacgccccgcacccuccccagggccccgcggaccccagcgccagcccccacacucaccucacagggcccugcaaaccucggcccgcgccccgcacucaccccagggccccgagacaccccgcagcccccgacacgcggccccguggccccguuccccaccgguaccugcgacucggcggggcggcugcccuggggcucccggacccggccccgcgcacgcggacuccgggacuacagcgcccacaaggcggcgcggcgggcgcgcggcugcggggugggcggguccgucccgccgaacgcguccugagggcggggccucgcgcguggccgggcgcugcggcaggagcguccccacggggcacccucccacccacggccgucucccagccccggcgccggccucuccccacccggucaccgccggggucacgcggccccucgugcugcggcccuaccccuggggccgcccccugaccccgaccgccccucgggcccccacccccgccggcgucagcauccuggggugccacucgcggaggugucggucccucgggcgggcacccugccaucccucucccccgcguucuucccacccccgguccccuccugacccccccuccucgacgaggccuugugc

SEQ ID NO: 16300 - RNA, 7503 nt, Homo sapiens
cugacugaagcacgaagagcuuuacugagggcucacagaagggccgagagacaacagaaacagacaccggcacaggcugggccagcagcauggcccgcucacaccugccucuccagguuacacaguucaggauccaaguccugugcaaaugcaucugacuggcgaacagaaaucccaucaagaacagcugcagggagacuggggucacgguuuucagcuccuggccacugcgguccaggaaggccagccagaccaggccuaagccaaucccccacauccuccaugaggggaccugccaagagcguccaggacuccgcgccgcccuccgugcuaugugcuguggggccagcugccucccagccauggaccacaccugcucagaguuccuuagaagccgggcuccuugccuugcugccuuggcucuggugaccucugcauuuugcagacacccgggaggagcugcccaagacggcagccccacuccagacccugucugaugggccgugcacgucugcacauuccacagaaugugaccagcuguggagcucaauacaaaauggcccucugcuggccgggcccugacuucagccuggacacucguccccauguccugcccagaugaucacugggcagagccggagauuccuggcugcuuugguuaugaaacacauguccagguuuagcccaaccucauaugcaguuuacacucucaucuacccucccuguaggcaaggcugggggccccaggcucuguggcgggaggugguccccgguuccccuccugccagcagccccugcagaggaggccgggggucucucagggccagauuccacuuccccagggcccuucaugagaggagccuccucacucacccacagcugccagcacaacccacuccccacugccugucacgcaacccccggcaggcccacgccccgcacccauagccuccagccagcuccuguggggccugcgccgugagugggccugggagucucccuggccucaguggccuuccugccccagggggccccaccccaccagggaugguccuguggaucaggauggcucugcugguggcuauaccagcucugggcccaucccccacugcuggaccccaccccgcacaaggaagccucugggcaggcaucuggggcuccaaagcccaacaggaaaccagcagggagagggcccggccugggcuccucuccuaggguuaggaguuagcuuuagaguuggaguuagggcuggguuggguuagguuaaggguuaguaucaggguuagggugaggauugggucagggguuagcaucaggguuagggugagaguugagucagggguuagcaucaggguuaggauugggucgggucagggguuagcauuaggguuagggcgaggauuggguuagggugggggaugguuuagggguuagcauuagaguuaggguuggguugggguucaggcucugccucccaugaugcccagguagguucccggggugaaaguggugaaugggcggcaucaggaagcuaagcccugcccauccagucuggcuggaagauucuggcuccccgguggcccaggagucacagaauacccccaauuuccuauccccucccccugccuugucucgcaaggccgagaccuccaccauguccacacugugaacugagacauucccuuuguccccgccucaccgcuaucaacacugguggccuggcugguguggggcugagcccacggccucugcagaugugggaaacucuugcaaucagugcagcauggaggcagaggggcugauuuggccugggcaucccaacgggcagcaggucccagggugcacaugcucacaucugggcugcaaagaacugagucacagggagaggcggggugcucuggggcaggcagcgaugucaucucaggggugcuccgccaccccuccuuccgcaaguguccaucaugggcuccaggccccgccaguaaagaggucacaagaugggagaggaggggacggcagagaaaggaaguggagggaagggcaagggaggggaggacauuagagggcaggaaggggagggcuguaccccgggagcgcugaggacuugcaagcacccacggugggagcuccagugagcaugaaggagcuuuggggucccacaguguuggggucucuauggucuuccuuagaggggaggugcuuucaccuauguugguggggcagggggcacaguaaggccaggacggugggcagcucauggaccugacugagcucacagugcaggggacagggccuccgguguccuccugguccucuccccaucuccuccucccagcaggagguggacaggggcccagcagaccuucaccaaggagaaggccagacccugggcugaggcagcccagcaaauuggggcagggagggacgggccugccccugcccugugcaccuccugaagggccacgucugggugauguccagugucugggcugauucuaggguaaggacaaaugaagaguccccuggcagcagggaaagggcaccccaaaaugcgagaugggacuggcuggcacccacaggacacagggcugaggagaggcccugccuucaccacccaggccucaguucacacucuccuugggaccuggggucaugcgugcugggcaaacccaccacaggcacccuggcauggagaagggguggcaggaggacgccaaucaccaugugacccuaggccugcuggccaggccagcaacaguucaccugcccuaccugcaucuaucagacagccagggauggcaccagucauucaccuauacauccuuauccuaugcuuucagccacguguccucuggaaggaaauccccacgggcccagggcacucugcugugucagcgcccacuuccuccaaacaguggagcuggacaccccgccacaugcuggcccugccuggaccacaaggaccacguggccccacaccagcacgggugcacccccgggggcuggcacuugguucuagcucucacuggaagggugaguggcgcugccaguuuccguggaggucucuguccuccgagcauggcgacacucaggcagcguggcgugagggaagcaggcggagccuggggcugccuccacucauacacugggccuggccccucacccaccccgcgucugcacugugggcagagcaaagccuaccaagcaccucacaacacagacacccccgugacucacacugcacacacgggguaccucagaaccagugcacacacccuggacaggcucucaccuuccaagucaccugauacuuuccaaagagaaaccacccucaacuuccauucauuuuuaagcaucuguuuggcgaagcaucucuacauaccuacacuucaguccacacacaauguacacugaucacucauuuacaccccccccaaaaauacucaaaguacuuuaaaauauaaacacucauaaaaaggacaauaaaaaauaaaauuaggaauuacuaucauauagguggagguaacaucuaaccugaaugugaaguaagguuaguaaauugagcacuaaauuaucucugagauuccuggcagcaaaggugaaaagagagaguuccuguugcuggagaaaacgaagcaucccauugauuggccuugaaacaucaauccccaguacuccgggccuuggaaaaagagcuguuuuauaucuuagugaguagaaaaagcaaggcacagggccgggcgcgguggcugacgccuguaaucccagcacuuugggaggcugaggcgggcggaucacuugaggccaacaguucgagaccagccuggccaacauggugaaacccggucucuacuaaaaauacaaaaauuagccaggcgugguggcucaugccuguaauuccagcuacuagggaggcugaggcagcagaagugauugagccugggaggcaaagguugcagugagcugagaucgcccuggggcagggccucccgcaucaggcacacccagaggggcaggaagcaggcgggcccccagguauguggcugcugucuuccccugggcaagcuacccuggacuuuucccaggucucucuccauauuguucaccccauuacugaacugaaauuuuggcacuacgguuacucaaaacaaacauuugagaauaaaaaaggguaggacaguuuguuugagcuacacaucccacuuagcucucuagaaaaaccuggucucuguuacuuugcucuggaaacagggcuuacguuccaauguacuucgaacacuggaacaaggcucauguuuaccuacaaugcacuuuguaaguaaacaagggcaagucagcuccucagcacaggacuuaucagcgccuucagcgggugaaccugcacccaagcucccucuggugaacccucucgcuugcagagcacccccuuaguccucugagugcauauccacagccugcagggccccgugugggagaggcuggcaugguggaaggaggcggaaugucacgauggacagcccggguugaaguuccacugggauaauuuccugaugguaucgucacgggcagucauuccguuccucuaagcuucagguuccucauccgucacacggauguguggcaaaaccacccagccuggaggugcugcugugccugagugcaacaguggggagcacacauggcugugacaccugccucagggaagagcaaaagcagcaucagucaccaccuacuacaaaagugacagcagccaccggcgggggucugccggaacaggcgcuagggccccgggccgaugggguccuuggaggcgggggcgcugggcagagacuucagguacuccaggugccuccgggcauccuccugguuguggcgcacauaguacacgacguaggcgaucaccauggcgaaccagccgaacauggugaccagcauggccacgucugugguccugugggggacgcugcagaggcuggcacccgcauccagagccugaaccagaggcuuccccacaaacuccuccugcacugagguguggcaggcgaucucguccacagagucgggguccagcuucagcucccacagggccuccugcagggcgcacucgcagugcaggggguugugggacaggcguaucuuggcgcugaguuugcccagggcguccuuggggauccucuggaugcgguuguaagacagguccagcagccgcaggcccccggccaggcccgcgaagguggcggagccgauggccucgauggcguugugagacagauccagcucccugagccggugcaggugcuggaaggccccguccgggaggugggagaucuuguuggcaucgagcuucaggagcacgguguuggccgggauguccucggggaccuccugaaggccccgcaagcugcagaagacagccacagccccugcguggucagggcaccggcagggcugugggcaggcggcgcccaggugcaggcagaagaggaggaagagacaagacucccggguggagaccagcaggagcgaggggcgaggugggcgcacggugcccauccugaccugaccuggggacggggacacgcgagccucugcuagggccuggggauggagcugguuuccgcaggcaaggccuuauccaaccagacaugaaaccgccauccugccccgcugggagaagcagugcaguccacucuggcagcucugaaagggaagacgcaggagggagcggagagggagggaggguggucagcacugccggcugcggucaccugggaaacgcguccacugguggggaggguguugagggcccacugaagggucugggguggggagcacgccuccuuaaacagcucugccuguaacuuacuucuggagacucccaaugcgcccgggaggagcgucccacaagugcagggagcuggcacugccagggggcuccgcauggcccaguggguggucacugcggccaccccuggccaccuacagcaccgcuggggaccaaaggccgggcggcggaguggcggcggcuuggaccacccagccccucccuccucaggguggacgccaggaggacggugacggcugcagcuucucccgaaccuggagcgcgggucaagcugggcacguggccgggcaccagcgggcgcucgcgcgccaggggcuacuccagcagccaacgccuggcugacuccgacaaccccuaaaaacugucauaacccagcaagcccuucccugccagcccuaaaggagccgcggcucgcaccgggcacagaaccgcgccuuuucuuucaacugccugaagaaggaaaccgagaaaacagagaagccaagcccugugcgcgcggcccgcgcugggcguggacggcggggccgcgcgcggagccggccgggagaggcucggacccccaggaccuccagccuuuagacccuccggcccuaggacccccggaaccugggacccccgagaccccagcacucgcggcggggggauggucauggggugggugggaauccacgcucccagggcugggcgggggcuuuaccugcgcggcggcggccggaggcugcucugcgcgccgcucccgggccucucggagcccgccagacccagcuccacgccuggcgcggcggccaccccgcugccccugcgaccgcgcccgcgaccacuagcuggggaggccgcgacuccggccugcgcgggcgaggggcgggguggggcggggccuggagggggcggggcgaaaggcggagacaggcugugucgauuccccgcgggggcggggaaggggcggggcauguaaggagaccggaacgggauuugugguuaggcgggggcggggcuugagggcggguucugcggcagggcggggccuggaagagaugggggaggggcaugggaggggcaugggaggggccgguggugcggcuuuagauggagcugguacuaagacccaggucgcaggggcugugggcggguugugggaguaauuguggcaugcugggggcgugguuguggggcugaggacgagguggugggggcugagggcgugguuaugggugggggcggggucugcgcgccgggaggggcuguggguccagccccugccccucacucugggcaaauccccucuucccucuggcaucaggacuucuggggcuugaagacccugggucugcgggaagccccugcugagcgucccucgccuaccccguggccagugggugaguagggcuagaucuccgcccaucuagguccccuucugcuccagcuccagcgucugacaucccaaggaaggaacgcagggugggggcauuugagccggaccugagccauccucaugguuuucaaaaaguagccuuauugugguguaauugacagacgguaagccacauauuucaauuugguacguuuuaacacucggauacuccugugaaaccaucaccacaaucagcauagugaacaccccggguucccucuuggucaucucucccugcccucccuca

SEQ ID NO: 16301 - RNA, 27114 nt, Homo sapiens
ccgggggcgggcccggggcggggcgggcggaaggcgcgcgcggggcggggcggggacggcgacgcggcgcaggcggcgggagugcgagcugggcccguguuucggccgccgccauggccgcgguggaccuggagaagcugcgggcgucgggcgcgggcaaggccaucggcguccugaccagcggcggcgacgcgcaaggugggcgggggucccggccgcgucgcggcgcaggggguggagggcgccuccgcccuggccucuccggagcgcccgccgagccccgggacccgggucucgggccggcccggccucccgccccggccucccgccccggccuccugccccgggucugucccccgcucuuccccggcgcggucuccggccuacgugcggccggccacguucucggccuccgccugggucuuggcgccgcccgcgcccugccccggggguguguccgacucugggccgcggggcaggaccucccgaggaguccccgaggccacgcgagcggagggcgccggucccgccacccccagagccuggcccuuccugguucugaagcgacccggggacccggugccucccgagggccggcgccaggcugcgggcuuccgggaccuccucccggcugggcgggggcggacucacucccggaccgcgccuccuccucggggcccucgcggccgccuuccuugugggucuagcuggggaagagggcgguggggagaugggcugcccggggcauugagcaaagcccaguugucacccuuuucgcagggguacuggggaggccucaggugguggggacugggacuuggcagagcuggguggggguccggccugagggcgugguguccucgcacgcucccucccggaggccugguccugcccacugccggccuccagugucucuggccugacauguccaguguggcaccuguggcacaggacgccaccuacccuaccccucaggaggagagaggagaggauuuaggagaccagaagugaggugcuggguugggaaggggcccagccagcaccccaaggcugugcagcggggucuggucugucuuuuagaguucagaaaaugguugagaaaaugcggacacacacccccacccagcuucaggcaccugacccuccuuuucccuaucuggaagccaggaagaggcgagaaggaagccggccuugagugggaccaagccagggaggcaggaguggcucgugggugucacugucugaaccccggccugcagagggggcuccuucagaccuggcugagccaggccugugguggcugcccacccgcccuuuucacagcuguggcaagagcgggagcugcugcuuguugccggcuacuggcaguguccuggagccaguguggcuccacaaguccuguccuguguggcucugggucacgccuuuccugugggccagggguccguguugucgagaggggagggcguuguucaaggaugucuuuuugcacaauaaccugugcaaagguagcuagaagacuugaagcaggccgggugcgguggcucacaccuguaauuccagcacuuuggguggccugguggguugugggcccaggugggagaggaggcccguggccuuggagggugaacucgggaagcuccaucccaugagauuagacaagaaaggccccgagucuggagggcagacagguugcuguggggccagcccgccugcccaccagggaggcgcuuucuuggugaggcuggugaagccccaaagcccaccugugguucccugaaacacagaggguccccaaccagcuuccuuguuugcaaagugggagcaucagcaguggaggguugggaaaguugagagccugggguggcacgugccccccccacccccugccaccccaugcacagacuaaacagagaaggggggcucgcuggagguugcugaagggccagccuggcaggugguucuugggccagcggggaggggcacccagggugacaggcgguucuggaugcugguggaggaucuggagaugggaugccccuccuggcccuguggacaggccggcugggugggccucccaucucugucugagcuggggguuccaacugcucagccuggccccagugccugauauggagugggcagcgcuuccuggcugcagcugggagggugcccacagugcaccugcuggccgaucauggcaucccaguugggccugugccuuccucugcaaauguccucccuucccaagccccgugcagcugcagcgucucuguaugugagcucccaugcguggacagggaacaggugguuuucugcaagggaggaggacuccacacacuuccccaguucagggcuggggcugauucauggaggaugaucuggggcgaguaggaugggaggaacugacauucugggcagaaccagaguccuguuucaugaguucggaaaagcagucugcagggcucucccaggccaccacugcugcugccguguggcuccccauggugggugcucuguuuuccuucucggggccccacugccuuccuagaaaggcugacccuggccgaggggaagccuguggcauagugugcccuucucuuugcccucuaugucagccgggcagcaggagaguggggacugggaggcacuuucugccccaaugcugaagucugcguuuguuggauguauggaacagccagccucaccauccugccaguguugcccaguccugggacuucucgggccuugauuuccccuucugugaaaggggguuggggacaagacaggccaccuugcaaguuccuuccagccagcccacaaguccuguccuguguggcucugggucacgccuuuccuguuggccagggguuggugcuguugagcaggggagggcguuguucaaggauaucuauuugcacaauaaccugugcaaagguagcuagaagacuugaaacaggccgggcgcgguggcucacgccuguaauuccagcacuuugggaggcugaggcugguggaucaccugagguuaggaguucaagaccauccuggcuaacauggugaaaccucgucucuacuaaaaauacaaaaaauuagcugggcaugguggugcgcaucuguaaucccagcuacucaggaggcugaggcaggagaaucgcuugaaccaggaggugcagguugcagugagccgagaucgagccacggcacucuagccugggcgacagagcgagacucuguugcaaaaaacaaacaagaaaaaaccccaaaaaucagccaggcguggugguacaugccuguagucccagcuacucgggaggcagaggcaggagaaucgcuugaaccggggaggcagagguugcagugagccaagaucccgccacugcacuccagccugggugacagaacgagacucugucucaaaaaaaaaaaacagacuugaccaaaaaaaaaaaaaaaaaaaaaauggcccggccugccuaugccuaccuucaucucgcccuggccugggcacuuuuaauucucugggcccuuugucuagugcccccucccugccccugcaggacaccgugcccugccuuucccuggcugguguguuuggacguugguuuccuguuaucgcaggugaggacuuagcuuccuggcccgccacgccucccugacauggccuccuguuuggagccuucaggcucaugcuuacauccuuagcugaucauuaaacuuugugaccauuucaugcucacugcuuucuugccugggagcuaauggugaggaaaggucacugggaaccagcgcaccaaccucagacauugauuuuguuccagccuuuuuuccugggcagggguggcuaucaccugcugguaggcagcggcaggcccacuguccugccugcccucugacugcggugucggcgacugcugcccgagguuuauuuugagaaagaaaagccgauuaaagggccauuaaaaaggucuuuugaagauuacagcuuccaaugagguuaacagagaaaauuuccuccuucaggccgcagccagucccguucuaaaauccagaacgugucccuuuccagucccguucuaaaauccagucccaacaacaaaguggccaugugacauggccacuuuguucuccucccaagggcucagcacaaagcuggguuuuggcagcuucauugucuccgggcgucaaagcagguuuuauuuugcagagcacccugaagacauuuggaagugagggguacccuugcugaccccugauccuggggccccuuugccguucccagguccccugacaagcccaccaggcccccugcugagauggcugugacccugggcugacccgcccaguggcacauugacuccgccuggagcuggggagaccagagaggcccugugguuggacgguggccugggugcgcugcuccugcccucuccuugcccugccucagcugcugccugccagaggugggcuuggaccuguggugggaccaggucugcagggagggcgagggagggacggaggcuuagcuucggccagcuguggcugaguggaucucccucacugcccccaacuccagugagggugggggacagggcgcugcacucacagcaccaccuuggacgcccagccucaggcagcaggacuuggcucugcugacuguuuuugguugucgggugcuugggguggcucagcugucuggggggggcucggcugucugucucggggggcuuggcugucugcggggggcucggcugucuggggggcucggcugucuuucugggggagcuugucugucugucuggggggcuuggcuuucugggugugugugggaugcuugcuggguucccgccccaguuucagcuguagcagccgugcucccaucuauguggggaugugagggaggcacuguuccuuuagagacggcguugcuugcucaaguggagaagcugccagugugggcagcuccagcucccugcacgcucugugcucugcccauucuaacgucugugccccuucuucuggauggcugccgggcuuggcucuggccccccuguuggauccccuggcugcuggguggggagagggccaccuacugaaccugagggugggucugggugaguccuggcucugcugccaccugcugggcucuggaaggucccucacccucccucugggaucucauuggauuccuguaguguggggaugguggcagauacucuggcugcuacgugagaacagugugccgaucccugggguuucucaaggcguggcaccucaccucacaccugcucccugcugcugagccccacgccaagcuggagagcggaugagaagcauguguaaccaggguagaggucgagaguccucucgugggggucuccauguucaagggagcugccgaggcuugagcaggagcccccagcaggucagcaccuccagccucugcaaguacaggggggugggagggcaggggcuuuugaggggcacgaggcuuggggacagaggacccgcauggcuuagggauggauggcaugguaugggugcugggagggaggcaggaagagcagggcuggucccaggggcaagcacaaacucaggccuguuacacggccccagaccucacucagaaggggacccuggccgcuggcguggguuuccuccucucugaagauuagguggucuuggcugccccuuuuguaugaagucauggauaucuuuugagaugggggcucucgggaagaaggugugggguacauuagcaccagcguuuccugagugccgccucccccguuaaugucccucuccaggaaacuggcuuugccaaggcccccgcugggacagacuguuucuuucacugcaguccugggagccgagggcaaggggacaggaaagaggaagugaccucagagccugguggcaccagcaucauguccaggcuggggggugagggucccugaggcccuggggcagggcagugcuguucccuggguggcugaggccggaggggcucuguucucagucccccaucucauugcggaggaaggagcccaagccccuuccagcaggugcuuuccucagugcccagaggugcuccccggcuucuccauccccacgccgcagccugaaugucugggguggggccggugugggaggugccggccucuuuuccaccugccccacuuuuuauccugcucuguggucaaggccuggccccguggccugugagugugggggcuccguggcagagguuggggcggcgggguguggaguucgggacacccacacaugccugauugccaugcucugcaugggauguucccaguuuaucucugggcaccauacuccaggugcucggaagcugaagccuagagccugcuggguucacccgagccuccacccgggggcccagggcugguccucaaguuuccuggccuggugccuccugagauggggagggugaccaggccuucccuacccccugcccucugagauggggagggcguccgggccuucccugacccuugcccucuugagaugaggagggugaccagggccuucccccaccacccgcccucugagauggacaggguguccaggccuccccuacccccuguccucugagauggggaggguguccagggccuugcuucucagcgugggacugacagguuugcccugaccuccacaggcaugaacgcugcuguccgggcugugacgcgcaugggcauuuaugugggugccaaagucuuccucaucuacgagguaaggccaaggugggcugugugugugcagggaguggggaccuccugaggcgcaugccgagguguguucugugugggucacacugggagacggggugguccuggccuggaggagcugauggguauguggucuuggggagugugagggggagcuuggggccaggccaaaggcaucugcagaaagaagaccuacugccuugggacucagcccggcuggaggcucagaggcugcagagcacgggccugggggcagggaaggagcuggguggacaaggagucgaggcccugccuacagugaucgcugacgggccaggccccacccaccacaccccugccuggugucccccagccuggcccuugucccgccccgaggccucugugagugggggccagggaccucaccgccucugcccuuguccuccccagccuccugccucaccacccagacccggggggcagccgcuggcagcagcucugcugugucuauguucauuguguccccgcaggagcagcggaugcccuacugccucagccccaguccccgugggagauuuggggcucgcccuccguccuggguauuuacacacccacacuugcgcucacacaugugcacacacaggcgcauucacacacuugggccacaccacgcacucacaggcugcauucuugccuugucaggugguuuuccacauuccacaagacaaggucuuuuguuauuuuguugccacuuuuuauguaauauguagcuguuuauauaaaauguagcaaccccagcucugcagccccaggcacucagccccaccccccucacugcucacugcucgcugcugaccacucaccgcccugggucucaguucccccaucuuggccccagggaacagcagccuguccagcccucccucugcaggacugugugaaugaaugagugagugggcagucugugcuggcccguccucucccuguggccaggcuggggcccugccaguauuggauuaggaagcaggucucagagcccuggggagcugggugugggggccucucuaggcaggcugggcuguguccguacaaaccccuccugccaccugcucgaccuucaguuucuucuucuaaguggcaaaggggagaaauuaggguuuuccggaacccccacacauuugugguugggaaagacuccuguggcaaaagacagaaaacagguucaucggugcagggcguguccuggaaaaggggagaagaggcacuuugccgugccuagaguccuggcuucugcagagcccagcagagaccagugcacauggagaagccgagggguacagggacgcagcgugaggcccucggaggugggggaaugcaggagggugaguuuaugggaaaaagaaugaagugggugggcgcggguccuggggcugucucuggguccugagggcugugaggggcauuuacauccuguccaggcgguaacaggaggagccuuagucuugggaugcugugugcugcuuuccucucaaagggaggcaaggcugagagcuucccugaaucugcugccuagugggcuuuagcucagaaacauccacaucuaagaggcagauuuugagaugagacauucugauauagcggcccagggaagacuuccccuccgucccaugaagguucuuggaagaauccacuugcgaaaagcggauuaauagggcagaggugcuggcauucauugugaauaggcauggagagguagggcgaagaugcugaccugcccuccucccagggaaaggggcaugggcagccuggaugauucuagggggguaggaauuuuuuuuuuuuuuuuuuuugagacagagucucauucuguugcccaggcuggagcgcaguggcacaaucuuggcucgcugcaaccucugccucccagguucaagcaauuuuccugccucagccuccugaguagcugggauuacaggcacccaccaccacgcccagcuguuuuuuguauuuuuaguagagacgggguuucaccauguuggccagccuggucucgaacuccuggccucuggugauccacccgccucugcuucccaaagugcugggauuacaggcgcgagccacugugcacggccaugaaugguuuuuaggggauucaaugggcuuggacagcaucuguuagcccuggugaccaccugcccaaguguguuggcagacacaggucuuucuuccuacgaugaccucagugcauggaaacucagggaggggacuggccgucacuguuccuuucuccagcagcuaugggcuuuaggcagauucgggggcuucagggagcagcugcauccugagcuuggaggaggcagagggucgagaggcagaagggggaggucagggagaccugcggcugcgucaguucacaucagacugcauuuuggguuucugagcccccagcgcuggcuuccuucagcagggagaccgaucccuucuccuuggggcuauuguuagggcagaaagggaggguggccuuggaggugaaaacccuucucaguucugacacaaaggagggcucagaacaggcuacucuuauccccccaggcagagcccacagcauagcagggagggcccugagccuggguccaggccugcaggggugagaggagggggcggggcuagaggggaaggaggggaaggugagcugggccuaggaggacagagacggaaacagaguggguagaggggggcaaacagcuucuagaagauuccaaggguaggaggagguugugucugugagacugauuccagcagaacugagccacuggccuuguggggucucuggggacugcugggcuggccauaccugccugccccuccgcccaguggggcaggggccuggcuggcgccugggcucuguauuggauccugaguuuugcagacagaccuguguuugguggccuccugcucagguggggcuguggguuugggaucauuuuccuguuuuccuuguuccuagcucagggcugguacaaccagagggggccaggcuggccuggccugagccggaggaaguagcucuguggucccucagaucagccccugagauggggcaggggcaccugucccccagcccagcugguggggaagggaggcugucaggcuagaagcccgccauggccagaguggggauguucaugcgccccgcagcgcgcacuaucccuugacccccugccugcuugaggcacuugcccuccuggcccccagggcccugacaccugguuggggagaaggcggagggaggagcagaagcccacagcugagcuggcauccgcccuggccgaggaauggcugcuccacugccucaccucacggccuggagaaggcugcugaugccauggagggaccggggcugcacggaggaggccgcccuucuccucuccacacccuuagugaaaugcagucaugagugucccuccccucaaacaacaagaaagggcuggccgugcaguaggaaacgggcacguggcacggaggcugugcaggugccaucugggaaaucccagguagaaccgcaugagaggcagauccacgguacuggauggaaggcccaguguggccggcguggcgggacgcggagccuggagccccugccugggguguugccggcccuacgagcgauggccacucggguccccuggacccaggagcucccucgggugggggcccgccuguagggagguguguguguucucagcuucccgcucuggcgggcagaugguagccugggcuguucacacggccgccacacagcaagagcacgcgccgcacaccccgccggccgcaugccugggaggacuccaguggggacagaaggagccacgcacagcagccucuguggugucauuucuaggauguucagaacaggcagaccuaggaugcacccucaggagcuggauggcgggcuccgcuggggccuucgggacgcugaacuugccuguguggaucuggguggggugagggagcucagacaggccccugcaccaaagcacuugccacaggagucacgccccgggacacacggacucaccagcugugcagagggugucuggagcccccuagggggcacccggacccuguuacccaggcccugggaugaugguggggccucacagucagcacccugguccugcuuucugcugguggggugaaaauccugcucccagaccacuugcugccggccgccaugggguccccuaucucaugccugccccacucuugauuucagggcuaugagggccucguggagggaggugagaacaucaagcaggccaacuggcugagcgucuccaacaucauccagcuggugaggccugggaacgcggaugcauguugcacuuggacucgcagacagacacacagagacagaccugcacacacagacacacacacagagacagacacgugcacaaacacacacaugcagacacacagacaugcacacagacgcacacacacacagaugugcacacacacagaugcgugcacacacagacccgugcacggacacacaggcgcgcacagacacagacacgugcacagacacacacagacaugcacacauacagacacacagacgugcacacagacacacagacgcgcacacagacacacacagaugcacacagacauggagacagauacacauggauagacacaugcagacacauaaauacacagauacacacguagacacacagaugcgcacacagguacacagauacagaaacauacagacauauguacucagagucacacacacacgugccccaucgcacagggacucagguucaggccgacccugucaucugcugccauggaauuguugggucgcagggucaugggguugccaggggccaggaggaccuggagacguggccgugcuggguccugggggagcccuggcugaggcuggcuaugaggggccacgugagcgcaccuggagcugcugaggcuugagcccuggaggcccuggccgguucccugaguugguacagggccugugugugcacgugugcacgcacauguguguggcaaccuaugcguguguguacugugcuuuccagucuccaaagccuuccacucuauuaccuuggggcuucccaagcccaggaccggacggacaucauccuccucuuugucucuccaaggagagaggcccagggagguagggccaccucagguuuccagagaccccggggcuucugccucucacucugcagggucugccagccccuugcugcccaguccuggggucccucuggugauccccaggggcugucugccgccugccaucucuccugaaguuucuggucuccucugugcagggcggcacuaucauuggcagcgcucgcugcaaggccuuuaccaccagggaggggcgccgggcagcggccuacaaccugguccagcacggcaucaccaaccugugcgucaucggcggggauggcagccucacaggugccaacaucuuccgcagcgaguggggcagccugcuggaggagcugguggcggaaggugggucugugcccggcgcacuguaggcccugggguuuuguuuugccgcugcugccaggcgugggaaugggcaggacagagggacgagggaucccugggugccccgaggcagaggaggggcugucuggccguuggccggggaggaguagugucugccagcacgagcucagaugucucccagagauggaggucagugcucaagccugagggagggcacccaggcagugcauggggcugguggaggccgguguugcucacccuacgcugcguagacaagucuucucugugauugauccgagugagauucuggacaugcauggucacagucugcagaaauagaguugaaguuggggugacauaagacacagagucccgagauugcugcuuggaaaguggccucucggagccaugucuguuccaugucccucaugugggggacccugaugugaggccuuggccgcucugcaaggcaccccagaggucccccgucugcacuuggccccagcggauccagccaugcugccacaggguuccaggcaggaggaggcugagccuggaacuccggggccccugccgggcugcacgccugggaugcgggggaagggguggcaggagaggggucucuggcccugugguggggccaguggagccucagccagguccuccugcugcuccuggcccagguaagaucucagagacuacagcccggaccuacucgcaccugaacaucgcgggccuagugggcuccaucgauaacgacuucugcggcaccgacaugaccaucggcacggacucggcccuccaccgcaucauggaggucaucgaugccaucaccaccacugcccagaggugagugaggcuggcgccggcggccagcccagggccccuccuccccgcacgguggugagguggucucagggugacggccaucugcaagggcaguggacucugguagccccagcauccaggccagccgcccucagcccccagcugggggaacgcacagcgggcuccacucccacucugccaggccgcggggggccuuugugcagccccuucugaggggcagcugcuugcccuggggugugacgcccccaaaggaaguccugggcuggccaggccugggcuuggcaaaugacccucagccugggaggagaucagucgaaaccagcccaaaggcuggaaggaucccaagguaucuuuuagcucagagccugggcaugagaaggggcuguccccugccugccucuccauccacugggucccuugagcaccccgcagggaaucgggcuggcagggccguguggcuggcacugaugcauccuccuguuccaucuccacagccaccagaggaccuucgugcuggaagugaugggccggcacugcgggugaggaggggcuuccuggcccgcuggguggcccgggugcugcuggggaccgcagugacagguguggcauauuuauucuagggcucaguuaaugccaugggugugagagagccgggugggggccgggagagacagagaagcuguggcccagagucggaccucuggguacagggaagcuccccucaacggcuggguggggguccugagcaggcaggcgcucgcuccuccagguaccuggcgcugguaucugcacuggccucaggggccgacuggcuguucauccccgaggcuccacccgaggacggcugggagaacuucaugugugagaggcugggugaggugggugccguccagccugcugggggccgcagguguccuggugcacuggguagcgccccugggguuuugggaccagccuugaccaacucaucuaucacucauggguucaucagcagcugcaggugccccuugggggcgggacacgcaaggaguggggggcuacggggcugaccucagugaggcaccugugguccugcccccagugggcaggaggcggagagggucacucaggcugccgccgccccaggcucagccccguggucaguguggggagcuuggugaggcugcuuacuggggugggacugcugagccuggggcggugggaggugguugguugugagggaguggccccagcaagguccagacggcagggcuguggggguggcgaggccaggagcugggccaguggggagcagggccuuccccugagggcggucggggcccggggguggguucuaggcuggaaagaugugucggaacguggcuguagccacaggguggacaggaggucccggaagcaggagaggguggggaggcugcugggaggccgagaccgccucugggagggaugggggggugccugguggggaggggugugucuggagugggggugccuggaaugccgcccucugguucccuugggguggaguugggggcucuggccuagaacaggcugacacugcccuguggacccugagaccccucaacugggacaggucggccccuuggugggguggggcucaaugguggaccagaggcacgggccauucaggcuguccuucgcccacacccgaccaugcagggcaaggccaggggcccccguggcucuagcucuguccucugugcgcugaggcugaggcaggaccacuggaaccagcccugggggcagaggguggguuugggacugacacgguaucccuguccccgugugaagguggcagcgucacucccaucuguguggacacugguuccaccuccgcguggcuguacagugcugccgagggcagugggagaggccguggguaaugaccuggcuucuagaaccuuccccaguggagccuaggggccgggcggagauggagcccaacaggcgaggcuggcccaaggugcggguccuaugaggggcuugcucuccuagggcagggacuucccggggguuccggcuccaguggugaccuuggccuuagcuuaugucugugacucacauugggcccuccuggaaguggccuggaugcaaggucggcccaccugguuccuuccugcucugugugagcagcucaggcccucacugagagucuguuucccccuguaacaugcggguucccgccuugcccaccacccagggugcacuggggcagggaggguggcacagcucuccugcuggaccugcagcccaucuuccgggugucugaccucaccugcacuggcgccaccuccuccagguagcccuccacucccaccacacccgggcccugucugagcugcuccaacccugucccuguaggaggcauuguggcccguggugggcaaacauggggcuuguggcucagagcgagucccacaaauguuggcugggucauugaaguggacggccgaaaagcucuuucaguucccagagagcugggccgcggcugguguguggugcugaggcagcagccugaggcuggcagaggggaugguguguccuaugugcaccaguguggacccacaguggcuucagggugcaggguguccggggagcccuggcuggugccagcgaugcggggccccugguuauaaggaugagcagauggaagcucacaggggccccagguaccuggcccaggcuagcccgggcaggccccucugcccugugccccguggagcugcagcccugugcgucuucccgccuggaaggcuucaccagacacaagggcccagccccagcugugugugugcugggcccagccccgagggcccccuuccuccccugcugcccuucccaggcuuucgggcagagcccucuuguucaccgccuccaggagggcggggcguccuagugggcccagccucaucucugcccucgcgcuccaggccugcuuuccuccugcuggguggggauugugcccuggcccauguggguugggaaugguggccccagggagggcuccuggcacccgggggcuguguccggggcagguuucccugccuggcagcugagcccugucgugucuuugacccagacucggagccgugggucccgacugaacaucaucaucaucgcugagggugccauugaccgcaacgggaagcccaucucguccagcuacgugaaggacgugcgugugggccuggggguggccacugggcaccugcuccucuaggccgugugggcuggggcucagggcugguccuucccacuguccugcagcuggugguucagaggcugggcuucgacacccguguaacugugcugggccacgugcagcggggagggacgcccucugccuucgaccggauccugguaaguggccaucacccugcccugcguacgugcguggguaagcguggugugugggugugggugugggcagugugcacgcgagcauggcacgugcacuguguccauguggcugugggugaguguccgugucuguguguggggguguaugugugggggacgcgugguccuugugggugugucugugugugucugguccguguggguguguguggcagugugugugggugugugucaguguggguguguguggguguucccucaagcuguugcuccuccugggggagacugaggccuggcuucuccguuccccugcagguauagggaacucagaccuggggaccaugggaggccccccaccagccugugccuccuggcuguucugacccccacccucugccagcccaacguggcagcagucagggccaggggcaggcccugggagaggggcugggugggcagaggguggugcccauggcgccuguggcgucacagucugggaggcuggugcugggagggagcauucggggucuggccuggccucgccguccuugguccugaucaccgcugggucucacuuuguccucugcaaaaugggaaugaaguuggagccaaauggagugggucuggggccaggaaggcaccaugguaggcaaaaugccuguguaugaggguggucacccucucaggcagggccagagacugucagacaggugggacuugugcugagggagaccaggugacugcgcccagcccugugacugcaccuggcccugugacucgugugcugagccgagcauucccagggaacccacacagcuggacgagggccacucuauagaggggaggcuuccucagagaggggccccgccgaccuagccaggcagcugcuguccccucugugaggccucaggcucacucugaagagccucuugaggggccggggacaucagggcaagccagccgcugcugagccuggggugauggaaaugccgcugcugugaccgggccagccaugcacucccagccugcaggcugcuggguuuuccagccagugucuuggaugccugaugccgggugugaaacaaaggacaguugaucgccccuagccgcggcugucacccagagcgucagcauucuugugcucccugagcccguauucccacugggugcugcgaaggggccaggggacccuagcacgugcagugguaaccugcacuuuuccaaggagccucauccugcauggggggugucuccgaggcugcucccuaaacagcguccuggagagacugcccagaauaaggugccgccugugccucacuugcaagaugaaaaaaccuguguggaacacggagggcugucuguggccccggggguccagcugcugggcuucuacagggcuggccacugguggucaugggacggccacggcaaccgcaggccuggcuuucuuguccacuguggccgguucccgggguggggcuggggccugccuuugcagugugucccuggggggcagcuccuggauguguccucugcccagcccuuuggccggugcggacacacaccagggaagucacgacaugagggccuccacgggaggauccaucgcagcggauggggcccuggggaccuggcucccgcccuugccuugcgcgccuagcgauggcagcgagcgacggugggugggucgcauugcauggcacccugcagccagcagugcaggcugggccuuccagcagggcagcgaggacucugugaaauggugucuggugugccgucgugaaugcuggucagacacguuuccaucucugaugccaccuguucuggaagcuuccgucagcguggggggcucuggaagcugggguuugcacaucuacagaggaugggcauguggcuugggguagagggaccaagugggugugccagccugaacccuuccccacagagcagcaagaugggcauggaggcggugauggcgcugcuggaagccacgccugacacgccggccugcguggucacccucucggggaaccagucagugcggcugccccucauggagugcgugcagaugguaagcccugggccccccccaucagaaccgccuggccccucuccccaguccccacucacaggccccacugcucucugggggccccagcacugugagcaccggagggcagggccucguggcuggcccagggcaucccaggucuccagggaggggagggaugugagcacaucccugggugggacgugggaccugggacguuccccaggaggugugucggagcugcagggagccuggugagcaugggaagucacagggguccacggccacugagcuucuguaggcaguggugggaguugggguuacgaugggacggaggaggaggggccagugaucagagcagagcccugggaggagcucaggcaggugauggggaacacugggguggcuggagcagggaccccaggagaggagguacggggaaggcagaggcgagggggccgggugugggggcugguccagcccuggcucgguggguuuggaggccugcaacuggggcagagugcccugccuggagcuggagcugcugagaggugaggagggcagcugggggcaggguagggccuccuggucucagccagccccagaagagcuggccuugguggugaccgcuguuccuagggagaggcugccaggccugggccagggucaggagaugccggccagaucugcccucgucaggcccaccagacagggcaguagccaugggugugcgggccaggcucuccauagucuguguucuguuucucuuccuuaagaccaaggaagugcagaaagccauggaugacaagagguuugacgaggccacccagcuccgugguggguaagcccccucagcagaccccugcacucuuacauggcugggucccggugccaggcagcaugugcugcaguggcgcuaugcacgccuggccugggucauccuucuaggcaccgcgucugaagaucgagggaggaaggggccugcgggugguacaggaggcgggcugggaggugugguaccacaggagacccugggcgguggcacgggcagggcccagugcacagggaucugggcauggcgaggggaugagaagcuguggauacaagcccaggacaugggguggccccgcgggggcugggaaggcuggcagauguuggguguggguaccaccccccugcaggcguccuggcggccgggucaggcuggauuggacgucuggguucccaugcgugccuccacccgcuaccaagguggccaacccucccuugagcuggaugccggccacgugcuuugcugcacgggcuggcguggccucguguuguguugggggucucgcaccuucuguggaaggugcccugccuggcaugcgcggugucugcugccucauggcugagcuuccaucgggccgugugccugugaccagccuccugggcucugucacggcugcgcuguggcuguacgccguggcgcugcagggcugugcauggugugacccgaaucccuuccaggagcuucgagaacaacuggaacauuuacaagcuccucgcccaccagaagccccccaaggagaaggugaggcagggagcggcgcccacagagggaggaacgggcucaguuauucugcagccucuucacgcuggccccguggcugggccugccugcccccaccuucccuccugcugggguccgagcugugagcugggagggugggccugaccucugccugggcucaggcaccacuguggcuggcaggucccgggugcugggacccuggcugcagggcuggcuguugcuucucagugguggauggaaaugaagucaggccacaggcuuaacucaggagaggagaagccauuguguagaaaaugucccccggggccaggcucacaccuguaaucccagcacuuuggaaggcugagguggccaguucaccugaggucaggaguucgagaccagccuggccaacauggugaaacuccgucucuacuaaaaauacaaaaauuagcugggcguggugguggcacaugccuguaaucacagcuacucaggaggcugaggcaggagaauagcuugaacuugggagguggagggugcagugagccgagaucgugccauugcacuccagcccgggcggcaagagugaaacucugaaaauaaaauguucccaaacagcugaaaaccucaggaaaugggaucucuccaaaauaaggaugaaauggcuuguuucuaaaguccugggggacgaggguccuguagagagagucacggccagugagguccuggcucccaagccccuugagccacagccggagcugcaggccggggcagacagcguggcccagccugagucugguccucccuuccauggacaucuuugggugucccugcugcuccagccuccugcuuauccccagagcuagucagcgggcucuacccuccgugguggggcaaccuggucuccacgaacccagaaccuggcaggggcgugacuggcuuugugggcagcagggcuggcucguaccaggacccaguggggccauguggcuauggagcccuuggguguggcugcugccaagugggaugugcugcacgugacaggugcacgccagguucagagccucagcacgguggguggaggggaggugguggcggccgucacuggauucacauggauguggugggguuuuggguccaucagguuaaauuaacuguaguccugaugggacugucuccaugucuuuucccuucccuuaacguggcuacuagaaaacaggauagccagggccccuuccuuacucguggcugugcaccccccacccucccgcccgcugccagccccuugugugggcacugaccuguguucccgcccgcaagccuggcuucacaacagugcucgccccuucugccuccucuguugccugcgugccagggggccaggcuugcaccgugucucuuuuggucuucaccagaaucuucuggaauuagaacagauaccguauucccagggcaguugggcggugugcugggcagcguccaggcugcuggcagggccuggccccuuuuuccagaaccugccggccugcugaccuccugugcagguuggggguccccuccccggcugugccucacgcucaucuccccuucucucugaagucuaacuucucccuggccauccugaaugugggggccccggcggcuggcaugaaugcggccgugcgcucggcggugcggaccggcaucucccauggacacacaguauacguggugcacgauggcuucgaaggccuagccaagggucagguggguccggccggggcaaacaagugaggacuugggccuucugugugcacacuuggggcauuuccuguggaaggccggcugcuggagguggaggcugagaccuggguccgcgugucggugcccacccgggccuggguacucagcucugccugcagcgugaugcccaacacuggcuggcccccgggcacaggcccaccccuggggggaauuggccagaggcucaggcuggccccugaagcugcaucuccuccuggcaggugcaagaaguaggcuggcacgacguggccggcugguuggggcgugguggcuccaugcuggggaccaagaggugagcugccugcugcggguaccugggggcaggagggccagggcgcaguauccaggcccugcaggugggggcggcaaggggaacccagcccggggcccugggcucggccccucuuccugcugguggucugcccagagcaggcuucacgccuccugccuggggcuuccuggccugagcuccgcuguguagggcaggcugcucuggcggccccaugcccauggugggcucuccguggcaaggaagcuggcgagcgucugucccugccuggccaggccaggcagccugcacugucagcacucuggcugaggcuaugggccugucugauggcuuuugucccagggccugagacccuucugugggcauggggugggcacagucccccugugugacuacaggggaaguugcugaguccugagccacugaguggcugcaagggccagaggaagcauccgcuccugccgcugaguguugggcgagaaagccucgggcaggaagggguucccacggggagcccagcggggugggggguucacucgguugccuggccggugccuggugaugcugaguggugcccaggcggcucacgcugggccugugugucccucuccguguggagccacagcgccacaucccgggcauugcagcgacugcugacuggcucggggaacggccaaggcaaugccuuucugugaucagaugcaaucuggacacgcguccccgggugcugcguguucaugcggaugugucuuugacugcaggacccugcccaagggccagcuggaguccauuguggagaacauccgcaucuaugguauucacgcccugcugguggucgguggguuugaggugagagcugcccacggacgaaaaagccccagggcacaggagacccaagguguccucccgccgagggggcccauccugaaaacccgugugcuggcugggccgaugcaggggccgagagggucgggguuuuaagugcugugugugggcucgggagggcacccgugugccagcugggcugaugcaggggccgagaggguugggguuuuaagugcugugugugggcucgggaggguucuuuacuuucuccggaaagcuucacaagguuccgauuaaccccagugcuggggaggggcaggggaggaaggggacucggaagcuggaggacgagaaagaagggaggcggaggaggcagagguguaggugcuggacggcaucgcugaacgugguguccuggcacugggcaagcugucacuaaauaaugaauaaaugacagcccuucccccuugcccuccauggaguggaucuggggucagaguggguuggaggagacuccugacccuccuuagaguccaguuucccugguaggcauccugagaugacaccaggcugacugccuggcccagccccaggggauugagcagguggguccuggcguccagcacggggcacaugacaggucagcagggagcagggcugggcggccgccggcagagccuguccccggcccacccuggccucggugcugcccuugaccugccccgucccuacugcugcaggccuaugaaggggugcugcagcugguggaggcucgcgggcgcuacgaggagcucugcaucgucaugugugucaucccagccaccaucagcaacaacgucccuggcaccgacuucagccugggcuccgacacugcuguaaaugccgccauggagguacggggcuccuggacaccggccugccaugcccaggcccuugugggguggggcugagccuacggaggcugcuggaggggauaguguguggugagcaccugggagggcugccaggguugggguuuguggggcacaggcccgggugaaggggcucagcucccugccauagccacuuccagguccaggggggcccugcguuguuccucgcuacugugaugagcucagauggggagacugaggcgggaaugucccugcgccccagugcuggguagucuaagagcagcgccuggccucuguccaagggugccagggacaccccugcccacucacagccagugugugugcaggcugcuguccacugugcccugggggguggggucgccugguugagaaccccugguccuguggggcccaggugggaggugggcccaagccuggugcugcuggcugucugggugcgucagccccaggcuggcuuuggagacacagggcucccugcaggguagccaugccgacggccuacagggaagggugggcacguggaggacccccgacccccccuugucccccagagcugugaccgcaucaaacagucugccucggggaccaagcgccguguguucaucguggagaccaugggggguuacuguggcuaccuggccaccgugacuggcauugcugugggggccgacgccgccuacgucuucgaggacccuuucaacauccacgacuuaaaggugagcccagcccagccccugcugcggcagaccugccggcaugccagccugggccccagacacucaggccggccagcgcagggcagggcccgggcaggugggacgcguagcccagugcuccugcuggccccggaucgccggucagccuggaauucccuccccacaguccuccggcucauccguguccgccccucccgcaggucaacguggagcacaugacggagaagaugaagacagacauucagaggggccuggugcugcggugaggcugccgugggucccuggccacagcugcgcguccaacucucggggcugggguggggcugcugaggagcggcugggcaggagaaggcaggagggguccuuggagagggugggccagggcggcuuuccugggagcugccacucccucucccaggccuggcccagcggggacucaggaucggggggagaccugaacucguucccgccgacucaggcccugcugccccucucaggaacgagaagugccaugacuacuacaccacggaguuccuguacaaccuguacucaucagagggcaagggcgucuucgacugcaggaccaauguccugggccaccugcagcagguguggggcaggggugaggcucugagaggccugccccucuuuccugccaccaucuguccccggccccaggggucccagcccucacgggcacccacgggcacucccggcaggcccucgggcacgugugcccuuccccagugaggggaccgaggccuguaucuaggugaggucucauuucaagaagggguggggcuggggcuggagccggggcccgagccagggcauucacaugcugagccgagcuccccaccccugccaggccucccgcggccacuuccgccgaaccccucaccuagauccccgcaugcucccugccuuaugguggcccugcaggaagcccgcguccugggguuuucugagccagggaggggagucaggguggcugggcauggggcccgaggugauggggcccgagguggggccgcuggcugccgaugcagggcccaggagucacuugacuuggccaggggcagccgacugccggccucgggaggcagcuucuggccuggacuuggagcuggagagagcaggcaggguccucgaucgggaacagacgggaacggugcacggguuggaaggaauggguguucacaagcugccugggaggcuccccguggggauccugucugcacuggcguuggccuuggcccaggcagcccaggggaguccagggaaccgggccucaccuguuuccaggguggcgcuccaacccccuuugaccggaacuaugggaccaagcugggggugaaggccaugcugugguugucggagaagcugcgcgagguuuaccgcaaggguagguggugggugcgacccgaggccucacuuugcccuccccuggcucccuggggcagggccucaccauggagggcugccacgugccucuguuugcaggacggguguucgccaaugccccagacucggccugcgugaucggccugaagaagaaggcgguggccuucagccccgucacugagcucaagaaagacacugauuucgagugaguuccaccaaagccucguggaggcggguggggcugagggguggcccagaccuucccugaggcaggugugccaggcccagccccacuggcacccugaccccgcaaggccuccugggcccccaugcccagguccccgccaggccguggagagcagggaccaugcccaagucuucugagcacaacacugggcaauccuuucgggugggcaugggggcacagcggguagccaggagugggcacgcuugagggcggcugaggcugacucugugcugugccuccgagggauggggaccccagaccugucccagcuccacggauaccgagauguucagacagaggggcaugcacaggcugcagggucggggggggugggggggcuggggacguggcugaagagcugcccugaccccugacuccccaucauccucccauccccguccugcacaggcaccgcaugccacgggagcagugguggcugagccugcggcucaugcugaagaugcuggcacaauaccgcaucaguauggccgccuacgugucaggggagcuggagcacgugacccgccgcacccugagcauggacaagggcuucugaggccagccaugcccacgccccuccccagcccccacccaugccagcgcagcgccagggcucagauggggccugggcuguugugucuggagccugcaggcaggugggggcugcgucccugcucagcccauccccugccucuaucccuggccaccugccaggccucccucgggcuggugucuugagaccagccugccaggcccuccagcaggaggacagagugcccuggggcauccaccuuccugcc

SEQ ID NO: 16302 - RNA, 11837 nt, Homo sapiens
gcugcaugucccggccaucuggggucaggaggggaagggggccgccggacgggccaugcucuggauggcccacugcaggaugccaucgaaggugugcugcgggacagagugacggugagaaccuccaggugcgcccccgccgcagccacagaaucauggccaucguuacaagaagucaccauccaaccuucccucuaagucaaagguggggaaacugaggcccgaggccccauggcacaggccagucuggggaggacccuguccugugcacuucaccguauuccaucaaagguggggaaacugaggcccaagguccccauggcacaggccagaccgaggacccuguccuguguacuucaccacauccuauaagcccagggcacauccccauggcaguucauggcaguucugccuccucggguggcuccuucagggugggggggucggggccagcuacuuauucugcucaggagccugaugcucccacaggauggggccacgggccccacgaugccagcagaauaagaccgccacccgggagaggcugugagcccgucgcucauuucuccagcuauacccggggaccccauccagaggggcagcuccauuacccagcgcugggcccccuggcccacucucaggcccuggggcucugcagacaccugcacggucaggguguguggggcacggccacugcacagggcagaaccccugccccauggucagcugggacccccgggugccacaucagacacugaggagaacccguggaggcugaaggagcuuauccucuuggcaaaaacagacagagcccuuaaaagucacauuuuccccacagauucuaccugcccaucuuagcguagagaggccugaguugggaggggcaagcaaaucuuagagggacggggucugggaccccccccccacucccacgccccacccucccugggaaaguggaucuugagccuggugcucgagccucugccugccagggugcaggcccucaggggaggggccgugugggggcucuuguuggggaggggcugggggcgcucagcagcacugggcucccgcagggggaggggccggggggggcuccugcaagggggcuaggggggcuccuguggggggugccaggugcucagcagcacuggggcuccugguggguggagcagggacagccugaguuuccacggcucaagagcagugggggccggcaguccucccccagaguggggagccugggugccggcugaggcaggggagggggaguggaggagcaccaggaggccaggggaggcguuaccucgcucagaagggacuccaggucaucccugugcagagcgggcucgugacuggcagugucauccuggaacccaguaaagagaagaggucagcccaacucccacagcccugguggggguacagaggccgcagggccuaggggccgcggggguguuucccccacacugagaugggaauucuuacacccagcuccacugggggugggggcacagggcugcgugggcaugauggggcuggggcugccuccccaggguccugcccacggccagcugcccacggcccccagacagccuccacacuguguggccuccuggggaaaacgagggagcucagggaaccagcaaggagucccacucugagaggggaagucugaggcccagagaggaaagugccugguccaugccacccccgcccccgacaagcaccaccagggccagcccacacuauaggugagcgaccagagugggagaagguccccaggcaggcacccccagcagagaggagaccauauuacauugaacccuguggaauuccccauuuguggccccaaacagccacaucccagcuccuccacucgggugaacacuggcgcugcgaggcccggcagcccugcauggcugagggaggggcugcccggucuggaggggaaagccccuggaugcuccccgguccuaaggaugcucccagggggugggagagcugcucaggauggggucuggggccacguccaaccacccuggaggaagggggcaggcugaggggggaggccaaggccagccagaacuuuuccucugacauggcguuacauuucacaucacgaugacaagaaagaggucucugcuguucagagacagaacccaggagguuaaugacgagguacccgcugcgggagcaguugcaggaaagcugccugggguuagggaggggcaucugcguauaugcccggcugggcuccugacuccagauggguggugugaggagggaggcuucuagaaggaaggggacagugacagcugugggccacgccacuguuccacaaaagccccaagggcagggcugggucugaggcuugugccaugccaggccagagccugcaugccggggaagccugucaccugcccggggaguaccacgcugggguaggcugucacccuccuggggaguaccacgccgggguggccugucacccacacgguguauacggggcggaggcacagcugggaaagagcaugggccaguggagcaggugggacgugucaucaccccaggaucccuaaaggcuccucgguggccaggaugugcucaggaggccucugcuggggacggucagggcaagaggccacccccccggaggcuccugcagcagcgacucgggccucccccacacccagcuccagggcaagcccagccgccccagcagucaggggucuccgcgccacccagguccucucugaccccggagcaggaggacaggaagagcuacuggcuggacccggggucacuuugccucucugagagggcucuggccacacagugggguggauccuggccccagggagggcugggggugagacaaccuggaggggucagacaggguggggguuugcuccugcaggccgggcgcucccgcucucccuucaccccaccagggagcccuggcaggacucucaggcucaugcugugaggcggccacacagccaaccgugacgucagccaccaacccucggggggagcuuccuuuuuaacuauauuuaaguugccaaaaagaauugguuuaaaggggaaauauuuucuacagauaaugagcacauggucagugcgucuggugcaagcccucgaagcuggcacccagggucugcccugagaugugcucccccaacaccaacccaagggguuccccacccccagcaccggcaugcauggagggccccugcggcacugaccuuggcaggcccaggggccaggcgggcggggcugggggccagcacccccuccacaggggcuggggucacgucuccugagcaggaucugcagcgcaggcccguccugcagcagaggaugaggggcugccagcccugggggggagcaggagugccaccuccgggguaugggguguggggugugggcguggguggugagugggggauggggguguggggugugaggaagggguguggguguggguggagagugggagugguggguuuggguggguuuggguuggguguagggugugggguggguguagggugugggugggagugugggguguggggugggguguggcuguggaguguggugaggugcaggguaugagguggggaguagggugugggugggggugugguggaguguggcuguggaguguagggugugggugcagggcaugggugugggguggggugcaaggugugggugggagugugggguguggguggggugugguugugggcuguaugauguggguggggaguguggggugggguguaggguguggguguggguucaggccuccccgccgaccacgcucacucacccgggccgggaggugccggcugggaaguggcagcgccaguggaaggcagcggcgcagugaguacaccgcagcacguccguaccaucuccgcacaccccgcaacgcgcaccaggagccagguucugugggaggcaacagcgcggggugacgcggggggccgggggaaauguagcugaacccgaacccgagcccugugcgcucuccccugggaccacccagggcuggacggcgggucuaggcgcaagugaggagccucacggugccacgcaggcugcaggacagcgggaccagucccauccccaggaggcaggggcgacccaagcacccucaggcugcugccugcaagccuggcgcccgcaccucucuccugcuuggcgggccuggccuccuuuggggcugagugcgggagucuccugaaaggcggugcccacaggggugcagggaagggaauugaggcagggaggggagggcucccacgugugcugggacaucccccccuucauuguccugccuuguggggggagcaguaaugcccagggccaggagcuggaguggaggucuaggagcguccccuuccccccgcagccccccacgcuccccccacagccccaggcccugugccucccggagccuuucucgccuggccucccucuccuccuguuucaggugaauucauccgccccguagguccugggcuccuugaagagcccacccugacccccacuccccgcucaccugcugacccucaggacccacacacaguagggggugcagggccgaggaguccagcccuggcagcggggcugcagaaggcggagccggcaggugcuuguagacaagagucguguccaugccggcuagggguuccccagguggaccucuuaccuccucucccgccgaccuaagccccggggggagcuggaacccaagggucagcaucagaggggcagcgggcgccugcccggcaccacccaggagucagugacugcugggacccugaaacccagggcagcagggugggggcagaggccuggcauggugggggcggagggcuggcaugguggaaggcguccacacugagugggaaaggcuguggcacuuccuggcucugugguccucccuccucccccgucuacacacggggggcccccuggcccucagggcugucagagggaacacugggucugugcacaguagaccuacuacccucacagcagcagaacaaggaacacaucuuccggggccguuaucaaugcucauagugccccccgggguggacccgcagccaggagagcuggguuuaggcccacaggaaccaugauggggacuccacugcaggagaccacaaggaccgggcuugggcaugggggacauagugcuauggcuggggcaguccugucccacaggacuccaggggacagacggacaggaggggguggcccagccuaggagggggcguggccauguggacaggagggguggcccggcuaggagggggcguggccauaccggggucuccacggguggcuccuggggccggggcuccucugcccggggcugcaccuccuggacuguugccugcaggcagcuggagcaccuccaggucccacugcucguguguccaccagucagagacaugcagaacaagacagcgggugacagauccccaaacccacggguggagcuccagggcuccgaccaugucuuuucacagagggggaaccgaggcacagcagagagaugggcagagacacaggaagggagagcccagcagggggacauuuacccuucgugggguggcccuggccagcgugaucaggguccccuuggcgugcucucugaugaaccccaggaauccccaacaccugcgagcccugguggcuuugccugccucucagggcugggcccugccgggggccucccuaaacugacccaccuguuaaggggaauggcacccagcagaauggggaggugaucaagggcagaaagagacggcaaggaggaacggcuucaggagccgagcaaugacccccacugugccccuuauucuagugaugaggcacaaggcugagagggggccugaugacggccacucaggggcuggggcagagccucgccugaacguggguccccacugcacccagagcucuuccucccacagacugccacguccugugggguuggaaugggggcagggcucggugggccguggggaaggagcaccgggaugugaacgcagaggaggccucccgcccccacuaagcccggcguccugugcauugguggacaaacucccaccugcccuggggggcacagcucuguggccucugugcuccccagcccugucuggagugggacucugggguggggcuugggggugggggccggcuacccaugggggcgugggcugcagccugggaugagcuuggacaggguggcaucuucgcccugggccucuguucugcuuugcugcccucaggggcccagcuguccaggcugggcagcagguguggccagaccgggaggcagguggcagggugggaaaaccccaggccccggccccacggcccagugaccugacucagaaccccuuuccaucuuggaugggagaggcuugggguggcuucccuucagggucaguggguggaggcggccgugaaccgggguggccugguugcgcuggcagaggugcaggcucaccuggggaucucccggagcggaggggacaggcaggccagguggaaggcccgagggcagccgucacagcagaugagcuccccgccgucccgacacacggcacacucguccucauucuucuggcacaggcaagagacgcccaugcagacugggcuggggugcagcacccuccugagagccaccuccuucccaaaacagcucccccagcagcaucucuggguaccugaacuccccagucucugcccugcucccaugcugccagggccugaaauucugcccugaccaccuguuccccauccaucuggucuccaacagacaccccccggggccaucccuauugggaagaaaacccgguuucuugcaggcugcugcguuccaggggccccggaacuguacaccaaccacaugaacccuuccucacagggcaguggggccaggcccagggaggucucucccgaccucagcgccugcugaauccuccaccugcagcccccaccguccuugugcccugccuggauggugccugcugugccuucaggggucucccagguaccacuuccuccagaauccccccagacagccaggcuaggcugguccugcacggcaaugaccucacucauucuaacaaucccccagacgcccaccagcccgggugcuccugcagggcaggacuggcuccugucacugcuaagugccagggccccacagagccccuggugccaaguggucaagaucuguaacccaccacggcaggcaccccccacacugcuucuaccccauuaagaaaccaugcuggggacgaaagaugagcauggcauucccaguggauccuugaccuccuggcuauagcaggggcgcccggcccacccacgggcccagcugagagcagcggguacagccuggaccaaacgccaugcucuuaagagccugagaagaccucacuuucucugacucauuuaaacuauuaccauugcguauuaucaggaaaaaaauacugucuauuaaagaaaaagagcuguacccuguggguaggggcucaggccccggugcucaucccugagugcccagguaaaggcagaggcagcaggacccacccgaggggagcaagggcagacaggggccucuccuguggucuagggcauuaccugguggagcugggggucacuggggagggccagaggggcgggaacgcugcccugcuggcccagccuagccucaccuccacccugcaaggaagaggggcgucagcaaugggggcagccucagcagcgagggugcacauggcuguggcaccaggcgucucucggcagcagcccccagcccccagcagagccacucccccagaggcaacgcuguuccuggggcggggggcaucaagagccaggcuccccagggaaggucaggugcuuacgggggcagcgcccugggcucccuuggcucgaaccagaggcuucgggccacugcugcugcgggccuuguucuucccacugccggagucuucgaacuugcugggaguguagaacuccccgccaaccuggaugcacuucuuggagccgccugggaggagaugccggcugguccuggcucacccgcccagcaggaccugccuuggcagucguguaggccccaggguggggucuagcagagacagguggaguucccacagccugcauuccuccagcccgcccccaccccagucgagucuggggcccggggauuguccuggaucuacaccaggguguucaacagcgucccccgaaguucacguccacccagaaccucagagugugaccuuacuugaaaucagggucuuuguagaugugauuaguuaagaugaggucacacuggaccauaaguucaaugacugguguccuuauaaagaggacacgugggagacagcugugagaccacagaagcagaggcuggagcgguggguccugagcccaggaacaaggagcacagggguacccccauaaugaccagcagcugggagacacaaggaaggauucuucccuggagccuccagagggaguguggccccgagacaccucgauguuggcauuucugucauuucaagccucccaguuugugccaauuuaaccaacagccuuaggaaguaacacagugggccuugggaccauccagaggugcaagaccagggcccuggcugugcuugguguucccagcccauguccagcaccgaggagacaccgugucagggacuugagauggaaugccccgauggcacggugggucugccaccagcggcccugcugugcccuggucagauggcacuggugauugcauggggucagcggcuggccagggaauggcgggcgaggaugcugcaggcuggccaggguauggggggcaaggacgcuaugcuacaggcuguccugguugaagaaugccgauacccuggagggucucagcagcacaggcagaacuuucuaaggaugcaaccccauggcccaggagggcccaugcacauggauggaggugacuggggagugcuguacaucccggguggggaugugggccuggaccgcuggccuugcagaaggucccccgacagggagacuucagugcucacccuccuccuccaaagucagcagaaccacaggcagaaacucuggcuaccugagcaacaguccggucugcugugggaccaccaggaugcaaaggggcgugguccuccuuccaucuuggagccugggucuccccaucagccccaucuccccgccacagcgucuaccugacucaaacaccugcuggaugaggauccccuccacggccccucgggcucccgggacguccccggaggacauggccacagcucucuggacugaagcugacauggucugaaucccugggaaagggaacacccauuggggucacccguggggaagacuguucccaagcacauacucuaugccagaagcaggcagcacugggcugcagagcccuuuccuuccagccagggcaggccaaggaggggacccagcccugccaugugcagacagcccacagguaagugcagagacaugagaauguguguguucgugugugcacccaagugugcgugugcugggggguggcagugucagcagagcuggcacaauggauaggaaggcaugaccaaugaccagacccacccccccaugacaugggcccuguauugugccgggagggacacagaguuccuaggcucugcccucagggagauagggggucucuggaguccagugcccugggaaggaaggagaaggggacaggaaggguucagccugcaugcagcugggggccagggaugauuuucuggaggaagcuaugucuaggcugguccugaaggauagggaguggacgggcagagaaggugccugagaagggggucccagaaccagggugcagugggggcaggggcgacuggcaagaucaugcuuagacccaagguguccccuuccugggucugguggugcagcuuaggcccuuggaaugacacaccaggccagcacguccccagccccuaggacagggucucagagggcaggcccugcucugaccccugaccccuugccccuggccagggagaagggaggcgcucccacugggccccgcucaccguucccgaguggaaggcgcugcugcucugcgcugcucuccggcuucuuggggggcuuggccuucaguugagagccugaaugggggagcugggggcagccuggccuccccucucagugggggugagugccggugggcaggggcccgcggugggagggcguggagggggcgguccagugcuggguagucccuuugccgggcucugguuucucaucaguaaaagggaaaugagacccgcccgccuacuucaccagcuccggggagcucagccuucaggcaggagggagcugagaggcugguccagugugugggucuaguacccagaggagacccccacagccccaggcaggcuggccccacacccagugggugggagcccggguggggagggggcgugggcucccggggaagcccgggaagacuggagacccuggcuggcuuccccugcagggaggguaccugggcuggcggugccccuuggagucagggcugcuggcgcggcagcucgagccucuucugaggccuuccucuugguggggagucuggguggcgguaccaaagccuuggggacggccgggggcuuccuccccuuccggggcuggcugagguccacaucugcagcucaggggcaggagcagggucccaaccucaggguuuucuccagggguagggugggccccagaacuggacaccuuggccagacaggugaggccuggccccuuugccucuuaggauccaagacgguccuggaacaucacccacgggcuccucaaacaccacuccgguuccaguccagcugggcugagcaggugacagcagcugccccaggcccccagcauggcugaguccaccaggacccaccuuuggggaagcuguccaggaugggcugcagccggccauagcgcuccagguuguaguccuugaacagcacccuccagaaguccaggauggcuguggaguccugggucagcagccaggacaggagggcguggaaggccugggggcagcccuccuuuuccuucagaugaagcgucuccugcagugggguggcaugagggucccugccauggucccccacacccugcggccugcccaucuccaucaugacuagaggguggagcucccaggcagaggcgcuggcgaccuggacagcuccacgcccaucuccucggcuugugguggagucagguggugguguagggguguugaggguggggcugggggaaccuggaggccauucccuuggcuugggggugagguguggggacggcugggggaaggggaccaacuucuaacuugucaucagggacgccccuggcuccuuguggggagggaguuggggaaggcuggaggggcuuggggaucuggaggggcgggguccuccuggaacuuccccggggacuaucccuggcucacagggccugggggcagcggggggcgggcggggagcccaccugaaacuuguccucggggaccacgucguggucagccagcgcgugcagcagugggaaggcgcuguccacggccaccgcgaucuccgugcggugcagccucagaagccggcguagcgccgcguccgucgccauggggugggcgcggggacccggggcuggggcggacgcggugggucccgggacacuggcagccccucgcuuggccucgggucccggcggggcug

SEQ ID NO: 16303 - RNA, 14440 nt, Homo sapiens
agccacaggcggaggcucuggggaaagguccaguuccugggaugcuggccccuaaugaugggcccaucucuccagugccgcccuucccucccgccuggcacaggaguucuggagccacgguccugagucuacagaacagcccggucagccucgucccgcggugcaagcgaggccuggccucccucccugccuguccuuggcccggccacaucacucccugcguuucuucuucuucuccggcuccuggacauuggccgccuuugcucgggcacuggucaggggccgagguguccuccuucucuggcgagccccucucuggccacggccccugggcugaucucggagcagggcccgcucagcugugccuggcugcucaccagccucugcccgcgccucggggucggccccuacaccccuccuccugcuccucuuccucuccaugcccgggcucgggggcuccuucucaccuuucccugacaaaacagcaagaccccaugagccagagaaugccaacacgggcucuuuccacuuacuccaacucaggcugaggaugccagcaccacagaccugggaggacaacacggccacaacagccagccagacgcaucccguguccagugugggcgccaagcuccauccacacggcucaggaccucagcaagggcugaccucagaaggaccagcgugaggacagggucaugagacccaggagcaaaggcacagaggaguaggcaggacugggcucaaggcagaaggggagguggaagaacaggacgccaggcagugccagguccugaacgccagggccgacaggguucacacagccaagggccggcuacaaagaggaggccacugccucaugggaaaugagauggacggcuucaauggcacggagcucugggcaagggaaggggugaaucccuaggcccuggggccaguuuagcauggagagaguaacagggaaggcuucccaguguggggcaaagccaccaugugccuccucugcaccccauucuugccaugggcccccugcccugcccggcacugugcucaacccccuccacugcagguaggcagcuccaggcccugaguggucugccgcggacccaggguugccccuggugagggcaucacaugccaaccacacucguguggccagaggcccaacacggaaggcagccccagaaaucaaggacagaaguggagggaagaaguggagggaagaaggggaaggaagacguggagagacucaggaaucucuggagggugcgggagaggagcggacggggcuuggaucuaagacggaggcacggaaggaggcagcccagccaggaggaugucuccagaccgggagggagggcagcgcacacagcucgggggagcugcagacaaggaaggugggugggggaggcagggagaggccuacaggagggaugccgaggacagggcauuuccgggaugcguggauagcaggcacccaggaugggggacucggcacucaugcuucagggggagacacugcaggugacccccauccaggggagaagcaagcaggugaggacgccggcuccaugacuaacacacccccuaguccuaccucucuccugcugcaaccugagcagacgcuucugcuucuucgucuucuucugccgccucccuucaagcaggcgccugcaggccuucucugggaucucaucuucagggaaaaugccugagaaccagggcagaagucagggggcucucgggggcuggggacuuaugguuugaggcucgcugcuuccagcaggccccagccagcaccaccuccugacaaugugugugagaaagcgcccuguucuaaugcccaggagcagcguguucaguacccgccacagcugaaacgaaccagcugagacccaagcccaucuggaaaagccaguuccuggagcauccaggacacagguacagcauagagcguccacgaccccaaaugccugggaccagcagugcuuugaaugucagguuguuuuggaacgucugcaucauauucaccaguucaacagcccucaccugaaaaccccaaacagaaaacacugcgacgagcauuucccuggagcuuccugucagcacucagcuuuggacuugguggcauuuuggauuugggguuucagauuagagacgcucaaccuguacaccaaagucuacagccuacaaugcucaugcuggcggcccaaggcaacuuucugcaucaaaaccugccagaugcacacgauccucacgcaccucacugacgcgcgcugucccgaaaaccccagacgaccagccgggcaacacagcgaaacccugucucuacaaaaaauacaacaauuagccggcgugguggcgugcgccuguggucccagcgacugggaggcugaggcgggaggaucgcuugagaccaggagaucgaggcugcagugagcugcaucacaccacugcacgccauccugggcaacagagcgagacaccgccucaaaaaauaaaaaauaaaaaaaccaaacccuggacuacagcugaugacgcgcccgcuggcggaugcaggggugugaugcugggauagaggagcuucacgcaaggacaggaagugcugaugcuggaggccggcagggacacgcagacauccacuauaaaauccuuccaacugaguugcaggucugaaacuuuucauaaggaaacaccaggggaaacgccuacgucucuaaccaucgacgcccacuaggaaaccguccuuccgauaaccuaugccaguuccauccgccacgcgcugccaagaacagacgugugcugcccaacagaccagcagcagcaccgcggucagugcuugggagccccugaggccagcaccccaucucucaggcucuggggcacuccaauggacacucaagucugagaaccacucagcaaaaaccacaaaaacgagagcuguggaacccugcgcccugccucccugucccucagaaacaccaccaggccucucugcaaagagacuccacgugcuaugagaccccuagaaccaaaccacucccacgaggauggagcuccaccuccaagguggugccauugucagugcccggccgauccucaccuccugccagguccugcagccugaaagaguaagacagauacccacuuaccacagcugcggcuuccgcaggaggaggaagcuccagcuagagcggcugcagguuccuagccaggggaaccccaggggcuggggacggucucaggguccuagcggggaucaccccgggggcugcggaagggcccaggacaaggcaaaggcacccagaucugagcaagaaagggcaacuccaaggggagcagggaggacgcagcgcccucacacacucacuuccggaucacuuuguagagacgcuuucuguucugagaaggggugcucuggcggcuggccauuucaaacagucuguuagcaacugccucguagucaaacuguuucaaaagagagacgucacagaggcaaggucagccacgcucugcgugcuccgagaacguggaaccccugagacccagauagcacuuggucccacuugcagguucuccacccggcucacaggaacacagcccacccucacugaggguccugcagcuccacccacucuacagcacagcgggcaccacacaagcugcgggcgcacugcggggcacgcacugcggggcacacucuggaagaugcacacugcggggcacacugcagggcacacgcccgccgguagccugccugcagcuuuaccacucuaggaaccacacagacaagcacgaacaacauagguuaaauugaucaauuuuaacccaagauagccacauuuuauucagucugcagauaaucauauuuaaaacuuaaaacauuuaaguuuccaauuugccugaagucagaccccacuggcugaguggauuccucgcugggacccacaggccagccgcuuggcacaugccaucucauuccccaccagcaccccaacgagggggccgcaggaaaucuggggggcugcccaugugugaggcaagaggacagcgugaggugaggccagcccuggauaaugcaguucugccugagcccacccucccaggccccagccccacuuucccaggccccagccccacucucaaugaucccacucgucuacaggcgggcaggguuggggcacccaucccuccuucaaagcuaaccccuguccggguaacucuccaugccaacagcugccauccucccuccuaacgccccccuccucuuccagagcaagcgguagcacagaggggcaaaggcugagggcacagccaugagcccagggaacccaccuggagaacggggccgccacugucccugucgucaccugccugcuccucaccagccucagguucagcccugcagauggagccuggaacaaaagggaccccgugaacccuaccugugcccaacgugugcuggccccaaacauccaggaauggagagcccgcuccgugcacccuggucggagcacgggcacaggcgggaaacacccgggaacggacagcccacccugcacccuggucagaacaugggcacaggcgggaaagcccacagcucaaggcagauacuaggugccaugugaccucuaaucucguauggacaggaugagaggugccaccucaggccugcaaaggaaaaaaagaugucccagggcacaggugccuacacagcccugaguggcugacuacaagcuggcaucuugggcaacaaaggccaugucaaaaguucuggaagugaggagccucaggguggccugguccagaagcugugggagcugauguuucggcugggugcucgagcuaggcugggcauuuggggcuuugauggcacugucugcagaagaaagguuuuugggcaacaggcagcuguggggcagcaugugacaagggucugcucuguagcuggcagcagggggccagcagcaggcacuagcggaccugccaggcaccucagcuacugagagagaagggcaaggcagagaccagggagaagcauacaggguggccgggccaagugcugggggcgguggggagggggucuucugauuaggaagccaaggggaacaguggccacagcacugauuuggggcauacugggguccugagcguggucaaagacaugcccuccacagcaccaggaugccacacuuagagcucagaccacccagcaggcucggacaaugagugcagcaucaaaacaaaaaaugggccaggcuggaccccacggcugcccacagaggccucuggcaggcagugaggggcaggugaguacaccugccccucacacacacugcacacagagcagucaggugcccugaggucucaggccugaacccagucauggucaauauggacagagcuugcuguccucuggggagacgggccaggaacgaggaacacgaggagcaagugauucacaucccgugccacagagugacgcuauggggaggacugcguugggggcugggagaggccaggaggcugaaagaguccagccccagagagugauggggggagagacggugggagggacggagagacucggcaccaaggcaggaacgagucuagggggccaacugagccagaggcaugcguuagaccgaggagcccagggguccggagagggcguggagcacaucagaggcugggggaugaggggaaacgacgugugcuuggugcccacagaagucacucuggcuucuaugcugaggauggacuguggagaggggcagagacaaggggaccagguaggagguggcaggagcaacccagcaggagaucgcacuggcucagcccaggacaggccccgaggagaagccaggcgcagugugacccccaccugcgggcggcuucucagaccucuucugggacagcgcgucuccacgcucaccacccucagaggacucaucacuguccgacgccaccuccucauccuguguguccaguucauucaggaggucuucaauggcaagcggggccugcuccacaaucgucucaaagaugccucgagugauguuguucaaaaccaaggaacugaggggcagagcagaggccggugagcaggcccguuaugcuggauucccaagcggaagccgccgacuccccugcaaccucuccccacccacacggccagcggccacucugagacagauucaucccucgagggagcagcacccccacaacagcagccccauggaagaacucagugaaggagucgggcccgaucaggccacccaccacuuacuccuugguccgggcagcaauucugcagaaggggucgaugaacuucagguucuggucugccguaagcuacggggaaagccagcgggagcucaguuccuccuccacaaacgcccagcuccaccgccccgucggagcccagccucaccuccucggcgcccacuuuggucagcuccuccaggaagaucucgaugaaguggcucuucacaccguugggggccuggcugcuggggugcaggaucucagucaucagcagcucuagcagcuccucgaucugucugaggaaagaaaaagcaaacaugacaggcagccucgaugagccccaagacagccgugccccccacucucccaugguuacacgcucugaugggaaccuaagugcgggcaggcgccacugucugcaaacaugccagccuuaaaguccacgcagaugauaucaacgauccuaggucuccuccagcgcaaggcagucuugcaguuagggaguuaugugaccagcaccaccaccagaacguauggccugagugugcaugucagcuacaaaaugcagcacguguaaacauucagacaggccuucccucuguccucaagauugcuagcagagagaaaggcuuggcugagacgagacgcccugccugguguuccucuccacugccuccacuggguaccgcuggggaagacacgucaggacagcacaggcagagaaaggaagguggaggcccagaaaggggccgaggaccaugagccaccugcuggcuuccugggcccugccgcacgacgcauuccaacugugacguccaccagagcucucccuggcaggcggguuugauggcaucacaggcccuggaucugaagacuagacagccccagagaauaauguguagcaccuacaugcaucuggaccuccuggggugcuuaauaacgcagcugccuaacucagaucuguaaacugugugauccuuaggaagcuccguagcaaggcuggagaaucacucgugauggaaaggaaaagugaugcucucuaaggcucaggaaaaacgagacagaggcaagaacaggugcugagaccaagaggaagacacacagaugcaagggaccgacuucccaggccaguggcaauggcguggauauuaaugacagccugguuaugccugcaggagauccaagagggcgggaagagcggaccccacugucagcacugggaccgcagcaggcauugggggaaggcaccgaggucuuccacaugauuccugugcugaauucucaguuacagggagaaaaguacucuuguaauaauaugccaaaaaaaguuaacacaaguaaaaucaucccuuuaacauuuaauucagcuuaagccaugagaccccuaugggguaauccacaaugcuaaggcccagaaugaaugagacuccuggcaucagaguccugccagggaauagaagaaugaaaaucccuccaaaccagaggcaccgcugcccuaaaugcaaaaucacccaugcaacucaaaccuagagaaacucagcagccacaguucaauuccugcugauucuuuaaaaaaaaaaaacaaaaaaccagaaucucacucuaucaccuaggcuagagugcaguggcucagucacagaucacugcagccucaaacuccugggcucaagagauccccuuaacccaccauaaccagccugcuaauucuuuucuaugcauuuaucuaauuuuuguacuuuuaguagagacacgguuucaccaugguggccaggauggucucgaucucuugaccuugugaucugcccgccucggccucccaaagugcugggauuacagaugugagccaccgcgcccagccaauuuacauauuuuuagaauuaggagcaauuaacauugcuuacaacuugggaggccuaggcaggcagauuguuugagcccaagaguuugagacaagccugggcaacaggacagaacucgucucuaccaaaaaaagauacaaaaauuacgugggccugguggugcacaucugcagucccagccaguugggcggcugaggcaggaggaucacuugagcccgggaggucaaggcuguaguugagccaagaucacgccacugcacuccagccuaggcaacagugacaccuauuucaaaaaaacaaaaagcauugcuaaugaagcggaacaugccguguuuuuauaagaagcuccucggcuggacacccuuucauuaaaaaacucccuucugacucccagugagaacuggccuccaagccugaggauaaauggcaucauuuccacaaacacacaaacugauuuuuacuuuaaaaacuaucuucucucuaagcacgauugggggcaugcguuaauauaaaggcugacaucuccuuauggcaaagaaucaaaugacaaacacgacugcgguccccgagaacagcguccccccagagcaggcccgccgcgcacccaccuuucuucccagccuugcaucuucagaaccuucaaggacucguucaggaccauccgcaugagcuuugacacagaaggagguuggcauuagcagaagcccagcccuacuucgccagaccacccauccccauguaccaccauccgcugcaggauaaagucauggccguggugaccucugccggccccagcacacagccggcccccagagcugcugacagacagacgcuggaggacacaccaccaagcccucagaacccugggcugagaacaugcccuauccccggcuccaaggccccagcuggcaggaagcaggugcauggggggucggggguaauaggggacaguccuacgacuccaguccauaaaccggggcugaaacggaacaguccgauucauaagggagaaccaggaaagaggcacggcuacccccacgggcgguggagcccuccgcaaaaccaggucugaaacacggcugguccucaccaaaccccccgcaacgggcagaauguagcucacuuccucugcgguccacuacacagcgaaggcccucccgccaagccucacccgugaaucaacaaugccauuucccuccauggggcucaacacccuucugcaguuguccccccuuuaggcuacugacccagcaugcccacacgcccagaguggggucugagcugcagucaguagcagcagaggacacgcggacccccaggagccccgaugacagagcacagcccagcagcccggacacuguucuugcagacacaggaggccuaucccccacaacacccugcggugccaccgaggcuagcccugacgcaaggcugugcugcuggacucagccacacaaggggcacccagaaacgagccauggaaagcagcagaacgcauccauccagggacccagcagccacaucucagcaaaacaguaggguggccucccugcagagccccauugucccuaagagucugcacucugucugagugcauggccgggccccuggccugcccuggagccuccuuccuucuugagcuccaggccuuucccgcccuggucuccacuucuagaaucacugguauauaugcugucugcacaauccuggcccgaaucugagcuggacacugaagccagaguggcagaucaacaucuguccucagugagacccggacauggccccuuucaguguccccauugggugaccgacuccuacacagugacaaugucccuguaucucaggccugcucuaagguuacaaugaccaccaccuuaguaacgagaccucaugguucaacaagagggaaggagggaaggagagaagcagguccgggcagcaacacgcugcaccucuaaaccccaguguuccccuguauucucagggcaaaucagugcccugaacggggauacaaugagggaggagggaaaggaagucccacacugugaccauccaucccagccucgcaggcuaagcacuccagggcucaugcuagggcgugaccgcagcuccucugcugcgccuccagacucacucugccucuuugacaagguaacaacggugucaccaucgacucucaccaggagagcaaucgucacuuuccuucucugaaccaaaaguuugugugguguuuuaagggucgaauuccuugcccauucaaugacccucagagacuggacaaagcugcagagcccuggucagggaccgcccagagucucggcuccaccucccaccccuggcuucagggucgcacugccucagguugccucccugcccaggugccgccugucucgcuuggccaggcacugagacccgcgcugcccccgcccgccggcacccugguggcugccucaccauguagaauuuauccaggcgcagccugucaaugcccguccacucgcgauucauggucugccagaaggccugaaggaacaggugcucuggagaaggaauaagccagaagagaaccacugaggagcacgaagccacucuggggagggaggugagaacauggaggaacccguucuuuacauagcuauagauaaaaaaugcugaugcccaggcccuacccccagaacuggaucuugcuggaccaggaucuggacaugaggauuuuuagaggcuccucaagugaguccuacagacaggcaggguaagaacuucucaacuccggucaccagagaacagaggagucagaaaaaucaacugcaggaaccucaggaccaucaggcggaauucaguccaaucucuuggugacauuauccuggcuuuucacuuuauuuuuaaaguguaagauauuagcccauuaggcucgaaaugaggguuuuggguaaaugagcuaauccauguugaauacuuacaccagcacugcacacaugcuaagcacccacagacaccagcuggcgcucucuugcccuuaggcauuccuuacucuggauuugagaacacaaaccuccugggucugguggcucugaugcucagagguucugacaucuacaaaugcacccaacuacagcagagcauacucacgcgccuccguggucugaaaagcaugaacgagcugggaaauaguccuuccuaauucuuccuguguaggaaacaacaaaaacgcccucagccccugaagcaccaggcucucacaaugacacacacgcaaccacccacucacccacucacucacucacucaucacagagagucggcuuccagggggucucagcucagugcacuggagguuucaccccugcuccaaaagaccccucuacagccagggucaacaggcucucacacaaccacgggaggccccucuagacagcuggggucaacagccucucacacaaccacagcaggcacugcccucuugacagaggcugugcccuaagccacagagucacgguuaaagagggacgugggagagcggaagggagccuugggacucacagcccccuaaccaucaggaggaagagggcugcgagaccccauagaucacuggcuaucugccuacaucaccgugccagccaucgcccagaauacuugcuaagggacauuucacagccuccccuugauaauucagugggcauggaauauggcccaggaaccugaacuuaacuaaguacccucaccacccaggagauuuugaaggagagcacaaaauucacaauuugagaaacaauguuuggaaaaggcuagcaggagacguccuugucucaggagacuugaauuccgccccgugguuuccacuauuucagcacuuguuugcaacccaggacaaacacaaaacccaguuuucacccaugccagugcugcugcagugcacggcucagucaaucacaucaacaccucagcaaguguaagacucaccuaacaaaggcccaggcccaccagccgugccgaaccaagcgucaaggcuauacgaccuccccacggucucuggccauauuaaaacuggguugaccaggccgggcgcgguggcucaugccuguaaucccagcacuuugggaggccgagaugggaggaucacuugagcucaggaguucgagaccagccugaccaacaugaugaaacucugucucuacuaaaaauacaaaaaauuagccaggcaugguggcagguaccuguacucccagcuacuugggaggcugaggcaggaaaauugcuugaaaccagaaggcugagguugcaguaagccgagauugagccacugcacuccagccugggcaacaagagcgaaacuccgacuuaaaaaaaaaagaaaaacuggguugaccagaugcccauccauccucccccgcugcuucuguaccugcucugcugcuccccccacucaccuggaggaguggcuuguccugcauccacaugcaauaaaacaguccuuuccacaccuucagcagcucgucgugcguaaaaccaccugcaucaaaacagcaacgguuggaccaaaugaaucccacaccuucgagugccagaaaggaagccacagaaacgugacugccugaaugagaccaaagucccacuuacgguaaaggcaacuggggggcagaaucuggcccuccccuucaaacaauccuucuaacccagaaccugccgcgccuguggcuaugcggcuacuccagguaacugcuacuucacgcacacaguaaaaccgacugagaucuacaagguaucaggcaccauacuccauuuuggaaauucaaaauugcgaaccuugacgguuuccuaagcuggacaguggccacaagguuaaucuguuggugauaauucauccagcauuauacugagggcuucugcacucuccuguaauauaucucaaauacuaaaagaagaaagugaacucaggcauucagacuacgagagaaacagaaauuacugaggccaggugcgguggcucacgccuguacucccagcacuuuggaauugagugcugaggcaggaucacuugaggccaggaguucaagaccagucugggcaacauaggaagaccccaauuuguacaaaaaauacaaaacuuagcuggccuggccgcacggugccaguagucccagcuauuggggaggcugagaugggaggcucacuugagccugggagguagaggcugcagugagcuguaaucgugccaaugcacuccuccaccacggaugacagugaggucugucucacucagaaaaauaacaaaaaauuuuaauuuaaaacauuacucaguugacauucacugaaguccuaugugucuggcaaccuguuccugcagcagugguucucaggcugaguguggggagcagaagcacuugaacagcuucauaaagcagaugccaguccugauuuaguagggcugggauccuagaacuugcauuucuuucuuuucuuuugcgauggaaauggagucuugcuauguugcccaggcuggacuccugggccuuugugauccucccacaucgacgugccaaguagcugggauuacaggcuugggccacugcgcccggcauagaacguguauuucuaacaaauguccaggggaugcuacugcugaugggggaccacgcucggagaaccaccugguaccaugaacaagaaguagauucucggcccucagagagguacucucgaguggaaaucggaaaacaauccaauaauuaacgcaaaacagaaaacugcaaacagugggaaaugcugccaugagggaaaaauacugggugcccaaacagcagggcagcaggaguacauggucuacuggagggaggggacgccugagcuaggaaagggguuacggggcuggggaggagcguucucgcagagggaccagagucaccgcaccacgagggaaagcggcggcgggggccgugggccgguaacagcgggaacaggccaguggaccccgccugcccggcccggccacguggagguuccacagggcucggagggcccccagcuccggccgccgccgcccacacccgcaccagcccagccggcccccgagacgccagccgcccacacccccgccaaccugcggcccgcugaguccuggcgacgauguauuuccggagcuuccucaccgcccggucccgggucaccugcucauuccccgccaggcgcugagccagcuggaucucaggcgggagcugcacgcgcgaaaccaugacgccgacggccgagacccccugucccggagucgccugguacccagcacacugagcacgcgccuccugcgcccgccuccuccug

SEQ ID NO: 16304 - RNA, 14440 nt, Homo sapiens
caggaggaggcgggcgcaggaggcgcgugcucagugugcuggguaccaggcgacuccgggacagggggucucggccgucggcgucaugguuucgcgcgugcagcucccgccugagauccagcuggcucagcgccuggcggggaaugagcaggugacccgggaccgggcggugaggaagcuccggaaauacaucgucgccaggacucagcgggccgcagguuggcgggggugugggcggcuggcgucucgggggccggcugggcuggugcgggugugggcggcggcggccggagcugggggcccuccgagcccuguggaaccuccacguggccgggccgggcaggcgggguccacuggccuguucccgcuguuaccggcccacggcccccgccgccgcuuucccucguggugcggugacucuggucccucugcgagaacgcuccuccccagccccguaaccccuuuccuagcucaggcguccccucccuccaguagaccauguacuccugcugcccugcuguuugggcacccaguauuuuucccucauggcagcauuucccacuguuugcaguuuucuguuuugcguuaauuauuggauuguuuuccgauuuccacucgagaguaccucucugagggccgagaaucuacuucuuguucaugguaccaggugguucuccgagcguggucccccaucagcaguagcauccccuggacauuuguuagaaauacacguucuaugccgggcgcaguggcccaagccuguaaucccagcuacuuggcacgucgaugugggaggaucacaaaggcccaggaguccagccugggcaacauagcaagacuccauuuccaucgcaaaagaaaagaaagaaaugcaaguucuaggaucccagcccuacuaaaucaggacuggcaucugcuuuaugaagcuguucaagugcuucugcuccccacacucagccugagaaccacugcugcaggaacagguugccagacacauaggacuucagugaaugucaacugaguaauguuuuaaauuaaaauuuuuuguuauuuuucugagugagacagaccucacugucauccgugguggaggagugcauuggcacgauuacagcucacugcagccucuaccucccaggcucaagugagccucccaucucagccuccccaauagcugggacuacuggcaccgugcggccaggccagcuaaguuuuguauuuuuuguacaaauuggggucuuccuauguugcccagacuggucuugaacuccuggccucaagugauccugccucagcacucaauuccaaagugcugggaguacaggcgugagccaccgcaccuggccucaguaauuucuguuucucucguagucugaaugccugaguucacuuucuucuuuuaguauuugagauauauuacaggagagugcagaagcccucaguauaaugcuggaugaauuaucaccaacagauuaaccuuguggccacuguccagcuuaggaaaccgucaagguucgcaauuuugaauuuccaaaauggaguauggugccugauaccuuguagaucucagucgguuuuacugugugcgugaaguagcaguuaccuggaguagccgcauagccacaggcgcggcagguucuggguuagaaggauuguuugaaggggagggccagauucugccccccaguugccuuuaccguaagugggacuuuggucucauucaggcagucacguuucuguggcuuccuuucuggcacucgaaggugugggauucauuugguccaaccguugcuguuuugaugcaggugguuuuacgcacgacgagcugcugaagguguggaaaggacuguuuuauugcauguggaugcaggacaagccacuccuccaggugaguggggggagcagcagagcagguacagaagcagcgggggaggauggaugggcaucuggucaacccaguuuuucuuuuuuuuuuaagucggaguuucgcucuuguugcccaggcuggagugcaguggcucaaucucggcuuacugcaaccucagccuucugguuucaagcaauuuuccugccucagccucccaaguagcugggaguacagguaccugccaccaugccuggcuaauuuuuuguauuuuuaguagagacagaguuucaucauguuggucaggcuggucucgaacuccugagcucaagugauccucccaucucggccucccaaagugcugggauuacaggcaugagccaccgcgcccggccuggucaacccaguuuuaauauggccagagaccguggggaggucguauagccuugacgcuugguucggcacggcuggugggccugggccuuuguuaggugagucuuacacuugcugagguguugaugugauugacugagccgugcacugcagcagcacuggcaugggugaaaacuggguuuuguguuuguccuggguugcaaacaagugcugaaauaguggaaaccacggggcggaauucaagucuccugagacaaggacgucuccugcuagccuuuuccaaacauuguuucucaaauugugaauuuugugcucuccuucaaaaucuccuggguggugaggguacuuaguuaaguucagguuccugggccauauuccaugcccacugaauuaucaaggggaggcugugaaaugucccuuagcaaguauucugggcgauggcuggcacggugauguaggcagauagccagugaucuauggggucucgcagcccucuuccuccugaugguuagggggcugugagucccaaggcucccuuccgcucucccacgucccucuuuaaccgugacucuguggcuuagggcacagccucugucaagagggcagugccugcugugguugugugagaggcuguugaccccagcugucuagaggggccucccgugguugugugagagccuguugacccuggcuguagaggggucuuuuggagcaggggugaaaccuccagugcacugagcugagacccccuggaagccgacucucugugaugagugagugagugagugggugagugggugguugcgugugugucauugugagagccuggugcuucaggggcugagggcguuuuuguuguuuccuacacaggaagaauuaggaaggacuauuucccagcucguucaugcuuuucagaccacggaggcgcgugaguaugcucugcuguaguugggugcauuuguagaugucagaaccucugagcaucagagccaccagacccaggagguuuguguucucaaauccagaguaaggaaugccuaagggcaagagagcgccagcuggugucugugggugcuuagcaugugugcagugcugguguaaguauucaacauggauuagcucauuuacccaaaacccucauuucgagccuaaugggcuaauaucuuacacuuuaaaaauaaagugaaaagccaggauaaugucaccaagagauuggacugaauuccgccugaugguccugagguuccugcaguugauuuuucugacuccucuguucucuggugaccggaguugagaaguucuuacccugccugucuguaggacucacuugaggagccucuaaaaauccucauguccagauccugguccagcaagauccaguucuggggguagggccugggcaucagcauuuuuuaucuauagcuauguaaagaacggguuccuccauguucucaccucccuccccagaguggcuucgugcuccucagugguucucuucuggcuuauuccuucuccagagcaccuguuccuucaggccuucuggcagaccaugaaucgcgaguggacgggcauugacaggcugcgccuggauaaauucuacauggugaggcagccaccagggugccggcgggcgggggcagcgcgggucucagugccuggccaagcgagacaggcggcaccugggcagggaggcaaccugaggcagugcgacccugaagccaggggugggagguggagccgagacucugggcggucccugaccagggcucugcagcuuuguccagucucugagggucauugaaugggcaaggaauucgacccuuaaaacaccacacaaacuuuugguucagagaaggaaagugacgauugcucuccuggugagagucgauggugacaccguuguuaccuugucaaagaggcagagugagucuggaggcgcagcagaggagcugcggucacgcccuagcaugagcccuggagugcuuagccugcgaggcugggauggauggucacagugugggacuuccuuucccuccucccucauuguauccccguucagggcacugauuugcccugagaauacaggggaacacugggguuuagaggugcagcguguugcugcccggaccugcuucucuccuucccuccuucccucuuguugaaccaugaggucucguuacuaaggugguggucauuguaaccuuagagcaggccugagauacagggacauugucacuguguaggagucggucacccaauggggacacugaaaggggccauguccgggucucacugaggacagauguugaucugccacucuggcuucaguguccagcucagauucgggccaggauugugcagacagcauauauaccagugauucuagaaguggagaccagggcgggaaaggccuggagcucaagaaggaaggaggcuccagggcaggccaggggcccggccaugcacucagacagagugcagacucuuagggacaauggggcucugcagggaggccacccuacuguuuugcugagauguggcugcugggucccuggauggaugcguucugcugcuuuccauggcucguuucugggugccccuuguguggcugaguccagcagcacagccuugcgucagggcuagccucgguggcaccgcaggguguugugggggauaggccuccugugucugcaagaacaguguccgggcugcugggcugugcucugucaucggggcuccuggggguccgcguguccucugcugcuacugacugcagcucagaccccacucugggcgugugggcaugcugggucaguagccuaaaggggggacaacugcagaaggguguugagccccauggagggaaauggcauuguugauucacgggugaggcuuggcgggagggccuucgcuguguaguggaccgcagaggaagugagcuacauucugcccguugcgggggguuuggugaggaccagccguguuucagaccugguuuugcggagggcuccaccgcccguggggguagccgugccucuuuccugguucucccuuaugaaucggacuguuccguuucagccccgguuuauggacuggagucguaggacuguccccuauuacccccgaccccccaugcaccugcuuccugccagcuggggccuuggagccggggauagggcauguucucagcccaggguucugagggcuuggugguguguccuccagcgucugucugucagcagcucugggggccggcugugugcuggggccggcagaggucaccacggccaugacuuuauccugcagcggauggugguacauggggauggguggucuggcgaaguagggcugggcuucugcuaaugccaaccuccuucugugucaaagcucaugcggaugguccugaacgaguccuugaagguucugaagaugcaaggcugggaagaaaggugggugcgcggcgggccugcucuggggggacgcuguucucggggaccgcagucguguuugucauuugauucuuugccauaaggagaugucagccuuuauauuaacgcaugcccccaaucgugcuuagagagaagauaguuuuuaaaguaaaaaucaguuuguguguuuguggaaaugaugccauuuauccucaggcuuggaggccaguucucacugggagucagaagggaguuuuuuaaugaaaggguguccagccgaggagcuucuuauaaaaacacggcauguuccgcuucauuagcaaugcuuuuuguuuuuuugaaauaggugucacuguugccuaggcuggagugcaguggcgugaucuuggcucaacuacagccuugaccucccgggcucaagugauccuccugccucagccgcccaacuggcugggacugcagaugugcaccaccaggcccacguaauuuuuguaucuuuuuuugguagagacgaguucuguccuguugcccaggcuugucucaaacucuugggcucaaacaaucugccugccuaggccucccaaguuguaagcaauguuaauugcuccuaauucuaaaaauauguaaauuggcugggcgcgguggcucacaucuguaaucccagcacuuugggaggccgaggcgggcagaucacaaggucaagagaucgagaccauccuggccaccauggugaaaccgugucucuacuaaaaguacaaaaauuagauaaaugcauagaaaagaauuagcaggcugguuaugguggguuaaggggaucucuugagcccaggaguuugaggcugcagugaucugugacugagccacugcacucuagccuaggugauagagugagauucugguuuuuuguuuuuuuuuuuuaaagaaucagcaggaauugaacuguggcugcugaguuucucuagguuugaguugcaugggugauuuugcauuuagggcagcggugccucugguuuggagggauuuucauucuucuauucccuggcaggacucugaugccaggagucucauucauucugggccuuagcauuguggauuaccccauaggggucucauggcuuaagcugaauuaaauguuaaagggaugauuuuacuuguguuaacuuuuuuuggcauauuauuacaagaguacuuuucucccuguaacugagaauucagcacaggaaucauguggaagaccucggugccuucccccaaugccugcugcggucccagugcugacagugggguccgcucuucccgcccucuuggaucuccugcaggcauaaccaggcugucauuaauauccacgccauugccacuggccugggaagucggucccuugcaucugugugucuuccucuuggucucagcaccuguucuugccucugucucguuuuuccugagccuuagagagcaucacuuuuccuuuccaucacgagugauucuccagccuugcuacggagcuuccuaaggaucacacaguuuacagaucugaguuaggcagcugcguuauuaagcaccccaggagguccagaugcauguaggugcuacacauuauucucuggggcugucuagucuucagauccagggccugugaugccaucaaacccgccugccagggagagcucugguggacgucacaguuggaaugcgucgugcggcagggcccaggaagccagcagguggcucaugguccucggccccuuucugggccuccaccuuccuuucucugccugugcuguccugacgugucuuccccagcgguacccaguggaggcaguggagaggaacaccaggcagggcgucucgucucagccaagccuuucucucugcuagcaaucuugaggacagagggaaggccugucugaauguuuacacgugcugcauuuuguagcugacaugcacacucaggccauacguucuggugguggugcuggucacauaacucccuaacugcaagacugccuugcgcuggaggagaccuaggaucguugauaucaucugcguggacuuuaaggcuggcauguuugcagacaguggcgccugcccgcacuuagguucccaucagagcguguaaccaugggagaguggggggcacggcugucuuggggcucaucgaggcugccugucauguuugcuuuuucuuuccucagacagaucgaggagcugcuagagcugcugaugacugagauccugcaccccagcagccaggcccccaacggugugaagagccacuucaucgagaucuuccuggaggagcugaccaaagugggcgccgaggaggugaggcugggcuccgacggggcgguggagcugggcguuuguggaggaggaacugagcucccgcuggcuuuccccguagcuuacggcagaccagaaccugaaguucaucgaccccuucugcagaauugcugcccggaccaaggaguaagugguggguggccugaucgggcccgacuccuucacugaguucuuccauggggcugcuguugugggggugcugcucccucgagggaugaaucugucucagaguggccgcuggccguguggguggggagagguugcaggggagucggcggcuuccgcuugggaauccagcauaacgggccugcucaccggccucugcucugccccucaguuccuugguuuugaacaacaucacucgaggcaucuuugagacgauuguggagcaggccccgcuugccauugaagaccuccugaaugaacuggacacacaggaugaggagguggcgucggacagugaugaguccucugaggguggugagcguggagacgcgcugucccagaagaggucugagaagccgcccgcaggugggggucacacugcgccuggcuucuccucggggccuguccugggcugagccagugcgaucuccugcuggguugcuccugccaccuccuaccugguccccuugucucugccccucuccacaguccauccucagcauagaagccagagugacuucugugggcaccaagcacacgucguuuccccucaucccccagccucugaugugcuccacgcccucuccggaccccugggcuccucggucuaacgcaugccucuggcucaguuggcccccuagacucguuccugccuuggugccgagucucuccgucccucccaccgucucuccccccaucacucucuggggcuggacucuuucagccuccuggccucucccagcccccaacgcaguccuccccauagcgucacucuguggcacgggaugugaaucacuugcuccucguguuccucguuccuggcccgucuccccagaggacagcaagcucuguccauauugaccaugacuggguucaggccugagaccucagggcaccugacugcucugugugcagugugugugaggggcagguguacucaccugccccucacugccugccagaggccucugugggcagccgugggguccagccuggcccauuuuuuguuuugaugcugcacucauuguccgagccugcuggguggucugagcucuaaguguggcauccuggugcuguggagggcaugucuuugaccacgcucaggaccccaguaugccccaaaucagugcuguggccacuguuccccuuggcuuccuaaucagaagacccccuccccaccgcccccagcacuuggcccggccacccuguaugcuucucccuggucucugccuugcccuucucucucaguagcugaggugccuggcagguccgcuagugccugcugcuggcccccugcugccagcuacagagcagacccuugucacaugcugccccacagcugccuguugcccaaaaaccuuucuucugcagacagugccaucaaagccccaaaugcccagccuagcucgagcacccagccgaaacaucagcucccacagcuucuggaccaggccacccugaggcuccucacuuccagaacuuuugacauggccuuuguugcccaagaugccagcuuguagucagccacucagggcuguguaggcaccugugcccugggacaucuuuuuuuccuuugcaggccugagguggcaccucucauccuguccauacgagauuagaggucacauggcaccuaguaucugccuugagcugugggcuuucccgccugugcccauguucugaccagggugcagggugggcuguccguucccggguguuucccgccugugcccgugcuccgaccagggugcacggagcgggcucuccauuccuggauguuuggggccagcacacguugggcacagguaggguucacggggucccuuuuguuccaggcuccaucugcagggcugaaccugaggcuggugaggagcaggcaggugacgacagggacaguggcggccccguucuccagguggguucccugggcucauggcugugcccucagccuuugccccucugugcuaccgcuugcucuggaagaggaggggggcguuaggagggaggauggcagcuguuggcauggagaguuacccggacagggguuagcuuugaaggagggaugggugccccaacccugcccgccuguagacgagugggaucauugagaguggggcuggggccugggaaaguggggcuggggccugggagggugggcucaggcagaacugcauuauccagggcuggccucaccucacgcuguccucuugccucacacaugggcagccccccagauuuccugcggcccccucguuggggugcugguggggaaugagauggcaugugccaagcggcuggccugugggucccagcgaggaauccacucagccaguggggucugacuucaggcaaauuggaaacuuaaauguuuuaaguuuuaaauaugauuaucugcagacugaauaaaauguggcuaucuuggguuaaaauugaucaauuuaaccuauguuguucgugcuugucugugugguuccuagagugguaaagcugcaggcaggcuaccggcgggcgugugcccugcagugugccccgcagugugcaucuuccagagugugccccgcagugcgugccccgcagugcgcccgcagcuuguguggugcccgcugugcuguagaguggguggagcugcaggacccucagugagggugggcuguguuccugugagccggguggagaaccugcaagugggaccaagugcuaucugggucucagggguuccacguucucggagcacgcagagcguggcugaccuugccucugugacgucucucuuuugaaacaguuugacuacgaggcaguugcuaacagacuguuugaaauggccagccgccagagcaccccuucucagaacagaaagcgucucuacaaagugauccggaagugagugugugagggcgcugcguccucccugcuccccuuggaguugcccuuucuugcucagaucugggugccuuugccuuguccugggcccuuccgcagcccccggggugauccccgcuaggacccugagaccguccccagccccugggguuccccuggcuaggaaccugcagccgcucuagcuggagcuuccuccuccugcggaagccgcagcugugguaaguggguaucugucuuacucuuucaggcugcaggaccuggcaggaggugaggaucggccgggcacugacaauggcaccaccuuggagguggagcuccauccucgugggagugguuugguucuaggggucucauagcacguggagucucuuugcagagaggccuggugguguuucugagggacagggaggcagggcgcaggguuccacagcucucguuuuugugguuuuugcugagugguucucagacuugaguguccauuggagugccccagagccugagagauggggugcuggccucaggggcucccaagcacugaccgcggugcugcugcuggucuguugggcagcacacgucuguucuuggcagcgcguggcggauggaacuggcauagguuaucggaaggacgguuuccuagugggcgucgaugguuagagacguaggcguuuccccugguguuuccuuaugaaaaguuucagaccugcaacucaguuggaaggauuuuauaguggaugucugcgugucccugccggccuccagcaucagcacuuccuguccuugcgugaagcuccucuaucccagcaucacaccccugcauccgccagcgggcgcgucaucagcuguaguccaggguuugguuuuuuuauuuuuuauuuuuugaggcggugucucgcucuguugcccaggauggcgugcaguggugugaugcagcucacugcagccucgaucuccuggucucaagcgauccucccgccucagccucccagucgcugggaccacaggcgcacgccaccacgccggcuaauuguuguauuuuuuguagagacaggguuucgcuguguugcccggcuggucgucugggguuuucgggacagcgcgcgucagugaggugcgugaggaucgugugcaucuggcagguuuugaugcagaaaguugccuugggccgccagcaugagcauuguaggcuguagacuuugguguacagguugagcgucucuaaucugaaaccccaaauccaaaaugccaccaaguccaaagcugagugcugacaggaagcuccagggaaaugcucgucgcaguguuuucuguuugggguuuucaggugagggcuguugaacuggugaauaugaugcagacguuccaaaacaaccugacauucaaagcacugcuggucccaggcauuuggggucguggacgcucuaugcuguaccuguguccuggaugcuccaggaacuggcuuuuccagaugggcuugggucucagcugguucguuucagcuguggcggguacugaacacgcugcuccugggcauuagaacagggcgcuuucucacacacauugucaggagguggugcuggcuggggccugcuggaagcagcgagccucaaaccauaaguccccagcccccgagagcccccugacuucugcccugguucucaggcauuuucccugaagaugagaucccagagaaggccugcaggcgccugcuugaagggaggcggcagaagaagacgaagaagcagaagcgucugcucagguugcagcaggagagagguaggacuaggggguguguuagucauggagccggcguccucaccugcuugcuucuccccuggaugggggucaccugcagugucucccccugaagcaugagugccgagucccccauccugggugccugcuauccacgcaucccggaaaugcccuguccucggcaucccuccuguaggccucucccugccucccccacccaccuuccuugucugcagcucccccgagcugugugcgcugcccucccucccggucuggagacauccuccuggcugggcugccuccuuccgugccuccgucuuagauccaagccccguccgcuccucucccgcacccuccagagauuccugagucucuccacgucuuccuuccccuucuucccuccacuucuucccuccacuucuguccuugauuucuggggcugccuuccguguugggccucuggccacacgagugugguuggcaugugaugcccucaccaggggcaacccuggguccgcggcagaccacucagggccuggagcugccuaccugcaguggaggggguugagcacagugccgggcagggcagggggcccauggcaagaauggggugcagaggaggcacaugguggcuuugccccacacugggaagccuucccuguuacucucuccaugcuaaacuggccccagggccuagggauucaccccuucccuugcccagagcuccgugccauugaagccguccaucucauuucccaugaggcaguggccuccucuuuguagccggcccuuggcugugugaacccugucggcccuggcguucaggaccuggcacugccuggcguccuguucuuccaccuccccuucugccuugagcccaguccugccuacuccucugugccuuugcuccugggucucaugacccuguccucacgcugguccuucugaggucagcccuugcugagguccugagccguguggauggagcuuggcgcccacacuggacacgggaugcgucuggcuggcuguuguggccguguuguccucccaggucuguggugcuggcauccucagccugaguuggaguaaguggaaagagcccguguuggcauucucuggcucauggggucuugcuguuuugucagggaaaggugagaaggagcccccgagcccgggcauggagaggaagaggagcaggaggagggguguaggggccgaccccgaggcgcgggcagaggcuggugagcagccaggcacagcugagcgggcccugcuccgagaucagcccaggggccguggccagagaggggcucgccagagaaggaggacaccucggccccugaccagugcccgagcaaaggcggccaauguccaggagccggagaagaagaagaaacgcagggagugauguggccgggccaaggacaggcagggagggaggccaggccucgcuugcaccgcgggacgaggcugaccgggcuguucuguagacucaggaccguggcuccagaacuccugugccaggcgggagggaagggcggcacuggagagaugggcccaucauuaggggccagcaucccaggaacuggaccuuuccccagagccuccgccuguggcu

SEQ ID NO: 16305 - RNA, 9014 nt, Homo sapiens
ccuggugaccuucgcuguccugucgcagggagaaggcagcgaugccuguggcccagcaccugaacccagugcaggugcugcagcugguggaggaaacgcuaccugacaacucaauucuggugguggauggcggggacuucgugggcacugcugcccaucugguacagccccgcggcccccugcgcuggcucgauccugguaaggaagggcccccgccuggggcagugggcaccauccaucaggacgccuucacacccaccugcucuugguccucuuaggggccuuugggacucugggaguuggugcaggauuugcacuuggggccaagcugugccggccagaugcugaggugaggcacuggaguugggagacuugcugcucucuagguccugauccacccuaaccauccuggguccccucccgacuaggucuggugccuguuuggggacggagcuuuuggcuacagccucaucgaauuugauacauucgucagacacaaggugacugggcuggccugagggaagcuuagggccugggguucugggagaugucaccaggggugggcugagguggggagggagccuccucucuggcagaggcccuaucccugucucuguccucuggcuggccaagccauggggcugaaggcugcggccugccuucaucaucuuccuguagaucccagugauggccuugguagggaaugaugcuggcuggacacagauuucucgggagcaggugcccucucugggcagcaacguggccuguggccuggccuacacuggugagggggccucagcgagguugggaggacaggaggcuguuucagucccagcugggcuuguguuccucuccugggcuggcugcaugugcggugggcugaguccuugccacuauccgacuuaaucucuucuuuuagauuaucacaaggcagccaugggucugggggcccggggcuugcugcucucacgggagaacgaggaucagguggucaaggugcugcacgaugcccagcagcagugccgagacggccacccgguuguggucaacauccucauugggaggacggacuuccgcgauggcuccauugcuguauagggccuugugggucaggacgcuuggcugccuuccugccccuggacuguguccagcugguuuggagucucaucauugcuugcccugggccuaucccaugaggcccagugacuccacaaccucccugaggaggggauggaggggucaaaucucagagaggcucucuugugagcucuuggacccuccucuucacggacccaacugugccguuuguccccucucuuauggagacugaauaaaccaccucuggcccauguaggcccaaguacucagucucagaaccugugcauauuuauuuauuauccacaaagauggaggugcggaaaagaagagggagacaggagggaaccguacucucccacuggaacucuggggcccacugaggcaccauuauuggggauuucaggguggcugggcacugcaaacugcucccuccucuguggucccugaaagagccccacacgccugcuucagacguguccacgcacaccaguccucacagacacacacacacaugcauggaggcaauaaauauguuccguaccagacugcccccagccugacgcuucagggggcccccuccaaaagggagggguuuaagugcucaauuuuuuucgggggggggggcaaggggggggcaaggagauggggauuggaaaggccagacucuguuaucuccauuugcugacuagaggccaaucguggggacuuccccggaaaaggguaggggaaaccagcuguuucucuauaagccccaggcuaccccuguguccaugcuggaacccaggauaggggcugccccccacaaacagugccucaugcuagucuuugugucguccaagggagggagaaacagugcagugcucaaagcuaauacugauuugguuggcagcagcaagagggccgacuagaggugacucaccacaccagggugaugcucacaguaacugguguugccccggccaaggggaggcaagagaggccagccuagcaagcgcgagaacuaccuuuuuggcaacaaaaggggaagcccuuggugcucaggaaagauggucacaaccgcuggucccuaaaauccccaggccccagacuuggcaacuaguguccaaauaccgggcccuggaaacugggaaugagucucagccauacacgcgacuggucccgugguaacucgcuggcaaccaggagcucggccugagcaacaggucuggcucuccuuggucaccagggcaccgccuuagccacugggcgcccgguccuuacuaaccggggucccaccccgucaucuggcucagaggcacacguugauuugcuuggagagcucucucuccagauccaggaugagggcgucgaagucuuugagauucaggugcggguugaagggcgcaucgaagucgucuucgaagucaccggugacccucggcucgccgaccuccucguccucguccucgcugucacugcccgucacguggucguagucuggcccggacaggaaaucccgcccacagggcaggaagucccgcccgcaaacgcuccagucgccggcguagcgguugcucggggggcuuucggggccuccucgaccgcggggccgagucaccacuucggggucugccagcggcaggugcagagguggcugucguuugggucgcaaguaaggcgcgacaucuggagauugucggggcaggcggggaucugaagggagacaggguaggucauagaaagaggcgacagccgaccucugauuggcugcuuagggaacuaggcuccugauuggccuguggaaagcggccuucgacccuuucagguuuucacuggcagagcuaggacugguugcuuacgcaacuaggccucugauuggcaugucaagaggcagggccucugacugcaucaaagauggguaggggcaggucuguggaucaugccuggaucaugccuguaaucccagcacuuugggaggccugaggcaggcggaucacuugaggucaggaguucaagaccagccuggccaacaccgugaagccccaucuccacuaaaaauacaaaaauuagcuaggauugguagugcaugccuguaaucccagcacuuugagaggccugaaauggguggaucacuugaggucaggaguucaagaccagccuggccaacacagugaaacccugcucuacuuaaaauauaaaaauuagccaggacugguggugcgugccuauaaucccagcuacucgggaggcugaggugggagaaucccuugaaccugggaggcagagguugcagugagcugagaucaugccaccacaccccagccugggcuagagagcaagacuccaucucaaaaaaaauaaaaaauaaaaauaaaaagaugaaucagcucuguggggcaaggugauuugguuuauaaucccaguacuuugggaggcugaggcggaaggauggcuugagaucaugcguuugagaccagcuugggcaauauagagaaacccugucuuuacaaaaaaaugaaaauaaaaaaagacaaaacagacagauugguuggaucugaacugguugcugaggcaaccagguaccaguuuacuccaugagggggcguagcuucaagccuaagacacugauuggucccuuaagguggcaucacuguagcagccuggcucagauugguggugcaggcccugggcaugaacucaccuggccaagacugcagcagguagugcagcaccucgauguggugcuugaaguccacugcacuggcaaggccugggccggagcugcgggcacgaggccuugugggcgccuggcgugccggcagcagcacaggcccgaagcacacggccaaguucuguggggucaugcgguuguaggcauggaaggaggagacgaggcgcaggugguccaggagaagcgucagcguggccugggagaggguugagaggauguaagucagacaaagucaggccccuguggcaccuaccugcaagagacuaagguggcuagaguagggaagcagguucacagucucauagcugggauguggucggguuaagacuauuaaucauuagauguuaguauuaugagccuauuuuguuggagggaagacugaagccaaaggcaacuaagcauuggaaaagcagagcugccaugaaucucauuuuacagaugaagauauugaagcacagagagggaugggacuugucuagguucccucagccaggaaccucccuuguagguugaaagaucagcguucagccugcauuuuugacacauccuggcugugugaccuugggcaacugucaccugcuuugggccucaguuuccaaaucuaugaagugggaugcuaauagcaccuauuucuuggggauaugaugaugcugccagcucaugcccaucucaggcccaggcaugggugaaacauucuauugguaucagcccacucucaagucccaucacucccaccaggcccaacucacccuuuccacaucuggcaggcagcugaggagcccucgggugcccucagugguggggggaacucuguuuggggggucccgggccauggccuccaguaccaccuuauacaggggcugggugaugaguggggugggcaacucucgaagauaauccuugaggaugccugugaacacaggguccccucuggucagggcaccacuggcuucuaaggcuaaggagggcacagcuaagggggaagaggaggugggugaaagcaaggucagauaggaggacugaggucccagaggagccccaaggccuugaagugaggcauugaaugggggugagcaggcaggggagagggggccaugcugaccagugaugacauugauaucgggguacagguccucagauaggcagaccgcugcacugucccgcucaaaggcaucccgaagcucuuucuucacugccgcugagccacaaagacgguacagucccacuaccugggggugggaagagagagugaaugucuucuugccggggccacagacuaaucagggcccaguggggugagcacuggaauucugggccaggcagcaaugggcauugugggcugggagguuggaacuaccuugacaaccuggccuuguaaacccucugcuuggacuacuugucuuggcugccaucuccuuugacuuaggaaacugacacuucuuugaggaggcuuuccaugacuaccccagguuuuguuuuaagcucucccagacccuagguacaccccaccccaacuccagucccaguuauaguuuuacauuugugaaugacuagagucguaucuuuucccccaucagacucugagccccaggagggcuuggauccuguuuuuaaaucaauggaugacccauggguucugcccagggugcuacagucaagggggcgccuucugcccuugucuagguugggauuggagcuaggaguggcucaggccuggggguaggggucuggcaucuguacauaggguguccugaagaguggucugaggucugggggccagaggguugggguggggugggugcucacccgcagcccucggcgcucgaucugcccaacgcacuucuggaugaugaggggcaccuggccggggggccgcucccgcuccaccagcaguggcaggggcagcccaaagacgcggggcucagcuguggcaggggcuuccugcugcuccgacagggucagcuuggcauacagcagccccugaggcuccaggcgcacggccagcuguugggccuggcacccugaggacacaagggggccugagccgggugugcucugaagcuucauguacccuggccucgcugcuccaggccacaccuuccgcccggagcccagcccccuaggcacucugcgggggguggcggugggguuugggggucccugccccuccuccccugcagccgcauguccuaccucggaagaccgugggcagcagcacggugcccugggcacagggccggugccuucucacgccagggucccacgcaagcaccagggcgcgcaggagccuggcggccuccagcuccagguggaaggugugguccagccgcaggaaguccggccccccucgcaguggcccuguucgggcccuggccuccccauccacuugcaguaggcagcagaggucccuggggguggcccccggcgcuggccgcagccccccgagaccguacaggugcaggcugaggcggccccagagugcggccgggggugcccgggcugcgggacccaccucguagggccggaaggaggugggugaugggggcccagcugggcgcuccggugaguccccgucgcugagguaaccggcccucgggcuccgggugcccccaggcccugcugccggcccggggccccccacgcugcuguccaggugguagcggcugaugacggagcccgcaggggcagcccucucgcgcucccugccagcccgggggccucgcaggcucaggcggcgccgcaguuccggcagcuucuucaucuuuauggagaggcgccuggcggggcccggggacuuggugcgggaggcuuugguuggggggcuggcgggggcugcaccuguguggagagcagacuucaggguccaggaaccugggcuuaggggaggggggugaggcuggugcuccccugaagggaaggagugugaggcugguguuccccuggcggggaggagggugugaggcugaugcuccucugggagcaucugacgggguggggaugugaggcuggugcuccccugaagggaaggagugugagguuggugcuccucugggaggagggagugugaggcuggugcuacccugaagggaagggauguggagcuggugcucaccuuggggaaggggaugggaagcuuguucuuaccuuggggggccaggcccucugacucagcugagccaggcuguggccccgggggcucaggugcuggaggucuggggucuuccucagggaugggguuguaccagaucucgccggcgggcuccccagugccagguaccccaggcccuaaagagguguccucagcuggcuuggccccacccagcacccaucggcggcuacugggcuccaggcuuugcagguaggcuccccgugcagggcuccuugaugccucggggcuggagggccccucugcuccggccugggacccuucgggagccuggggcucuggcucuggagggcugggcucugggcgcugggcuggguggccuggcagagagcaaggggagugagacccacccagccccucacugccugcagagcagcccugugcaauugaucagugggugggaugcuguguacggcccuggccggccccugauaagucaugguuccuuggauccugcuguuuuguuuggaauaggcagccacaggcuagcgaucucaguuaucagcuuagagcacccccuacucagucccuggcaucccaaaaggggacuccaucccugcagccucaggguucuaagucaggcuuccuggggcccguagguacugcguuccagucuccacuuccucuacccucucaauaaccguggcauggagcuuugcaccugcguggccuugggcaagucgcuucccucucugaggcucaguauccuccugugaaauggggggaugugauuuccauguccagggaggcuuccaggagccuuuuggaaaaguauacagcccacagcaggcacuacgugcucaggagugaggagcuggguuuucuauucccugcagcacagucacucccaguccccugccccuuuuacccucccuccugucuuccaaacucugucgccauccugggaugggcccuugucccucagcccaggccagaccccccacgcucaaugcuuugggacuuccccuucccucccuccucuccugucucauguccugggcuguuuccuguguguguuuguguuugggcaucucugucccuucucccuucccugggaacauugggaaucuuugggaaggccuggggggaagggguacguccauggaauggucuggccuuccuccuuuaacuccuuccuuccugggucccccuaucccacgcagcuguuucucuaagguuuuuacuugcuacccugcugaacuccuccucuggccaccucugauguccacccucuagggucucuguuuguagcauaguccaaagagcuguuuaagucgauggcccugggcacaugacccaauugcuccgugccucaguuuccccaucuguauaaaagggacaguuuccuggggcuaaggcaggcgcaguugccgucacuguuaguaggugggaggcggagggggcagcuacucugauugacgggccgccccucucuuuccuuugcaggaguacgccucccaucucccauccugcgccuccagggcucccgaugccccuugcccagcccgacugggccccagugucccggccucccagccccuccuccccuccacccuccaggcccucagucgcggccccauuuccugucgugggcgaggcccccucccgggccucccaaggagcccgcagcgcuggcauccccggccagcagcacauaacgguccgcgccccccucccucccagccccuuccuuccaggaccccuacccuccccuggcuggaggcaccccagucugcagcggggugcggggggcucccccugaucccccccaccgucuguccucggggcccugggaccccgcucccaggccggguggggcucggcgcccccuguuccccaccgaucuccgcuuaccgcgcuccuuggcguccgacuuuuuccggggaaguuucucccggccccgcaggcgggagaagguuuuccugaguagcggcucggccaugcugcggcccgggccgggccgagccgagugcgcgccccgggcuccggccgcgccgccccgcgcccuccccgccccgcccgggccuccccgcccgcccc

SEQ ID NO: 16306 - RNA, 9014 nt, Homo sapiens
ggggcgggcggggaggcccgggcggggcggggagggcgcggggcggcgcggccggagcccggggcgcgcacucggcucggcccggcccgggccgcagcauggccgagccgcuacucaggaaaaccuucucccgccugcggggccgggagaaacuuccccggaaaaagucggacgccaaggagcgcgguaagcggagaucgguggggaacagggggcgccgagccccacccggccugggagcggggucccagggccccgaggacagacggugggggggaucagggggagccccccgcaccccgcugcagacuggggugccuccagccaggggaggguagggguccuggaaggaaggggcugggagggaggggggcgcggaccguuaugugcugcuggccggggaugccagcgcugcgggcuccuugggaggcccgggagggggccucgcccacgacaggaaauggggccgcgacugagggccuggaggguggaggggaggaggggcugggaggccgggacacuggggcccagucgggcugggcaaggggcaucgggagcccuggaggcgcaggaugggagaugggaggcguacuccugcaaaggaaagagaggggcggcccgucaaucagaguagcugcccccuccgccucccaccuacuaacagugacggcaacugcgccugccuuagccccaggaaacugucccuuuuauacagauggggaaacugaggcacggagcaauugggucaugugcccagggccaucgacuuaaacagcucuuuggacuaugcuacaaacagagacccuagaggguggacaucagagguggccagaggaggaguucagcaggguagcaaguaaaaaccuuagagaaacagcugcgugggauagggggacccaggaaggaaggaguuaaaggaggaaggccagaccauuccauggacguaccccuuccccccaggccuucccaaagauucccaauguucccagggaagggagaagggacagagaugcccaaacacaaacacacacaggaaacagcccaggacaugagacaggagaggagggagggaaggggaagucccaaagcauugagcguggggggucuggccugggcugagggacaagggcccaucccaggauggcgacagaguuuggaagacaggagggaggguaaaaggggcaggggacugggagugacugugcugcagggaauagaaaacccagcuccucacuccugagcacguagugccugcugugggcuguauacuuuuccaaaaggcuccuggaagccucccuggacauggaaaucacauccccccauuucacaggaggauacugagccucagagagggaagcgacuugcccaaggccacgcaggugcaaagcuccaugccacgguuauugagaggguagaggaaguggagacuggaacgcaguaccuacgggccccaggaagccugacuuagaacccugaggcugcagggauggaguccccuuuugggaugccagggacugaguagggggugcucuaagcugauaacugagaucgcuagccuguggcugccuauuccaaacaaaacagcaggauccaaggaaccaugacuuaucaggggccggccagggccguacacagcaucccacccacugaucaauugcacagggcugcucugcaggcagugaggggcugggugggucucacuccccuugcucucugccaggccacccagcccagcgcccagagcccagcccuccagagccagagccccaggcucccgaagggucccaggccggagcagaggggcccuccagccccgaggcaucaaggagcccugcacggggagccuaccugcaaagccuggagcccaguagccgccgaugggugcuggguggggccaagccagcugaggacaccucuuuagggccugggguaccuggcacuggggagcccgccggcgagaucugguacaaccccaucccugaggaagaccccagaccuccagcaccugagcccccggggccacagccuggcucagcugagucagagggccuggccccccaagguaagaacaagcuucccauccccuuccccaaggugagcaccagcuccacaucccuucccuucaggguagcaccagccucacacucccuccucccagaggagcaccaaccucacacuccuucccuucaggggagcaccagccucacauccccaccccgucagaugcucccagaggagcaucagccucacacccuccuccccgccaggggaacaccagccucacacuccuucccuucaggggagcaccagccucaccccccuccccuaagcccagguuccuggacccugaagucugcucuccacacaggugcagcccccgccagccccccaaccaaagccucccgcaccaaguccccgggccccgccaggcgccucuccauaaagaugaagaagcugccggaacugcggcgccgccugagccugcgaggcccccgggcuggcagggagcgcgagagggcugccccugcgggcuccgucaucagccgcuaccaccuggacagcagcguggggggccccgggccggcagcagggccugggggcacccggagcccgagggccgguuaccucagcgacggggacucaccggagcgcccagcugggcccccaucacccaccuccuuccggcccuacgaggugggucccgcagcccgggcacccccggccgcacucuggggccgccucagccugcaccuguacggucucggggggcugcggccagcgccgggggccacccccagggaccucugcugccuacugcaaguggauggggaggccagggcccgaacagggccacugcgaggggggccggacuuccugcggcuggaccacaccuuccaccuggagcuggaggccgccaggcuccugcgcgcccuggugcuugcgugggacccuggcgugagaaggcaccggcccugugcccagggcaccgugcugcugcccacggucuuccgagguaggacaugcggcugcaggggaggaggggcagggacccccaaaccccaccgccaccccccgcagagugccuagggggcugggcuccgggcggaagguguggccuggagcagcgaggccaggguacaugaagcuucagagcacacccggcucaggcccccuuguguccucagggugccaggcccaacagcuggccgugcgccuggagccucaggggcugcuguaugccaagcugacccugucggagcagcaggaagccccugccacagcugagccccgcgucuuugggcugccccugccacugcugguggagcgggagcggccccccggccaggugccccucaucauccagaagugcguugggcagaucgagcgccgagggcugcgggugagcacccaccccaccccaacccucuggcccccagaccucagaccacucuucaggacacccuauguacagaugccagaccccuacccccaggccugagccacuccuagcuccaaucccaaccuagacaagggcagaaggcgcccccuugacuguagcacccugggcagaacccaugggucauccauugauuuaaaaacaggauccaagcccuccuggggcucagagucugaugggggaaaagauacgacucuagucauucacaaauguaaaacuauaacugggacuggaguuggggugggguguaccuagggucugggagagcuuaaaacaaaaccugggguagucauggaaagccuccucaaagaagugucaguuuccuaagucaaaggagauggcagccaagacaaguaguccaagcagaggguuuacaaggccagguugucaagguaguuccaaccucccagcccacaaugcccauugcugccuggcccagaauuccagugcucaccccacugggcccugauuagucuguggccccggcaagaagacauucacucucucuucccacccccagguagugggacuguaccgucuuuguggcucagcggcagugaagaaagagcuucgggaugccuuugagcgggacagugcagcggucugccuaucugaggaccuguaccccgauaucaaugucaucacuggucagcauggcccccucuccccugccugcucacccccauucaaugccucacuucaaggccuuggggcuccucugggaccucaguccuccuaucugaccuugcuuucacccaccuccucuucccccuuagcugugcccuccuuagccuuagaagccaguggugcccugaccagaggggacccuguguucacaggcauccucaaggauuaucuucgagaguugcccaccccacucaucacccagccccuguauaaggugguacuggaggccauggcccgggaccccccaaacagaguuccccccaccacugagggcacccgagggcuccucagcugccugccagauguggaaagggugaguugggccuggugggagugaugggacuugagagugggcugauaccaauagaauguuucacccaugccugggccugagaugggcaugagcuggcagcaucaucauauccccaagaaauaggugcuauuagcaucccacuucauagauuuggaaacugaggcccaaagcaggugacaguugcccaaggucacacagccaggaugugucaaaaaugcaggcugaacgcugaucuuucaaccuacaagggagguuccuggcugagggaaccuagacaagucccaucccucucugugcuucaauaucuucaucuguaaaaugagauucauggcagcucugcuuuuccaaugcuuaguugccuuuggcuucagucuucccuccaacaaaauaggcucauaauacuaacaucuaaugauuaauagucuuaacccgaccacaucccagcuaugagacugugaaccugcuucccuacucuagccaccuuagucucuugcagguaggugccacaggggccugacuuugucugacuuacauccucucaacccucucccaggccacgcugacgcuucuccuggaccaccugcgccucgucuccuccuuccaugccuacaaccgcaugaccccacagaacuuggccgugugcuucgggccugugcugcugccggcacgccaggcgcccacaaggccucgugcccgcagcuccggcccaggccuugccagugcaguggacuucaagcaccacaucgaggugcugcacuaccugcugcagucuuggccaggugaguucaugcccagggccugcaccaccaaucugagccaggcugcuacagugaugccaccuuaagggaccaaucagugucuuaggcuugaagcuacgcccccucauggaguaaacugguaccugguugccucagcaaccaguucagauccaaccaaucugucuguuuugucuuuuuuuauuuucauuuuuuuguaaagacaggguuucucuauauugcccaagcuggucucaaacgcaugaucucaagccauccuuccgccucagccucccaaaguacugggauuauaaaccaaaucaccuugccccacagagcugauucaucuuuuuauuuuuauuuuuuauuuuuuuugagauggagucuugcucucuagcccaggcuggggugugguggcaugaucucagcucacugcaaccucugccucccagguucaagggauucucccaccucagccucccgaguagcugggauuauaggcacgcaccaccaguccuggcuaauuuuuauauuuuaaguagagcaggguuucacuguguuggccaggcuggucuugaacuccugaccucaagugauccacccauuucaggccucucaaagugcugggauuacaggcaugcacuaccaauccuagcuaauuuuuguauuuuuaguggagauggggcuucacgguguuggccaggcuggucuugaacuccugaccucaagugauccgccugccucaggccucccaaagugcugggauuacaggcaugauccaggcaugauccacagaccugccccuacccaucuuugaugcagucagaggcccugccucuugacaugccaaucagaggccuaguugcguaagcaaccaguccuagcucugccagugaaaaccugaaagggucgaaggccgcuuuccacaggccaaucaggagccuaguucccuaagcagccaaucagaggucggcugucgccucuuucuaugaccuacccugucucccuucagauccccgccugccccgacaaucuccagaugucgcgccuuacuugcgacccaaacgacagccaccucugcaccugccgcuggcagaccccgaaguggugacucggccccgcggucgaggaggccccgaaagccccccgagcaaccgcuacgccggcgacuggagcguuugcgggcgggacuuccugcccugugggcgggauuuccuguccgggccagacuacgaccacgugacgggcagugacagcgaggacgaggacgaggaggucggcgagccgagggucaccggugacuucgaagacgacuucgaugcgcccuucaacccgcaccugaaucucaaagacuucgacgcccucauccuggaucuggagagagagcucuccaagcaaaucaacgugugccucugagccagaugacggggugggaccccgguuaguaaggaccgggcgcccaguggcuaaggcggugcccuggugaccaaggagagccagaccuguugcucaggccgagcuccugguugccagcgaguuaccacgggaccagucgcguguauggcugagacucauucccaguuuccagggcccgguauuuggacacuaguugccaagucuggggccuggggauuuuagggaccagcgguugugaccaucuuuccugagcaccaagggcuuccccuuuuguugccaaaaagguaguucucgcgcuugcuaggcuggccucucuugccuccccuuggccggggcaacaccaguuacugugagcaucacccugguguggugagucaccucuagucggcccucuugcugcugccaaccaaaucaguauuagcuuugagcacugcacuguuucucccucccuuggacgacacaaagacuagcaugaggcacuguuuguggggggcagccccuauccuggguuccagcauggacacagggguagccuggggcuuauagagaaacagcugguuuccccuacccuuuuccggggaaguccccacgauuggccucuagucagcaaauggagauaacagagucuggccuuuccaauccccaucuccuugccccccccuugcccccccccccgaaaaaaauugagcacuuaaaccccucccuuuuggagggggcccccugaagcgucaggcugggggcagucugguacggaacauauuuauugccuccaugcaugugugugugugucugugaggacuggugugcguggacacgucugaagcaggcguguggggcucuuucagggaccacagaggagggagcaguuugcagugcccagccacccugaaauccccaauaauggugccucagugggccccagaguuccagugggagaguacgguucccuccugucucccucuucuuuuccgcaccuccaucuuuguggauaauaaauaaauaugcacagguucugagacugaguacuugggccuacaugggccagaggugguuuauucagucuccauaagagaggggacaaacggcacaguuggguccgugaagaggaggguccaagagcucacaagagagccucucugagauuugaccccuccauccccuccucagggagguuguggagucacugggccucaugggauaggcccagggcaagcaaugaugagacuccaaaccagcuggacacaguccaggggcaggaaggcagccaagcguccugacccacaaggcccuauacagcaauggagccaucgcggaaguccguccucccaaugaggauguugaccacaaccggguggccgucucggcacugcugcugggcaucgugcagcaccuugaccaccugauccucguucucccgugagagcagcaagccccgggcccccagacccauggcugccuugugauaaucuaaaagaagagauuaagucggauaguggcaaggacucagcccaccgcacaugcagccagcccaggagaggaacacaagcccagcugggacugaaacagccuccuguccucccaaccucgcugaggcccccucaccaguguaggccaggccacaggccacguugcugcccagagagggcaccugcucccgagaaaucuguguccagccagcaucauucccuaccaaggccaucacugggaucuacaggaagaugaugaaggcaggccgcagccuucagccccauggcuuggccagccagaggacagagacagggauagggccucugccagagaggaggcucccuccccaccucagcccaccccuggugacaucucccagaaccccaggcccuaagcuucccucaggccagcccagucaccuugugucugacgaauguaucaaauucgaugaggcuguagccaaaagcuccguccccaaacaggcaccagaccuagucgggaggggacccaggaugguuaggguggaucaggaccuagagagcagcaagucucccaacuccagugccucaccucagcaucuggccggcacagcuuggccccaagugcaaauccugcaccaacucccagagucccaaaggccccuaagaggaccaagagcaggugggugugaaggcguccugauggauggugcccacugccccaggcgggggcccuuccuuaccaggaucgagccagcgcagggggccgcggggcuguaccagaugggcagcagugcccacgaaguccccgccauccaccaccagaauugaguugucagguagcguuuccuccaccagcugcagcaccugcacuggguucaggugcugggccacaggcaucgcugccuucucccugcgacaggacagcgaaggucaccagg

SEQ ID NO: 16307 - RNA, 16392 nt, Homo sapiens
ggcgcaugcgcaggcgcgggccggugggguggccuggagcggcgugcguaaugucggcacuuugcuggggccgcggagcggcggggcucaaacgagcccuacggccuugcggccgcccgggacuccccggcaaagaagguaacacaaagggagacggccaggcagcccgggggccacggcgugggcuccuccccgcgcggccggggccuuuggcgcuuugaccuuugccucuuugcaccugggcgugcgcagcccaccgacccggccccgcuuuccacucgcccuugcccgcuuuucgacugaggcuccuccgugcagucugaccuuugacucgugguuucuuaugcagccuccugaccccaggugugguguuuagggcucuuaaccuuugaccugcugcaccucgagugcgaggaacccucucucggcgguuccgcgcccguguucgccgcggcggggcccuuccaccuucgcugucuuaguuucuuuccaacuuaagcccgugcuccgagaguuuccgcugcguuuagggcuccuuugcccuucgacccuucggcuucugccuuuauggaggcccccgcccacacgcccggccccgcucagccgcucucgucuuucccgcagggaccgccgguggcgucugcggccccaggaggagcucguccgccagcccccaggagcaagaccaagaccgcaggaaggacuggggccacguggagcugcuggagggugagcgcgacccccacggcggcccgggagaggagaguccgcucccugcugccgggagaaaaggcaaaggcucagauucugagacaggcugagggcggucuccaccucucgggucccaggacacgcccagacggcguugcugaaacaucucuugcaccgcucaugggcccuguccuugcugagcaggcuccuuccuggagcucucguaauucccccuccccagaaccccaccaggugcucccacuuuccagggacauaggugaggcccaagauuaugucuggagagaccccccccccggccccgccgccaaggccacaugugcagagccaggaugugaacccugaacugacucagcuguccuggcuuggcucugggggguaggcgccuaauggagacuggaugacugcgaaacuugggagggacagcccaggcuccagcgguggcaggcccucguccuggccuggcugguggugugggagggaggugggagcuucccugugcuugcuucccgccggugcuucugucccacauccugucugcguccauuaggcagccgggaagggagaggcgggagaaccuuuauaaagggaaaaaaccuggccaggugcgguggcucacgccuguaaucccagcacuuuuggguggccgaggugggcggaucaagaggucggggguucgaggccuggugcgguggcucacgccuguacucccagcacuuuuggguggccaaggugggcggaucaagaggucaaggguccgaggccuggugcgguggcucacgccuguaaucccagcacuuugggaggccgaggcgggcggaucaagaggucaugaguucaagaccagccuggccaacauggugaaacacugucucuacuaaaaauacaaaaauuagcugggcaugguggugaacgccugcagugccagcuacucaggaggcugaggcaggaaaaucgcuugaacccggggagacugagacaggagaaucgcuugaacccggaagguggagguugcggugagccgagaucaugccauugcacucuagccugggcaacgagggaaauuccaucucaaaaacaaaacaaaacaaaacaaagcucucaacuguuaauccuaaaaguaucuccugaguuuuggagcacucugaaggcggacaucacgcuugucuuuuuauuucagcaauuuuuuuuuucuugagacggauucucaaucuguugcuaggcuggagugcaauggugcgaucuuggcucacugcagccuccgccucccgaguucaagcaauucuccugccucaaccucccgaguagcuggaacuacaggcgcgcaccaccacgcccgguuaauuuuucguauuuuuaguagggacgggguuucaccguguuagccaggauggucuugaucuccugaccucgugauccgccugccucggccuccuaaagugcugggauuacaggcgugagccaccacaucuggacaccugggucccccccccccuuuuuuuuuuugagacaggguccugcucugucucucaggcugcagcacgguggccugaucacggcucacagcagccaggaacuccuaggcuuaggugauucuuucaccucagccaccggaguagcugggaccacaggugcgcggcccuguacccggcuuauuucaacagucuuuuuuuuuuagauggauuauuguucuguugcccaggcuggaguucaauggcgcuaucuugagucacugcaaccucugccucccaggcucaagcaauucuccugccucagccucccaaguagcugguacuauagacacaugccaccacgcccagcuaauuuuuuggauuucuaauagagacgggguuucaccauguuggccaggcuggucucgaacuccugaccuuaggugaucuuccugccucggccucccaaagugcugggaugaccgacgugagccgccaugcccggccagcaauagauuuccaacaaggcuucuuuaaagagauacagaacacuuaggcauugauugguuggcaaaaaugcaaccugaggcggcacgagcaggagccgcguuuucccugcgagcuaguggcucagcguccaccgguguagacacugggagccuaggaguguguguguggcagcuccaccagcugggggggucuugcugaggcggggugcgaacuugcaggccaugguugagccagggagugggcgguucaggguccugggagucugugcagaggcccugagcuagacagugagaggggcaggggaggcgggggccaccuggauagauucuggaggcaagcccagaggagguacugagagguggacggagggaguugucacagaccccggguucugggccugugcaccuggagggucugagcggccagugaccggggagacguggugcugcagguuucgguggcagcuuguuagggcugcugaguucugugaggcucggguggggaggugcggaggugguggggugcgugugucuggaaagcagcgggcagaccuuacaacguuguuggcaaguaugaggaauucacgccuugggucccagcgagcucagccaccugcaccuccuggccuggcucaggguccagagagacgggugcucgaauggggagggggucccucucauguccucgccuucugccccucacagugcuccaggcgcgggugcggcagcugcaggcugagagcgugucggaggugguggugaacaggguggauguggcgcggcucccagaauguggcaguggagaugguagccuccagccacccaggaagguccagaugggggccaaggaugccaccccggugcccuguggccgcugggcaaagauacuggagaaggauaagcggacccagcagaugcguaugcagcgguugaaggcgaagcugcagaugccauuccagagcggggaguucaaggcgcugaccaggcgccugcagguggagccccggcuccugagcaagcagauggccgggugccuggaggacugcacgcgccaggcccccgagagccccugggaggagcagcuggcccggcugcugcaggaggccccugggaagcugagccucgauguggagcaggccccgucggggcagcacucgcaggcccagcucucaggucagcagcagaggcuccuggccuucuucaagugcugccugcucacugaccagcugccccucgcccaccaccugcuggucguccaccacggccagcggcagaagcggaagcugcucacgcuggacauguacaacgccgugaugcuuggcugggcgcggcaggugagugcagccgggagccgggccaccugcccuggucguuggagacaggaacuugcccucauuuagacuggacuuuucucucuuagcccccagguucaaguccuuuguuuuuuauuuuaauaauucuuuuaggcuuuucaaauacaaaucacgugugacucucaaauuuugaaaaugaccaaaaaaguagggagaaauucugcuaaugccuugagcauuuccuuccguucuuucucggggcucgugaaucugucugggcaggggugcuuuuggccucgucggggggcagccugcagagcccucgucaggaugaggcuuugguguugggguugacuuugcuccuuuuucugguuuccugagguggaaggucgggcugcugugcugagauccuucugugugaaauguggguguucacuggcgccgcauucccucugagcacagcuuuagauguaucccacccaucuucguugugguucaucuggaguauuuuccaauuucccuugccguuuucuuuuuguuuguuuauuuauuuguuuucugggacauacucucccuguuacuagguuggagugcgguggugcgaucucggcucauggccaccuccaccucccagguucaagugauuauccugccucagccuccuaaguagcuggaguuacaggugcccgccaccacccccgauuaauuuuuguauuuugaguagagacggggguuucaccguguuggccaagcuggucucaaacuccugaccucgugaucugccccccugagccucccgaggagcugagauuacaggcgugagccaccguauccggccaaaguuucuccucggaacucuugguuguuuuggaggguguuguuuacacacccuuucaaagcagcaaacguucccagcuuucuccccccccaugauccuucagcccuaauuugagaaacaacaguaaaagcuucucuuaauauuuggguaaacaugggauacuauuauauuaaaauacagauaucgcaauauuaagaccaauucgugguagagaacuugaugugcuucuuuauuaacgcaucaaacagcgaaauucaggaucagguggggccagucuugcggugaaguccgcagugcucuuaccgcgagguggaggcggcgugcugccugguuccuccuugcugcagggggcgccagacuccgggaggacugaggaugagggucguguauuuuccccuccaaggucacaagcccccuggauucccugggcagagagcccacacuguaacagggcgcuuuugggaucggccccuacgaaagugucccaaaccuggcggcuugcacagcagaaacgcacucuuagcacgagcccagaagucuggaaucaagaugucugcagacccgaagucucuccagaggcucuagcaggggccccuccugccucucccagcguuccgggguggccagcaguccuggaugucgcuggacugcgagcucagccucccgagcagcugggauuacaggcgugugccaccacccccggauaauuguuuuaauuuuuauuuuuaguagaggugggguuucagcauguuagccaggcuaaggcauugcuucuaucuuuuuuuuuuuuuuuuuuuugagauagacucucugucuguugcccaggcuagggugcagugccaugaucucggcucacuacagccuccgccuccuggguucaauaauucucccugccgcagccuccugaguggcugggauuacagggacucaccaccacgcccggccaauuuuuguauuuuuaguagagacgggcuuuugccauguuggccgggcuggucucaaacuccugaccucagguaauccgcccgccucagccucccuaagugcugggauuacaggcgugagcgaccgcgcccggccacguauucuaaccagcaccauccaguagaacuuucuaugauguugggaauuuuccgcaucugccaacagcugugugugcuacugaacacuugaagcuggugaaagggaagaacugaauauuucaauuuaaggacuauguguggccagugaggucuaccauacagagguuguuuagaaacugccccaaaaccggccgggcacaguggcucacgccuguaaucccagcacuuugggaggcugaggcgggcggaucacgaggucaggagaugagaccauccuggcuaacacagugaaaccccgucucuacuaaaaauauacaaaaaauuagccgggugugguggcgggcgccugcagucccagcuacuugggaggcugaggcaggaggauggagugaaccugggaggcagagcuugcagugagccgagaucgagccacugcacuccagccugggcgacagagcgagacuccgucucaaaaaaaaaaaaaaaaaaaaaugccccaaaacucaugucucuggucucugguguguggccaccucaugucacagcaugucuucagcugcaggacuauggggugggaggauguaagggaauuuuuuucccuuuggaauagucuguuacaguuacaggccacucuuaagcagccacugggucaaaggagaaauugcucagaacagggaugucaggaaaaaugaauacaagaaaaaaauuauauauauauguuauuuuauauauauauauauauguguguguguguauauuuuaagacagagucuccaagucugucgacagcaaaguuucugucucccaggcuggagugcaguggugagaucccggcuuaccgcaauuuccgcuuucugcguucaagugauucuccugccccaggcucccaguagcugagauuacaggcaugugccaccacgcccagcuaauuuuuuuuuuuuuuuguauuuuuaguggagggagcacaggcaugagccaccacgcccagcuaauuuuuuuuuuuuuuuuuuguauuuuuaguggagaugggguuucacuauguuggccaggcuggucuuaaacuccugaccuugugauccuccugucuuggccucccaaagugcugggguuacaggcaugagccacugugccuggccaaaaauuaaaugaaaaaaaaaaaaauugcaggggauauuuaagcuauacauggcugggcgugguggcucacaccuguaaucccagcacuuugggaggccgaggcggguggauccccugaggucaggaguuggagaccagccuggccaacagggcgaaaccccaucucuacuaaaaauacaaaauaauuagcugggugugguggcaugugccuguagucccagcuacucaggaggcugaggcaggagaaucgguugaacccgggaggcggagguugacagugagcugagauugcgccacugcacuccagccugggcgacagagcgagacucuaucuaaaaaaauaauuaaauaaaauuuccaaagaagaaguaaacuaugaaguucgaaaacacuuggagauaaugaaaaugaaaacaccaccugucagaaguccugggaugcagcugacacagugcucgcaggguaauuuauagucacaaaaugccuauauucggaaaggugauggccgggcgcgguggugcacaccugucaucccagcacuuugggaggcugaggcuggcggaucacgaugucaggaguucgagaccagccuggccagcauggugaaaccccguaucugcuaagaauacaaaaaauuagcuggugugguggcgugugccuguaaucccagcuacucaggaggcugaggcaggagaagugcuggaaccugggaggcagagaacccggcccagcugagauugugccacugcacuccagccugggcaacagagcaagacuccaucuuggggggaaaaaaagugaaacaucucagaccaaauacgucaccuuucaccuuaggaaacuagaagaagaagcugucacuaaaccuaaagcaaguagaugagaggaaguuacaaagauuaaaacaaaucgaugaaauggaaggcagaaacagcagagaacagucaagccaagucaguccuuugaaaagauccacacaauugacaaaucuggagguuuaacaagcugccucccagaggaacgugaaccucccacagucccaccuggcgggccaugcggcugccucugcagguggagcuugugugucagaaccucagggggaugcaucggucugcccagcuggccacuccugccuggugacccuguccccugcugagcugguggcuacagagaaggggucuccagggagcagggaggauguggagguugggccauccccccagacccucacccuggcuuggucucccagggugccuucaaggagcugguauauguguuauucauggugaaggaugccggcuugacuccggaccugcuguccuaugcggcugcccuccagugcauggggaggcaggaccaggacgccgggaccaucgaaagguagguggugucgggagggcccccaccccccaccaugucccucccaggguuuuaagaucugggacggugccugggcugggggcuggggacccccagagggccugacagccacaccgagaccugcaggcuagcaggagguggucacgagguuccccuggggucuguggaagcccagcguggggcuggcccgucccucgagcaggccgccugcaccacaggugucuggaacagaugagccaggaggggcugaagcugcaggcacucuucaccgccguucugcugucugaggaggaucgggccacuguucugaaggccgugcacaaggugaagcccaccuucagccucccgccgcagcugccgcccccggucaacaccuccaagcugcucagggacguguaugccaaggugagcccacgugggccccggcagacuucaguccuuauagcugcccuuuggggguuccuggagccucagcucagaccaaugggccuccccggugcccagggcucaccugggcugggcccugaauuccucccuuccuccucugagaagaugggaggacccagagcugggagggucuuggcccugagggugugggcucagggggacgagguggucgggggccgcagagagaggguggggugacaggagagcagugcguuugaguggggcugccaggugcacgcagugggcucgucuguuacugagguguaauucaccugccauaaaacccucuuaaagguguaauucagcgauuuuaguguagucacgguugucuaauucuagaauguuccaucacccuaaaaggaagccucguccccauccccgucacuccccauccccuccccaucuguggaugagucugcucuggacauuccauagaaaugggaccacacacugcgagaccuuuuguguuuggcaucucccacugagcgugacguccucauggugccuccgggaggcgaccugggucagggcugagucaugcuccggugcguggauggccgcgccgugcccgucuguucguccguuuaugggacguugggcuguuucuacuuaucgacugcgagucaugcagcugugaacguuuguguacaagcuuuuauguggacgugcgucuuugauucucaaagcgcuaggcuuuaguuguuauuuuuaauucaucuauuucuggaugggucacauucauacaguucugaguuugaggagaaaacagccaacaucugggggugcagugaacggucuccccaggcucugccagcucccagcaucaccgccccugccacccccugcacggugcccagugucccuucuagaggggucgaggccaggagggucaaggccuuugguuugcacugcuggcacugacuuuacccgcagcccgccuuuccccgcgucagcgauagccaccagcaacuugcaggagacgcagaaacgcgugcacccaugcugucucgggguccugggagggcaggucgcccucuggcaagcccccaaccucacuacccccaucccugcaggaugggcguguguccuacccgaagcugcaccugcccuugaagacccugcagugccucuuugagaagcagcuccacauggagcuggccagcagggugugcgugguguccguggagaagcccacguugccaagcaaggaggucaagcacgcgguaggggcugagccggggucccguguccgccgcaggggcugagccggggucgcguguccaccgcacgggcugagccggggucccguguccgccgcaggggcugagccggggucgcguguccgccgcaggggcugagcuccguguaugcgguugaauugcucaugcccuggucuggucaugcagggccuaggaacucagccuggcugccgcucagggaaaacuuguggggucccgagguugggucuuggccugugcuucugcgcacacugcagcugggcuuuugcucuuggcugcgucaggcacgcugaagccggcagagggcaggccggggugaggagcuacccggaacacacagcagggaccuugagggccaugaggucucugcagggagcugcggugacccccguccugugagccugggucccaccagcugccacggggcucaccgggcccguucaucccccgcagcggaagacccugaagacccugcgggaccaaugggagaaagcacugugccgggcgcugcgggagaccaagaaccgccuagagcgcgagguguacgagggccgguucucacuuuaccccuuccugugccugcuggacgagcgcgagguggugcggaugcuccugcaggugcgucuuccuccgcgcggccggguccccgggcggggcgggcaggcacucacggcugccuuccgcagguccugcaggcgcugcccgcccaaggugaguccuucaccacccuggcccgggagcugagugcgcgcacuuucagccggcacguggugcagaggcagcgggucaguggccaggugcaggcgcugcagaaccacuacaggaaguaccucugcuugcuggccuccgacgccgaggugaggcucgcacccccucuccuccuggcuggggccaguggugggugggcgcucucccucccuggagcagccggguuugcacccaagcuucagucuguucaucuguaugcuugggcugacagaugccccaccgggcgucaggcacgggcgguggggcaucuagcucaggggccccggugcccagcgcccugaccgcccuguccuacaggugcccgagcccugccugccgcggcaguacugggaggagcugggggcgcccgaggcccugcgggagcagcccuggccccugccagugcagauggagcugggcaagcugcuggcggagaugcuggugcaggcuacgcagaugccaugcagccuggacaagccgcaucguuccucucggcuuguccccgugcucuaccacguguauuccuuccgcaacguccagcaggugccaggcagugcccuccugagcuggggggcaucccgcugggaggaccagggaccccaugggguuggcgccuuugggcggagccuugaucucagcgcagccgucaguaccucccaggacucgggacacaccauggguguccaugcagguguccggccguuucuggagguggcuucuguucgugggaggccacacugguuucuuguuggccggggagccggccccucucacccaaguuuaaggggugggaacaggaaagccccagcaccggggcccugacccgucugccugucgcaccccagaucggcauccugaagccgcacccggccuacgugcagcugcuggagaaggccgcggagcccacgcugaccuucgaggcgguggauguacccaugcuuugccccccgcugcccuggacaucgccgcacucuggugcuuuccugcucagccccaccaagcugaugcgcacgguggaaggcgccacgcagcaccaggagcugcuggaaaccugcccgcccaccgcgcugcauggcgcacuggacgcccucacccaacugggcaacugcgccuggcgcgucaacgggcgcgugcuggaccuggugcugcagcucuuccaggccaagggcugcccccagcuaggcgugccggccccgcccuccgaggcgccccagccgcccgaggcccaccugccgcacagcgccgcgcccgcccgcaaggccgagcugcgccgugagcuggcgcacugccagaagguggcccgggagaugcacagccugcgggcggaggcgcuguaccgccucucgcuggcgcagcaccugcgggaccgcgucuucuggcugccgcacaacauggacuuccgcggccgcaccuaccccugcccgccgcacuucaaccaccugggcagcgacguggcgcgggcccugcuggaguucgcccagggccgcccgcucggcccgcacggccuggauuggcucaagauccaccuggucaaucucacgggguugaagaagcgggagccgcugcggaagcgccuggccuuugcggaggaggugauggaugacauccuggacuccgcggaccaacccuugacgguaggggcggggcccccgcauuccccgcccucccggcacccccgcgcccucccccggcgcccccgcgcccucccccggcgcccccgcgcccccugcccgucuuccuccuccccucccccuccccuggcgcccccugcccgucuuccuccuccccucccccuccccuggcgcccccacgucccccgcccgcucuccucccccgcgcccccugcccguccugcuucucccuucuccccugccccagggcccccgcguuccccacguuccccccuccccugcauccgccgagcugcuuccucccccggcgcccccagguccucuguccacccuccucccccggcagcuccggacacgcuuguuucagcccgguccacccgcagcucccauccuccauccguggcuauggagaacucauccagccaccgccccgucucucgcccacaugcgucccguguucacuaucacgggugugcgucuccuccccauuucccaccuccccgcaacacagccucccagcgggcucagggaucgggcccgggccucacugccccccauccgcuguccccgcagggccgaaagugguggaugggcgcggaggaacccuggcagacgcuggccugcuguauggagguggcgaacgcugugcgcgccuccgacccugccgccuaugucucccaccuccccguccaucaggugagccagcugggucuggcccccgaggccgugcagugugcacugggccuggggcucgacuugagggugugagauuucaccuucgcucgugguauucucuggaggugguccuagagugugcgggagccauggcuccuggucucucccgggagcgugcgggggcuccggugcacuuggcuggggggugcacggcccuaggaacggcucgaccuggggggugguuuggggucccacacgucucugccucucuagcuuccaucucccguuugccgccccuuccucaggacggcucuugcaacggccugcagcauuaugcugcucugggccgcgacagcgugggcgccgccuccgucaaccuggagcccucggaugugccgcaggacguguacagcggcguggccgcgcagguagggugugcccugcugcccgggggcaucucggcgugggggcaaugugagcccugagucucggccccaggugcccucaccuuggccuguccugaggaugugguggggcuggggcgggggcuucaugggugcuugguggccccugggcugcuagcggggcugacccgcgcccccggcccacccgccgugcagguggagguguuccguaggcaggacgcccagcggggcaugcggguggcacaggugcuggaagguuucaucacccgcaagguggugaagcagacggugaugacggugguguacggggucacgcgcuauggcgggcgccugcagauugagaagcgccuccgggagcugagcgacuuuccccaggugcgccaggcaugucgcgcugcgaacacguugguuucacugccauuuaaaacucagacgggugugcccccgacccagccucccagcaggagcccuggcugcucccccagaccacuggcugccuguuagggcuugggcguuucuugcugacugcgugggcgccaggccccauuccccugccccccugcuaggcccuaggccuugggccucaguggcucugaaauaggggggaguagggcgugaacgggccagccccugaggaccugcaccugcugcccgcccucugcaggaguucgugugggaggccucucacuaucucguacgccaggucuucaagagucuacaggagauguucucggggacccgggccauccagguacguccuguccuguccccgcucggccaggacucccuaagcaaguggacgggauccccggccugagcccccugcccugagacggccugugucccacagcacuggcugaccgagagugcccgccucaucucccacaugggcucugugguggagugggucacaccccugggcguccccgucauccagcccuaucgccuggacuccaaggucaaggucaguguaccaccccaucccuccccagugugccaccaucccaguguaacagcgucccaguguaccagugccccagcguaccaccaccccaguguaccaccgccccagugugccaccccaucccgcgccagugugccaccauccuagcgugccacuaccccaguguaccaccaccucaauguaccaccaccgugcugggccucgggugggacucaccggccccuuccccuuuuuagcaaauaggagguggaauucagagcaucaccuacacccacaacggagacaucagccggugaguggggggcccgggcuggggccuggccgggggucuggagagcagccacgguggagacagcggccaguuaggggugucccugggccgcccccaccggcaccuguuccguccucagaaagcccaacacacguaagcagaagaacggcuucccgcccaacuucauccacucgcuggacuccucccacaugaugcucaccgcccugcacugcuacaggugggcgucuccggacggcgugggugccgcucgccucccaggggcgucuucuggcuagcagggcacagcuggcaaggcugggucuagcugggggcagggacugggcagaguggaucugcugugucuguggggccuguguagaggcccugaggcugugugccccgaauguaggugguccuggcagcuccccuccuguggcccgacagggagagccgagcaugggcgcugccccuuccugcugggcauuucuuggcaccgcgaugugugguuagaucuggagcacguggaggucguuccagcagaaucuaccggccacgggagcugggaaugcucaggaugcggggugguggcccuggcaggaggggaccucguagccgcccucggagcugaggcucccacagcagcguggggggcggcagggguggggcgaggaggcuucugggaacauuuccucccccuguacugauaccuaacccaggauguuuggggaggggcggggcgagggguggggcgaggccugcaggagggugggcuucccuggaccucaaguggagggggcugagcgcagggccaggaugcuggucacuggguggcccugugagcuccccucccuucaggaguccuccgcucugccacaggaagggccugaccuucgucucugugcacgacuguuacuggacucacgcagcugaugucuccgucaugaaccaggugcccccguagucugagccucaguccacccauggguggggcccccacacuggggcguuggguagggguggugcccagagccugccugaucaccccuggggauccucugacuccugcccaggugugccgggagcaguuuguccgcuugcacagcgagcccauccugcaggaccuguccagauuccuggucaagcgguucugcucugaguaaggcgcucccugaccccaacuaccuggauuccccccccaccccaaaaccuggccucagccucaccccacccugcuuccaaccccaggccccagaagaucuuggaggccagccagcugaaggagacacugcaggcggugcccaagccagguaggcgggugggcagccucgcaaggguggcucgaacugcgggccagggcggggcuuucccgccacccacgccguccgcucugcuuccuccgcaggggccuucgaccuggagcaggugaagcguuccaccuacuucuucagcugacaccccgugagccuugucaguguguaaauaaagcucuuuugccacccccaggagccacugucuucaggaagggugcacgcccugcgggucucgggcaaucaca

SEQ ID NO: 16308 - RNA, 8509 nt, Homo sapiens
cccccaccccgaccgcggcccucccgccucuaaccugccccuucucccgucccugccucuguccccacaaagcacgacagcugccccgucugccgaaaaagccucacgggacagaacacggccacgaaccccccuggccucacuggggugagcuucuccuccucgucgucaucguccuccuccagcucgcccagcaacgagaacgccacaagcaacucgugagcccacgucggccgucgggaaagcacggggccuuucccacccacccucagccagcgccacacggcacccacagacugggugccccggcggcgccacgcuuggcuggucagcgcugcaggucccgccuguuccagggcaggacccgggcccggcccaccggcccccuggcuugggaaggcgugggccacaugguccccucuggggcguccccagccuccccguccucugucuaaccucacccucuaaacguucagcgguggaaagauuuuuauaauuuuaaauuauuacugcuuugaaauaaacggacguuugagcucacguggcggccaugcaugguuuguggcggaagacggggcccagcggcucccccagcgcugaagcacgggguucagcggcucccccagugcugcaggugccgccaggacgggccacgugggcccccagccucccccucggccgccuccacgacccggaguaggggggcucgggaccaugaggaugaccagcaaaauucaagaacaaaacugcuccaacagacuuuuuuaaaggaaaaaauauguguaucuugaaagcuauuuaaaauacacuacuuacaaagagaagccggugcuguggcuuuccuucugcgcccgugcgucaggaaaaggccaagcugggaggcuggucgggcucugcagaguccgguccugucuccaggggucugcgccuccugcagggcuuggcacccagggccggcuagcaaaacugcucucccgaaguuaagcccaggagggcugcuggcgagguagcaggguggcagugucacugggucgugaaauuuaaaaccagaaacaccagcguuaaagcgccagggcccagcgccucugccccacgcuucggucacaccucagccacgcggguuccuggccccuucugaaaagccggaccccacugcucaagguugcuggaugccuggcccggggugcagccagcucgggcacagcuggcaaggcguggggaccugcgggcucagggggccggggcaguggguucaucucaguugcugaugaucccaccauccugggauccaagaaucagacgauggagacagcuaacggagaggagccuccagcaggaccacccgugucccuccacgguagacggcuccugcgcgugggaggcgcgugccccacgccccuaccuguucuccaaagacucccgcccuccgcucugcaccacacucuucacugugucccgcgacgugucugcgucagcccccuuggccagguaacucggaucccaccuguccggaccgugcgcagggcaccuucugggcugcugccgcaacgccguggcgggcccuccugguggccgcccucuggggucgcgcguggcgggcccuccugguggccgcccucuggggucgugcguggcgggcccuccucguggccgcccucugggguugcggagccgagagaagcguugggacuuccaugacuguggccgccagggcagagugccagcccugagggcguccacaucucaaccccaggacccgcggacucggcuccucacgagguaacguacccggugcccuaagacgagguugcauggaggacaccgagguagggagguuaccucggaucguccuugaucuccggacugagagaacaaguguuuuaggccccgagucugcgcgacaggcugggccgccugcuccgggucacagucccccggccgagccguuuuccuguuggaagauggaguuuugagucaggaggcguugagggagacaaggcucggguucuguguguccguggugguucuugggaguuggaguuggagcuggagaggagggcugggcaggugaggcuugcagcggcgggaccuggagacucggaacuggagggccuuugucagagaugcugccggggugugcgccugccugugaggcugggacuucccucgcguggaguggccagaggagcaggaccgauugguucgccccacccaggcaugagccucgggggcgcugggcccagaggacaccggcacccuggugggggcugugaggccgcauugcucgaggucagacagcaguaagaaguggccgccccuggugucuucccugccccaggagccugcugcacgacaggacagggcccugguaaggcccgcaccccugcguccccgggccccucgcgccugcagccgcccucuccccauccgcccugccgcucaggagugcuucguaagcggaagcacaguuugcaacaguuugggguugucuuauuuucacugcuggcgauuuccuggggagccgcugguucugugcccccaggccgcuccucucuguuggggggcccccaccucacugccugaggacaacggggguccccagguuugggcuugcgaauaagcugcugagggcucugugugaaccgggauuucacugcccugggaugugcggagcuguacgcccauuccacgcucuguuuuagaaacaaagaaacaacugcugaccuguuucuuuuuuuuuuuuuuuuuugagacggagucucgcucugucgcccaggcuggagugcaguggcgcgaucucagcucacugcaaccuccgccucccggauucaagcgauuccccgccucagccucucaaguagcuggaauuacaggcgcccgccaccacgcccggcuaauuuuuuguauuuuuaguagacacgggguuucaccauguugaccaagauggccuugaucuccugaccucgugauccacccgccucggccucccaaagugcugggaugacaggcgugagcccccgcgcccggccugcugacccguuucuucgaggcacauguuacguuccugcguggggugccagcaaguuuuauuucagcuguggugaccugugcagcucccagugacaacucaaguggcgacgcccuccgacuggccaacgugggccgaucuccccucacacugccaaccuggggacauccugggugcagcccuguccuccacccacuccaugccagccaaagauguccccagaggccgccugguguccccugggguggggcucgcuucugucugcagggugagcagaagcucucgggccgggcacgacccucccuucccagaaggguuuuccgugucaggcugcucagcaccucccagcaagugccucggcccagucuuccuguauuuauguggaaggcggcggcuggggauggagcccuggccguccccggggacuucaccagggcgaugcugcugucgccccacacacagaaggggagacaggcccagggugucacugccuggcuccaggcuguggggcucuuggcucugaccuuuucucugagaggcuggaguuugacucccagggcuguaggcagaagucccagcggagucaggaugucaggagggcgcugggcacaggugggggcgcccccacaccgacggccagcccucucugcgucccgcaggacagcggcaugaagcccccaggccugcccugcacccagcacggcuccugcccucagccucugcccuucccgggggaucugaggagcaccgaggcgucggccucugcccuucccgggggauccgaggaacaccgaggcgucggccuccgcccuucccgggggaucggaggaacaccgaggcguuggccuccgcccuuccccgggggaucugaggcuuauuuugucaugagaacaguuucagacaccgugugcauauuuccgacgucugcuguaacaaaagaccacaaaguugauggcuuacuacguuuauuuucuggcgguucuggaggccagaguccaaacugggucccacugggcucauaucaaggcaggagcaggccggucccucccgggggcuccagugcggaaccguucccgccuuccccagcaucuggaggcacccacgucccucagcuuagggcccuuccuccccuucacggccacagcgcggcccauccccaucucucucuggcucucacugucccgccuccugucgugaggacccugugaggacacuggggcccuggaccccccacccuggaugcuccuccaucuccgucccaccugcaggugccuuuguccucgcaaggcguuguauuugcagauucccgggacgggaccggcuucgaggcugguguucugcggcgucugucaccgucuccccggcccccuccccuccccuccgcuccugcccccacucccaacgugcuccccaccccgagccccugccucugccgggcccugccugggacgucccccucgaccuuucgacgucugcguccuucagcccgagaggcgcccuguuggguccucgagguccccaacucaggauugaaccugcuugguggccaccacccccucaggcugggaccccccuggagggcuccugggcuguguccacagcgcccgcacacggugggcacucagcgcuuacagagcccgcagggggaagaacaagcguggccgggccccucgccaccagcccaggcaccuuggggagccgccggccucucagggccucaggagaccaggacgggcaggaagugggcggacaggugguaccgccgcguccggccgccuggccggggccccccccuccuguccagcgccaggaacaugggcuggccgcggcggcgccagcgcugugaggcguagguguuguggccguucucuucgaugcgcucccggaaccugcaguccacgguguagagucgcugcgggcgggggugaggccggcccacccuccccacccugcccgcgccgcccagcccugcccggcacucaccgacccguagaggcggccccggcgguucauggccacguagaagccugaggacacugcuuugaugaccacgacgcccacguguacagagcggaucuccaggaugccugggggaggcgggggucggggagggccuugcuggcucacccccagcaccgcugcuguccgcugugcuucgugcagggcccucaggaccacgacagauaccaggagacccccgggaccacgaguccccucccgaccacgacggacacucaggaucccccagagccgugacugacaccaggagccccccccagcaugugagggaggagcaaggagcaggcagagggaacgggaagcaggacggcccccacgagcugggggagugcagagaucgaugaggaccccgugggagggccaggucagcgcugucccugcagcucagcccaagagcagcaucuguguguguguauggcgggggggcucccacacacccagagggacggacgucaggggggcagcaacaccacgaggaagguugggaaaggguuccugggaugugggagucagaaggggcagggcccacccagaccacugauaacugucaaugagccagcgaccagcagcaccccagggagcccccagcccggcccucagagcucacaccaccccauauggagcccccagcccggcccucacagcucacaccaccccagagaccccccagcccggcccucagagcucacaccaccccagggagcccccagcccggcccucacagcucacaccaccccagggaccccccagcccggcccucacagcucacaccaccccauauggagcccccagcccggcccucacagcucacaccaccccauauggagcccccagcccggcccucacagcucacaccaccccagagaccccccagcccggcccucacagcucacaccaccccagggaccccccagcccggcccucacagcucacaccaccccauauggagcccccagcccggcccucacagcucacaccaccccauauggagcccccagcccggcccucacagcucacaccaccccauauggagcccccagcccggcccucacagcucacaccaccccauauggagcccccagcccggcccucacagcucagcugcccggcccacgcacagucacugggacuccggacugggacucuggacuggaggccgggcuggcaguggccuagagugggacaccggugguuuaugggacaccacagacaugcuugagcgccgacuguaugccagcuguccuaccaagcccgcucagcagcccacguugcagaggggccaguugaggccugggaguggcagagccagauuuggacgccaucgucuguggguagcccugggugagcccugccccacccugagcugaagugucuuguccagcaaggacccuggggccagccgccacuccucacccacacucgcucaccccggccugggugucugccgcuuugucagcuggguguacaguucccugcgugcccggccagcucccugucaaagugaaagcuccucggggcagccucccagcccgaccuuccaggacacacaggaacgucuuugaggugguuguucuggggcgucugugucacgaucuccccuggccccuuccucgcccugcaccuccccuccccuggcaaggugccucccaacaccgccguucacuguucugcgcacccaccugcacccuuguucacgucauucacuguucuuuuuuuuuuuuuuuuuuugagacggagucucgcucugucgcccaggguggagggcaguggcgcgaucucagcucacugcaagcuccaccucccggcuucacgucauucuccugccucagccucccgaguagcugggacuacaggcgcccgccaccacacccggcuaauuuuuguauuuuugguagagacgggguuucaccguguuagccgggauggucucgaucuccugaccucgugaucugcccgccucggccucccaaagugcugggauuaccgacgugagccacugcacccggccaaccguucacuguucugugcacccaccugcgcccuuguucacgugucuaacugcugcgcgccucugcucugggagccccaggagggugggcgucucugucaccacugggucccccaugcggagcacagcacccacaaggugcccgauuagugaccagcgaaugcacgaagggcaggagagcccucagcuagcccucacccccaucaccguccagcuggggaaaccgaggcuuggagagaggcagagacuguuccaggucaggcagcggagccaggccucugccccggcccgaggccaccccgccuggccaugcccgccauggauggaccggcccagccaguccccuguccgcccucgucacgugcggccuaaugagggccuuggcgcccagaugaaagcggugggaaggacagggggugauuaccugcccugaugguggugauucaggcggcagccagcgggcccgggcccccuucccagugccccccgcccggcggggacaccgacuccccuggccuccagguacccacauccccugcugugcccagccucuccucuugcuccugacauuccacaaacacugagggccuaccucagugugcucggcagacccuggggacagagacgcccgcuccgugacguccugggcccuguggggacccagcuccgccaccccugucagugugacccugggcaggucccaucccuucugugugccuccuuguccucaccugccagauggggugucugggaagaagcagagggggccccgacucaggcagcccugacuggauucugugaugucaggaguccggaggucagccccccgccgcuuccgccaugcagcugggccugccccagccccucuggagccucaguuucccaccugcagauggguggccccacccacaggguuguaccacacggacgcuucucugccccugagccggguccgccgcugcagccuucgcuuuaacagugcaacccucccaccaggcaggcugcacccaucucacagaccacggaaacugaggccgaggcugcacagaggagccuccgggacucccccgcgggcgcaggucaccgugaagacggcggccgcguugccgucacccgccgccuccccaccccaggcccccgccgccccgcacucacuguccuggccguggcgccagcgggugcccugcacgcggccgccgggauccacgcgcaggaagaagugaguggaggagaagaggcgccgccagcgcacgucgcccuccaggugcggguagcugcgcgguccccgcgacgcgcucgggguucccgcggcguccggcgcccgcgccagcagcagccaggccaggcccagccacaggcggcggcgcaugacccggcacccgguucgcugcgcgcucgucgcucccgggcguccgcggcucugccuucgcgcggcggggccaauggggcgccuc

SEQ ID NO: 16309 - RNA, 6992 nt, Homo sapiens
cugggaagucggugccgcugccgucucugcguucgccaugcgucccggggcgccagggccacucuggccucugcccuggggggcccuggcuugggccgugggcuucgugagcuccaugggcucggggaaccccgcgcccggugaguggggcggccagaggggcgggcggggcgggccacccacguggggcugcgcggaaugcggccggggggacgucggggggcgcggcggcggcggcgggggcgagggcgguguccggcgcaagcuggagccgggaaggucugaaggagggucaccaagaggucagcagagcagagguuucuaaucacaaugaccgcugacauuuauugagcgcuuagugucuaccucuccccucccugaaccugugccaucccgauagugccggagcucucuucaucuccgucuuccagauggggaaacugaggcucagggucacacagccuguagcaggcaaagccaggguucuagccgcgaccguccgggucgguccuggugccgagagguagugcugggugucgggagccaggcccuccagcuggggcugagagcuuucccggguccuggguagacggggcauggagucucacaccugggacuugccgggaggugccaggcaggagacggccccacuccuggccucaguuuccccuccuaugaugggugccaaggugcugcguuccacaagcuggucccuggcagugucugugaaccagcaagcgcucugggaugggggcuguggccguuccugcccccagggacgggggaagaaauggggggcucucuggcuccccaccccccaucccugcagccccaccccaccccagcccugcgccaaagggagagcagagcccccuccccgaaggccacgucccuggggagacagugagcucaugcaaggggaauguucccaaguuggagugaguaagaggcgggccaggcggugggggggcugccaggcgcggggcuccgcgugcccucgcccucgggugcugucuagacagagggcagaggcgggagaagcggcuccagggccugcugacccugacaugcccagugccugguguuuggugguguuugagggguugggcagggugccagccccuggccugggggcuuggaggguacgggaagggaccuccugggguggguggggguugguggugaggcugugggggggggcacguggagcucagaggggaggagacauuuccaggguucuggagccaggguggggacacccaugugguuuucugccccuucuuccuggguggggguagaucauuccgugcguaacuacucagcaccaccugcaugcaucugugggcgggccagaagcugggugucaggaguggcccaggagagcaccccguuccccggcccgcaggugguguuugcuggcuccagcagggccaggaggccaccugcagccuggugcuccagacugaugucacccgggccgagugcugugccuccggcaacauugacaccgccugguccaaccucacccacccggggaacaagaucaaccuccucggcuucuugggccuuguccacugccuucccugcaaaggugagaccucaggccagaagcagggcagacgucucagcucaggaccagccacaaacagucaugguggucgagggccgaacguccagggacugagcccgucacagggguauguaggaggcugcagggggaucccagccucagagagggacuggggggacuucccgguucccaggcuccagccucuugcagcucaggacucaggaagagaccacguggcuccagccuuugcuggggcugagcucucugccuggguggcucuucccaccuggucgauaaaugucuggcuugcaccuagcuccugggaagguggguuugccauucuggccugugaccccaaauguccacaccagggaccuucacugcagacuccagggucugcggugggguuacagcugcauguuuaacaagcauuugccucgggacccuguuuugagaggaugccucccacaucagacuaggggcucuugguuggcgaguggcacagaacgaaugaauaagauucuccgcacuggaggaugaugguuuuuuuuuuuuuuuuuuuuuuuuuuccugagauggagccucgcucugucacccaggcuggagugcaguggugcgauuuuggcucacugcaacuucggccuccgagguucaggugauucucuuuccucggccuccccaggggcugggacugcaggcgcgcgccaccacaccuggcuaauuuuuauguuuuugguagagacaggguuucaccacauuggccaggcuggucucaaacuccugaccucaagugaucugccagccuuggccucccaaagugcugggauuacaggcgugagccaccaugccuggccuguuggggcacaucuugaaggaggugggcauuagagcugggguguugggggaugucuaggaguuugccagauggggccgguaugggagaguggaucaggagagaacauggcuugagguuagguccugguggguggggucaggcagaggagccaaggggaggcugaagcugagggcugcagacccgaaggccaggcugaggaacucugcuggccucugagaugugauuaaucccagaucagccuggcugggugguccugaacucacugccacauaccccugcucccuccagaccccccucuggcuucugggagaaggacagucuucaaaaagugccuggccugggcaugagacggcccaggaccccccacccccaaccucaucuggcccuggggacggaacucaggcccccuuccguucucgcucgcauaaaagccacccuggccgagcauuuccagaugugccugugagccgcugugccggggccgcccaggugcggcccacaugcccugcaagggcugcguggcgggcgcuggccauccccuaaggagugccgcacugccuuggaaguggggcucccucgucagccccacuuuacacacagagaaacugaggcuggcacauaaacucaacagcuguguucagaggcccuaccagacccccagauaacagaaaggggguuggucaucuggguccuggcugcagcuuucaaacugaggugcuugggccccugcacucauagcugcgacccggccucaguuuccccaucuguaaaaugaugacuugggaagaugcgauaagccuaggaggcgaugagcauucacauugaaagcgggggcggggaccccagagagagcuucccuagcaggaccucaauaucccugucugagcagcggggcugcggggcagcuccugguucagaggccuagggcuguggggggcccccuccccuggaaucgcuccccaggccaggagggccguccagcgccccgcccuccccgacgccuccugggggaagguccuggcagccccagacucgcgccuggcaagggcggaacaccccaggcugacgcagcuggggccccuccggccuucccagaagagcgcgugcaucgggagcagacgucagccagcugcaaggaggagcggcccggggcugcguagcuccgcuggaccccgauuccgggcagagacccccccccgccccggcccgcgcgcaccgagcccagcccccgccccccagcgcaggcgcagcgcggaccucggccccaccggucccgcgcccggacccugagcccugccccugggaacccgagggccccgacuccgacugacccugaccugggacggcgcccccgccuccgcccugcagaaggggcgcagggaggggccccgaggccuucgcgcggccccacgcccgggacccucccgcgcccggccccacgcgcguguccucuguccgcagauucgugcgacggcguggagugcggcccgggcaaggcgugccgcaugcuggggggccgcccgcgcugcgagugcgcgcccgacugcucggggcucccggcgcggcugcaggucugcggcucagacggcgccaccuaccgcgacgagugcgagcugcgcgccgcgcgcugccgcggccacccggaccugagcgucauguaccggggccgcugccgcaguacgugggggcguggucuguggaggggcggggcgggaccuaccggaccugcgcgucauguaucgaggcugcugccgcaguaggcgggggcggggccuggggcgggaccacccggaccugagcgugacguaucggggcugcuaccgcaaugcgugagggccaggccugcgggggcggggccugcuggaggggcggggccugcuggaggggcggggccgcugccgcagugcguaggggcggggccuccagcccaggacaggucacauggguggcgguggggccugaguaagggcgucuuuauacuuccgagggaguaucacgggguagggucuuuuguaggguugggauuuggaaaauagugggccucugggggcucacacugggcaagagguauguggcauggucagagcgggagcgugacucagagaggggcuuguggguguaaccagaggggcaugauggaaccaggggggugagacugggucauguaaggggcggggcucuuggcuggggcgugguuccuggguggagaugggcggggauuuguggguggaguuugggugggcggccccgcagucgcggaggggcggggcuuuggguagcauaaggggcaggagcucacgaaagagguguggcuccuggguacaaugggaagggcagggcuuguggguggagccugagggguggaauggagaggggggcucacggggggcgggggggugcuugugucuccuaccagaggguuuucgcaucuuggggguuaagggugggucuuggggccaagagcccugcgggguucucagcgagauguccccugaacuuccccuggcacccggccugcagaguccugugagcacguggugugcccgcggccacagucgugcgucguggaccagacgggcagcgcccacugcguggugugucgagcggcgcccugcccugugcccuccagccccggccaggagcuuugcggcaacaacaacgucaccuacaucuccucgugccacaugcgccaggccaccugcuuccugggccgcuccaucggcgugcgccacgcgggcagcugcgcaggugcagacgcagggcgggggcacaggccuguccugggggccggagaacccccugcccugcgcccucaaugcucuuaucgacccuugcaggcaccccugaggagccgccagguggugagucugcagaagaggaagagaacuucgugugagccugcaggacaggccugggccuggugcccgaggccccccaucauccccuguuauuuauugccacagcagagucuaauuuauaugccacggacacuccuuagagcccggauucggaccacuuggggaucccagaaccucccugacgauauccuggaaggacugaggaagggaggccugggggccggcuggugggugggauagaccugcguuccggacacugagcgccugauuuagggcccuucucuaggaugccccagccccuacccuaagaccuauugccggggaggauuccacacuuccgcuccuuuggggauaaaccuauuaauuauugcuacuaucaagagggcugggcauucucugcugguaauuccugaagaggcaugacugcuuuucucagccccaagccucuagucuggguguguacggagggucuagccuggguguguacggagggucuagccugggugaguacggagggucuagccugggugaguacggagggucuagccugggugaguacggagggucuagccuggguguguauggaggaucuagccugggugaguauggagggucuagccugggugaguauggagggucuagccuggguguguauggagggucuagccugggugaguauggagggucuagccuggguguguauggagggucuagccugggugaguauggagggucuagccuggguguguacggagggucuagucugagugcguguggggaccucagaacacugugaccuuagcccagcaagccaggcccuucaugaaggccaagaaggcugccaccauucccugccagcccaagaacuccagcuuccccacugccucugugugccccuuugcguccugugaaggccauugagaaaugcccagugugcccccugggaaagggcacggccugugcuccugacacgggcugugcuuggccacagaaccacccagcgucuccccugcugcuguccacgucaguucaugaggcaacgucgcguggucucagacguggagcagccagcggcagcucagagcagggcacuguguccggcggagccaaguccacucugggggagcucuggcggggaccacgggccacugcucacccacuggccccgagggggguguagacgccaagacucacgcaugugugacauccggaguccuggagccgggugucccaguggcaccacuaggugccugcugccuccacagugggguucacacccagggcuccuuggucccccacaaccugccccggccaggccugcagacccagacuccagccagaccugccucacccaccaaugcagccggggcuggcgacaccagccaggugcuggucuugggccaguucucccacgacggcucacccuccccuccaucugcguugaugcucagaaucgccuaccugugccugcguguaaaccacagccucagaccagcuauggggagaggacaacacggaggauauccagcuuccccggucuggggugaggaauguggggagcuugggcauccuccuccagccuccuccagcccccaggcagugccuuaccuguggugcccagaaaagugccccuagguuggugggucuacaggagccucagccaggcagcccaccccacccuggggcccugccucaccaaggaaauaaa

SEQ ID NO: 16310 - RNA, 15195 nt, Homo sapiens
cccguggccccaccuggcgcuucggcggacacccgggcgggagucggggccgcccgcggcacagaaagaggaagccagcaacgaaggcggaacggagcgaggauacagaagauuuauucgaaguccagguacagacuggccaaccugccucuacagcguccacagcgaacacagggcuagacaagggaggaguuucucaaacgguuuuaaucgguucucuccgcgucacaagccaucggguaaggcaacggaaugugcgugggguccccuguggcuccgcggucacaauacugagccuggaauugcuguuagcaaaauauacauuugugucaccauaaaaaaccgcgccgccgccccucgggucucacaacagguauaaaaaauuauaaauauuuacacccuuguuacacgcuuuuacggaaaggggauccuaggagagcccccgggacaggacgcgggggcgguagaaagagcacagagaagacaggaggagcgcccgccuuccgggucccagcaucagaggcaggcaaaacacagaaaugagacuuugguccaaaauuugaaggaagaaaaaacccugaaguuugagagcaaguuuucuaggcgacugcaggugaaggcgugguguaaggcaaccggaggcgaugccagaggcggcgacacgcccgccccuucccugaagcucaggggcucuaagauaggaccggggcucccugugccugacccacugggcggccccgccugcucucuggaaacuggguccugccugugacuuaauuacaaggaauaaaauaaaaguaacagcauacaagguaauaccacaaggaaguuuagauuacacucauaccauuguaucaucuugcuauaaaaaguuacuuaaaacuauuucuuuugcauauaaaugaaaaaagauuagaauauuuggucaacuggaaauauugcuaggcacagacgucugcaacugcaaaguauauaauacagagauuaugucgaccagcuccgcagcuggagcagcggggagcccgccugggggcagaagggaaggcccugggggcggggugaagggagaaucacgugacuugauuagagggcugggguuggggugucgcagccgcggccgccgcgccccagcugcaugauccugcaggagccggccaggcccccugccucucucuggugugacccccccaccccuuggguccccaggacaccccggguggguguguggcugcaggaaggcagguuuuuuaaggcacaaggaagccaagucguggucggggcgcccaccugcaggccccacgcccgacacaggccccaccaaggcauggccccgagggucuggccccggguguggagggccgggaacucccgcugccacagucaccaagagccugagcugucccugucaccgcagggugagcaaggugaacuagauuuaauuuuuuuaaaaacagguaaacugauuucucuuuaaaaaaauaaaaucucuggucugcuaaggucacuucagcuguuuuuaaaguggcuuuucucuggaaugauggaaguugucgccagggggcccggccgugggggccugugccccuagaugguggacuuggagaaggagacccgcagguggugguucuccccgaggucgugguugugcaggucaaugagggccuggaccgccuccuccacggagcccaucuggaucagugccaucuugcgguccuuccugcaagacagggggucagggccggccgcagggcagccuggggagagccagggacagcccgccucauacucacuggaagaacuugaauccuuugacgacgcccccauugcuggaaaacaggaccuugagauccuccucggagacugagggccugugggaggagaaaggcgugagccuggggccgcgugggggugggggcgcccagucagguccgcgaggcuuuccccagacuaguuuucagaguagccggggaaggcguagggccuuuuaggagcccagaaaugggguaucaaaucauguccacaauggucugaagcagcuucuaacgaaaccaggcaucuacaaguuugcagaaacagaguaccacgcuccuccacuuuuuuuuuuccagauggaaucuugcucugucgcccaggcgggagcacaguggcgugaucucagcucaccacaaccuccgccugcagguucaagugauucuccugccucagucucccaaguagcugggauuacaggcacgcaacaccaugccaggcuaauuuuuuuauuuuuaguagagacgggguuucaccagguuggccagguuggucuugaacuccugaccucaggugaucugccugccucggccuccuaaagugcugggaugauaggcgugagccacucugccaggccccuuguugauuuucugauaacauuucacaaguaacguguuaaauaucaaagggcuuacuacugguugacaugcuuggggccagauguaccugcauuuccaaauacuugcauuauguaauuuuuacagacagggucuuacucugccgcccagccuggagucuggcagugcaaucacagcucacugcaaccucaaccuccugagcgcgaagugaaccucccaccucaaccucccaauccggaagagcugggaccugacgugcacaccaccacuccuagcuaauuuuaaccaauuguuccuguagagacagaggucucacuuuauugcucaggcuggucuuaacucuuggguucaagcaauccccugcccggccccccacaguacugggauuauaaaggugugcauuaggccaggcgugguggcucccaccuguuaucccagcacuuugggaggccgaggcggguugaucacaaagucaggagaucgacaccauccuggcuaacacagugaaaccccguuuccacuaaaaauacaaaaaauuagccgggcgugcuggcgggcaccuauagucccucccagcuacucgggaggcugaggcagcagaguggcaugaacccaggaggcagaacuugcagagaucccgccacugcacuccagccugggcgacagagcgugacuccaucucaaaauaaguaaaauaaauaaauaaauaaauaaauguggcuaggcgcgguggcucacgccuguaucccagcacuuugggaggccgaagcaggcggaucacaaggucaggagaucaagaucagccuggccaauauggugaaaccccgucucuacuaaaaauacaaaaauuagccaggugugguugugggugccuacagucccagcuacucgggaagcugagguggcacaaucacuugaacccaagaggcggagguugcagugaaccgagaucguuccacuguacuccagccugggugacaaagcaagacuucgccucaaaaaauauaaauaaauaaaugugugcauuauacauucucacagggagcauccccugagccaaaaccuccaaaguguccaacgacccccucccuugagcagcccucggcucaagcuccaggccuugcaguacuucagguuugggguaagaggugcccgaccugcacucuggaaacgccagaaguccacacaccgacgcgguaggacagccaagcagagcccuugcccgcccccggccccaugagccccccggcccagcacucacgggauguuggagaggugcagcguggccgagggcgggaauauguucuggaaguucuuggagcccggcuucuugaagcggugcaggggugaguugccguaguccuuggucaggcccugguccuccuggcccucgcggggcagcugcacguucuggugcuucgagagcgugaugcggaugggcuucccgugcagcuugugcccguucagguggcucauggcugggggagcagcacccgcgugaccaggcgcccgagagggaacgcagcccccgccccugcccccuccaccccggggccgccccggccucuuacccagcugggccugguugccguccgccaucugcacuagggcguucuccuucuuauugaacaggaucuucacgcgcugcacgucaccguagacgccuucaaaagcccagggauggggccugagucuccugcugccugccccgcccaucuccccgucagccccggccccgcgcacccccacaaggcccggcucagcccggccggguuugcuuuaucggccacugcggagcugcgucucgcagccacagggcgcgcuaacaggagcagcuccguucagcaaagucauagcauccaggacagguaagcugccagcggguggccacgguggcauaugccaccgacaggucuaacucugaaaagcaugcagggcgauaaaccaugcguacguaucuacgggaccaaauaaaauucgcaaaccgaaagcaaaccauaaaacgaggcggaugccacggagcaucagagugccaaaccgcaaacucauaauacgucucagggcaucaaaaucaucucaauuaaugaaaacaagguaauaaaagugugaacgauaacauaccgaaaagaauaaagaggcuuuggggugugacucucuuuagagacagcagagcaaggcagcggagggacaggggagagggagaggucaaggggggcgaguugccaaucguccacacgaggaagacaguccccgcaggcgugcagugguugauggaugaugaaguugucaggauguuaauauucaagggcagguugguuuccggagagcaggguuugagggggaauuuuuguuuuuuauuuguuuauguuuuuguuuuguuucaagcaacaacaggaagcagaaguaccgugcagucaguuggcaaagaaauuccggaucagggcaagaaaaaaaauagggaaaggggaaggggagaaaagaaaaaaaguagcaaaaaaacacaggucaguaaauacauaagaaucagguaguguucuaucagucacacuccacacacauuccaguuacagguuuaccucgacgggcacacgguaagagaagcaccuucacucacaugccggcagagacagcgcugcuggaggggcucccagaagccgaucccaaccacgccccccaggagcgcgcgugcagcuccgcucgcggccaccucagccaagcccugcagcagcgcugucucccgcagcuguggcacaagucagucucuaaggacgauuacaggcgugaagggagaucgagucuguuagugcacggccucgcucaggaggagcuggagggacagcacccggcucgugguaagaggcacaggcagggagugcguccugggcccccgcgagggagggccaggcugggcaccgccuugaggaagucacaggaguugccgggaaacagaacagccugaaaugcugauuccaggaggaucccauccaucaagaguuacauauuuugggccucuuguuucacccaagcucuccccgaggggaauuuaaccauucugggaaauaacggauccaccaguuaagugacaggcucucgagccacaggggcugcccacaccccgccgcgcuaacccugugugucccgcugaccagcagggcggccugcuggggcucugaacugcgcgcccugcucagcuccaaguaauuuuuagauugccuuuggguaaccaaaaaauaauucauucugcguaucaugcaagagaaaacgcgaaccaagaugugaauucaggaaaagaggaaaacucaagccaucuuggaaaaggagggucucagcgcugcagcagaggggcugccagggcagaggcgcagacacagcgaggggcggcgcugcuccgggacccgagcccgagcacaacauccccugcucgcucuuccgggaggaacggcggcgcggaggaaaagcccacguaccucuggguugagguugcugaccagcaauacagaauuuccugcccccgccaggcccgggauggcgauccgaccugccgccgcagcugccgccgccgccgaggggauggccaggggggccagggcgccguggacguucggaacggaaaggccuggaaaagcaggaggugagaugagcggcggcgcccccgacuccaccgcagagugggagaggccgacgcuccccguccucaugcaccgaggagccgagccgcgcgggaggcggcccuggcucuggcccuacccugggugccuguggggucguccgacccccgcacagccacccgccggcuccugcaccagcgcccgccucuccucacagcacgggccgggccgggccugggcucaucugcaugcgccccgcccacagcacagaaaagcuccggcuccgccagcacagacacggggcccucggcaagcagggcccgucccgggaccaccgcgcaugcgcgcccaugccuccaugcagacgaggcggccgccgggcggcacgcgcugcuccguccacggccagcacuggggcggccgggccccggucccagaagggaagcgggaggacggccacgcacacacgucccgccgccggucaugcugcucagccucgggccgcgcgcuuaccaggccacucaaauucaacuacuagagacaucccuccaaccacuggcgguccucgcgcucgcccggaggugcuugaagggaaccagaccacaaagacugugcgauuagcggcuucuggcuggcgccguccacacgugggccuccacagcccuguccuaccacugcccuggccaagccugcucuguggacguggcguccccucucccgggaagggccccugaccuggcacucgagugcccaguccgcccaggcugccgccguggaugcggagcugccugggaagguggugugggcaugcagucgcuggggaaccaagaccaagcguuugaauaccugcagcuugaggaauggcaaaggugggagggaaaccagcuccugcauacggagaggcugagauuauaccaggugcaccuagaaauaaaugagacacuaaucaucgcacccacaaccuccaccgcgagcgggcgcugugcugcgggaugggccccaacccggccggcgggcggccccggcagagccuucgcgggcagauccgcugcuccagggggggccguggucccgacgugggggacacuggaccgugcugugcuggccgugcagagagcagcaggugcaucacccuggugcagggccgggcccgugccgccggggcuccggacugagcggcccuaauagaccacucugcacacuggcgccgcgucgggcagccucuuaccgaaggccgcggccauggucugguccagcgagggcuggcuguccccggaaggcaggucugggcguguguagucacggcucuugucauuguuguacuugacguugaggcuggugagcuuggaaaagucgaugcgcagcgugcagcaggcguuguagauguucugcccguccagcgacugaggggagagggaccgugagacgucgccgggccagggccagggcgggcgccgucccgggagccccacucaccagcuuggcgugcugggcgcucacgggguccgcauacugcagcagggccuggaacugguuguucuuggugaaggugaugaucuucaacacugugccgaacuuggagaaaaucugcaggucccgggccacagcaugagcuccugcccggugcccaccagcccugccaggccccucccgugugccugugcccacagcaauagcagccgaccugcccuggcggugaugggaccaccucaccuggugcagcacauccagggucacaggguagaagagguucuccacgaugauccugagcacggggcucugcccggccaucgccaucccugcguccacggccgccgccgaggcagccaaggccagguuccccgacuggaccgaguucaccgccugcagggccgccugggcccgcugugggaggcacagccgugaguccccggccccugcggcugggcccacccccgagguccccgggcugcugggguccgccgcggggccacgcaccgccugguugggagagcugucggucuucagcuccuugugguuggagaacuggauguagaugggcuggccgcgcagcacaggggucaccgagguguaguaguucaccaugguguuggcagccuccuccguguucaucucgaugaaggccuguuggggaggcagugagcgcugggcccuccucguccccgccugcacggugugagcaccccggagaaacgcggcucagguaccugguuuuuccccuucagcaucaggagguuggugaccuucccaaagggcagccccagggagaugacuucccccuccgugacgucgauggggagcuuccggauguggaucacucuagaggggacgccugcacuucggcugucaccuuugaacuucuugcugucauuuccguuugcugaaaagggggugccaugagaugcaggcaccaacucgcaggagcccacagaggaaggucccugcuaucccccuagagcccugccugcuacggagaccaacccugagccccaggagggugcaugugaaccagcagcgcgagaggccaagaccugcacagucaggaccccugcucccgacagcuccugacaacccgcccacagguccaagugccagccuggaccauccauccagcgccucccuggaaauucucugcagcgagaacuuggaccugggucuguagcguggaccaugggccccugcaguuggagauggaaaguagagucccagaacaagaacguaacguuguuccagggaaagacacccacgggucuugcccugggccgagucccggccuuaccugcagaagccgaguugcugcucaugauaaacgguccguuagugacacaaguagagaaaagcucgucagauccccgcugcaagagaagggacaacgcggagcugcacuucccaccaggccagagccucccuuccccaccggccggcccugcucccacuugggcugccuggggucccagacccccaacccauacccacacccacacuuccacggcagggcagccugagcgcagacccagcccauggacgcgcacggcaccccacagcuccacgaccaaaacacugcuccuuuuuccaaauucuggaagcccuggguacucagccaguguggggcugggaggcucucagcuacggagggcaccacguacacuaucuccacggccaacucugcuguggacguggccucacugugcugccagcggcccugggcacaggccuggggccucagccaccagccagcagggcagaggacccccuccauggagccagcccccccagcagcacacggcagggcccaggcagccguccucacuucugguggccucgcaagagaaccaaauuauagcgcugccucccucacucucgcaggagccccuccucuccuguuuuccagcccggaaaagaaacccgaccuccgucucugcacacgcgagacugaggacuagagacacggccucccgcccagugauccgcugguaucgcggccgugacuagggccgggggagcuccacagcggcuccaucacuucugaccuguccauuuucucuccagaaacaaucuauucacugguuauuucuauguaauuggaucaacuucuaagaauugcacuagacugauccuaggcucaggacggcagacaucccccccgcugcaaggauugaagacacacguuuauucaaagagugaaauuggaggagacguugguuacggcccuuaguuacacagaaaacaaagcucgggucugaggaccuuggagcacaggcgcuuggucugcaaagcgagccucugcaggcgcugagggcagcaacgcccaggccccccaggacagggccaucccagggaacaaaggagccuccaucucccguaucaggauugaggccaagagccugcccccaccugcugaagggcccagggccaucgcaucagaaagaaccaguggauaucacacccuguccccccucagacaacccccagcuccacacacccccaugccuggucaaggagcugcccccacaccuggccaaagagcccccaccaacgcuggccuccccgagccugcgcuuggucuucucuuaaggccgccuccccuccacccacguucagcuccacuccugcccuggcccuggcucaagagcuuccuggaaggaagacugcccgagccuccaaagccccacagcugccuccucccgacgcggacggcaagagccucgggagacuccggcaccugcucaaggaggauggggaacagggacuggcccuugccaaugagaccucuaacugcagcccugagucucccaccaaucccacaagcacucagggcgucaccaaacaagcaaucgagcagccacaagggccggaaccaggaaucacucaggguccacaggcccggcgcccacccaaauggcaccuguucaguccccaagacuuuagggucagagaaugaacaguguccagugucacggcggcccugagguuccggccggacacagaugaagccaaauacugaaaacagacccucgaguccucucgcuuucagagucuggggcccccuaugagcacaaggcggggcugcgcaggcccaggggaaaggggucagagccagccgccucagguggaaaccacgcgaucagaaaacacagcagugccaggaccggaggaagggaggacgggaggaagggaggaugggugcaccugagacgcagggccuccaaccuucgccucccacaggaagucgcuuccugucugcucuccccuccagcucagaggcugggggagcccaggagccgaccccguccaggacaccagggcugguccucccccaagcuggagaguggccaagcgcccaugcggcucccaugugcuggcugcacaaaccuuaaaaagggcaucuuggacccugucuuugacuggaguggugggcggggccgcuuccucugagcgguccucuuggccgccugccugaagcccuaaucucauucccaugggcaaguggccuggcauugcccacaacugucugcggcagcaaacuccaugccugcccaggcggcacaggccggcuuggcucagcucaacggcgccccagcagaacggaagggacaccuggaggcuccgaggcuccacagggcagcaaccaggagacacgagcugggccuagcgccuccacugccuucacagcagcugccagguaccccaggagggucccuucagggcaccuguccugaagcacacagauugacaggaaacgccccaggacuuccagucugcagcuggggcccuacagcacaguuccuaggugucuuuaaccccacacugaacaagagcuugcucuguccugggcuaaaggacagcguagccaggugugggcccaggucagcugagggcucccugguggugggggggaggggggguaucaucugggucaggguacuaccccguccuccuaccagggccugcacccagcaggagcccuaacccugcccuguggcaaaaucccucccgcaggcuucaaguccuggcugggcuucaacgucccagcccaggagcccccuaggaacugcagaggagggcucaaggaccacccgauggaagcugagggccacuccagcuggaaagcaggcccacagaagcagggaagagacgacugccugcaagccagacacaucuagggauuguugcaaaugcuucagaugaaaguaccucucccuccucccacacugaacaaacagguuuuaucuccaggaagaucggggcaggcagcgcguaaagacagcaguccacuugggaaaaaccgaaaccuggcccaggcaccacugcugacugaccagaaaccaacuggcugcuggcucaggacgccaccacugugggcucgcccugcgggaggcucucggggcacaagcccugaagucgggagcccccucaacccacaaugaccagcagaaucauuaaccaacuaccccagcuaagcgaggacuacagcucccucgagaaucgccuccccaggaccuucuucuucuccagguucugacccccuuuccucacaugcugagcccuggccucacccuccauggggcugcaagauucgcacaccccagagacguggcacauucauuuuucucuugccccaaacaccaccuuugacaguuugcugcuguucuaaccagaugccaucaaagauacuuaaugucagccgggucuggcggcucacaacuguaaucccagcacugugggaggccaaggggggugcaucaccuguguuccagaccagccuggccaacaauguucgaaaccccaucuuuaccaaaaaaaaaaaaaaaaaauacaaaaauuagcugggcaugguggugggcaccuguaaucccggcuacucaggagguugaggcaggagaaucgcuugaaccugagagguggagguugcagugagccaagaucacaccacugcacuccagccuggugacaaagcaagacuccaucucaaaaauaaaaaacaaaaacaaaaacaaaaaaacuuaacgucaaaaucaaccaguaaaugcccauccuagccacucaaauaggcuggauucuauccagguccccuccacagccagguggcucuuuuccuaucaaaaccaagagucucccaggcagccacaacaugagguuucccacugaacggcacgauuccagccucuagaggcagaaguuccaaaggcaggccuggggcacacagagcccucgcugcugacagcaagaaccgaagagcagcucagauuccagaccugaggggcggccagcaaacccaagcccccaaaacucacgggcacuggagcccgggguucaaacccuaccgcccaacuccagauuccagaccaaggguagugccccuuaggaauggaaaagcgcccucuagccaacgcaacagcgcugggggguggcccccggggucggcacaaggucagaggagcgucacggagaagcaaagugagaagugccuaccuuuguaccaacggcuauaucugggacaaugcuguagagagaaagaaaggagacaacguuagccugguggccacucagcagcaggagcacccagcuguccccgggccaggagagcccguaggucccugcagcugccaccuccgcagggcucccucuggcugcacgaggccccgcuagagaaagcucagaagggcagggaagugagccguccacuugacugcaacuugaaaaggggccaccauuguccuuuggcgccccucccucccagcaggaccccaggccccaccucuggaccaggccccacacguuccaagacaaagacacccccaucggaagccccgaggaaugcuagaugccgcugagaggguucaagggcugcugugugcuuuccaguaaguuggaaacgccucggagaggcugaaacuggcaaacucacaggccugggccagagcuuccacccggguaggggugggcccccaagagggugccucucagcagaguggagcccgauccaccgaggagagcaggaggcggccguggaaaccgucaauaaaaauuaacagaccgaccagaacacagccucaguuacugaucaacccgagccccgcccgacccgacucucccuccucgggacaccccggggggaagguggauagaaagccggacuguccgaggcccucccuucagccccggccagguccugacccaacagugagcuccccacggcuucucccggccacugcaacucccggcgaggcccuaagugacucggagcguccgucggaagggcagccuccgggccuccugccucacuccgggaggcgagugcgcggcccccgagcccgcggugcuggguccgagagcggggagcccucgucucgccgucugcaggacccaccugcccgcacgcaugcuaagggguccagacccacucuagggcugcgccucuucugacaccacagacugcacggaccacguuuaacagacuuuuaaaagugacugaacccaagaaaaacuucucaggaaaacggaaagaaugcgaaacaucuccagccucucccgcuuccuauucccagggagggccucgcgcaggaagcgcucggcgggacacggccuuucuggagggggcucccaccucucccaagggaagcccgcccagcaaagccgcccggaaaggcugccccggcccgagagccgggaaggccccuccccaugacggcgcccgcgggggucccuggagaggccccuccggccccggggcggaggacagacccucggggcggccgcuucucucccgagaucaccgaaaccccuuggccgcggcccggggcgcacggggggcagggguagggcggggagcgcagagacucgggcccgcggcgaggccccggcgccagcuuucccucccggcggccgccccagccccgccugcgcuuccggggcugcgccgggggcagaguccgggcggcgggaaaggcgcgcgcccccgauggcggccgcgcacgcgcgcuggggccaacggggacgcgcgacgggcuacgcaggcgcacgaggggagcggacgggaggcgggaagggccauccgggcgcgcgagggccggacgggaagcgggaagggccgcgcgccgccgaggcggggcaaaggcgaagugcggggacgcgcgcggagggggaggggcgcgggaggccgcgugcgcuagggacggggcgcgcgggggccggaagcgggccggacgggggauggggacgcggccagacccccgggaagccccugacccgccccgcacccgcgcccgccacgcggagaggaaggggagagcccgccgcccccucccgcccgagagggggcgagaucggccccggggaggccggcgcggcggcgggggcagggcugcggcgcggggagggcgguggggcgcggggcgacgugcgacucacccguccauggcacacagagcagacccgcgggggacggaguggaggcgccggaauagcaggaaccgacccaacggcuccgaguuauagacucacaaaauggcggagacgcccgcacacgucccccgcgcgcgcugcccauuggcucccgcugcagccagggggcggggagagccccgcgggcccccgccagcaccucccacuggccagaaggccgcccgggggcgggacccagagaaaucgcaggcgccuauugggggaggcgguuauuccucaaggccgaaggcggaaac

SEQ ID NO: 16311 - RNA, 13187 nt, Homo sapiens
uuuaguccagacucugggacuacacucguccgucuguaaaguagggguuccacuagaucauucguucauucauucauuccacgaacgcuccucggcuucugcagaggauggcaggagggggagggggccaacauucuagagucuccgauuauaguggcuacccugauuuugaggaaaacccguuucccacucuggaagaagaguugaaauaaacucuucaggcuggaggugaagcugaaaugggagcguguggguccacagcuuugaaggcgcuggggagagugagaggcguggggacggcucccgcggcaggagguggcauugccguuggggcuuugaggauaaauaggaguucgccaacggggagacauccaggcugaggccacgagacuugcgcuguaagguagagugcagccaaagcgcauggggggcauuugagggaacugccucuucuccaaauggccaggaagcccagccucucccucuaccccaagucccggcccuucaaaucauucauuccacccagacucaccuguggcuucagcuuuugcuccuccucccaauggugagguggacauuuuccccuugauccccccaucccccaagaccuccucucuccccacaaaagcaucaaagcaaagcacgcccucaucgacgccaacucucuuggccaccuucucuucguacaaacagagguuuuauugcguuugguccacagucguauuucacauuaucucacggagcagguccccuggguggggggucccugugcaguacuuggcggggcauguggccggggaagauggagcaguauaagcuggucgggcccagaagggaggagggcugggggcuccuuaaaaccuacugaggggcugggcacgguggcucacaccuguaaucucagcgcuuggggaggcggaggcgggcggaucacaccugaggccaggaguucgagaccagccuggccaacauggggaaaccccaucucuacuaaaaauacaaaaauuagccgggcgugguggagcaccugcaguccuagcuacucaggaggcugaggcuggagaaucgcuugagcccggaagguggaggugcagugagccaagauggcgccacugcacuccagccugggcaacaaccacaacugaaaaaaaaaucuacugaggccagaguggguuggggcggggagcauggagagggggucaggcuuagccccaacaacucagaauuucacuuccuuguacggcccucacuuucuccaccuggccccggggcaggucugagggucugaagucuguuggucugaagguccuaggcaaauccagucacuugggagccggagauauuuaacaucacggcccgguccccuuucccaggggacucauuuccuagcacucucuccacuguccuugccccaccccugggggaaaaaauguauuuuucuuuugugaauacuuccugaaacuugcgggcauagaaaccacaaacugcucagcugacaaaagggggaagaggcgaggcaagcagaaaccgucggggaccgguuccuuccaagcccaggucucuucuucccagcacagccugaaugugccagcagggacccucgcccuacacguauugggauauggccuugaccccuucccccacagcccaguggcucagccuugcgaaggaucaaggcaaaggggaaaaaagcucugcugccugaucccacgcugacacucacagacccuugguugacuggcagcacugaacggguuaagaaaaaaaaaaaaaagaugaaaacacagaaaaacccaaaaacccagaugggcagacgauguggggagagagcgugcugggagccucaguagccggccuccuccugguaguaagggggauauucagggaccucccccggguccgggcagucgccggugcccgagggagccccaucggccacugugccuugcgggcaguacuuggggucauauaucugccggcccaggccgaagaccuggccgcucugguuggcgcccugcguguagcccaucugcagggacauggaggaguugucacacuugucgguucccagcuugguaucauagaugugccgccgggucccgggagccgucaugcccaccuggagaggaaggagggguggagcaggucaugguggagagaagaggggaccuucacugggugcacuggcucacgccuguaaucccagcacuuugggaggccaaggugggaggaucaccugaggucaggaguuccaguccagccuggccaacacggugaaacccugucucucccaaaaauacaaaauuagcugggcgugguggcacaugccuguaaucccagcuacucgggaggcugaggugggaggaucaccugaggucagaaguucaagaccagccuggccaacacggugaaaccccauaucuacuaaaaauacaaaaauuagccgggcgugguggcgggcgccuguagucucagcuacucgggaggcugaggugggaggaucaccugaggucaggaguucaagacuagccugaccaacacagugaaaccccgucucuacuaaaaauacaaaaauuagcuggguguggccgggugcgguggcucacaccuguaacccuagcaguuugggaggucaaggcggguggauugccugagcucaggaguucgagaccagccugggcaacauggugaaaccccaugucuacuaaaaauacaaaaauuggccggguguggcagcaugcaccuguagucccagcuacucgggaggcugaggcaggaaggagaaucucuugaacccgggaggcagagguugcagugagccgagaucgugccacugcacuccagccuggacaacagagugagauccuaucucaaaauaaauacauaaauaaaauaaauaaagauuaaaaaaaaagaauuggguggaccuuugggcaguccuuaagggaaaaugacacagggugagguaguaacuucccuagagacccacagccagguggaaaugacagaggcugaaauccaaggcggagacagagagcggggagggaagccggagguggucuagggaaggggcugagacugagaguggggagagaagcuggagguggccccagggaggggccgagaccacaggguguagaggggcagggagaggagucgggggcacccgggcgagccccaccuggcuggcacacuuguucgugcccaucuggaggcugauggucgagugguccauggggggcaggauaugguucuuggggucauagagaugccuucucgugccguaggcagucaugcccgacuggcuggcgcauuuguuggugcccaucugcagggagguucgugggagaggucagacugcacccaacaagcuuccggucccucccugaaauugagggaccacagggcuccaugccgcugucccccaaugcugcugucccccaacaccguggucccccaaugccguggucccuggggcugggggagcugucgcccaccugcagcccgaugacgcacuggccagccuucaugguggcaucgucgaaauuccgcuccugcuucuccgaguacuugacgccaauguccaccccgcucugcagccccuuagucuuggccugggugagggaaaggggccgggaguaccagcagagggcagccagggacccuagaucuaggcccugggggcgggacagagaccaggccgcggccugucaccucugccugccgcgcagagcccccacaggcacaucucucgggugucugggacuccacacacuccacacacccaucauacagcuguuucaguuuuuuauuuuuauuuuugagauggagucuggcucugucacccaggcuggagugcaguggugugaucuccgcucacugcaacccccuccucccagguucaagcaauucuccugccucagccucccaaguagcuaggauuacaggcgugugccaccacgccaggcuaauuuuuguauuuuuaguagagacgggguuucaccauguugccaggcuggucuugaacuccuggccucaaguuauccacccgccucaaccuccaaaagugcugggauuacaggcgugagccaccgcgcccagcccauggggcugcuucaucccagcgugccuugucuuaggcaacagcucagcuuuccagggcucaggccaagaauucuggggauggggacgugguuuucgcuuccucucucucaccuuccaccaccuccucugacccaauccccgggcaccauggccaggccauuggcucugccccucacugggaugucugcgcccggcuccucccugaccaccauuccccacgugagguuacugggagccacagggggcaucugaaaacaccauuuggagcaguuaccccaggagaaaaccagcucccgcuuccucuaacagcccagccaauuccaaugucaagaccuugcuguuccuucuacgugagacaccaugucacaaacacacacucccauuccauucuacaccagacaccgugucccacccacgcucccggucuacaccagacaccgugucccacccacgcuccccgucuacaccagacaccgucccacccacgcuccccgucuacaccagacaccgugucccacccacgcuccccgucuacaccagacaccgugucccacccacgcucccgguauacaccagacaccgucccacccacgcucccggucuacaccagacaccgugucccacccacgcucccggucuacaccagacaccgucccacccacgcucccggucuacaccagacaccgugucccacccacgcucccggucuacaccagacaccgucccacccacgcucccggucuacaccagacaccgugucccacccacgcuuaccgucuacaccagacaccgugucccacccaugcucccggucuacaccagacaccgucccacccacgcucccggucuacaccagacaaugugucccacccacgcucccggucuacaccagacaccgucccacccacgcucccggucuacaccagacaccgugucccacccacgcucccggucuacaccagacaccgucccacccacgcuccccgucuacaccagacaccgugucccacccacgcugccggucuacaccagacaccgucccacccacgcuccccgucuacaccagacaccgugucccacccacgcugccggucuacaccagacaccgucccacccacgcucccggucuacaccagacaccgugucccacccacgcugccggucuacaccagacaccgucccacccacgcuccccgucuacaccagacaccgugucccacccacgcucccggucuacaccagacaccgucccacccacgcucccggucuacaccagacaccgugucccacccacgcucccggucuacaccagacaccgugucccacccacgcucccggucuacaccagacaccgucccacccacgcucccggucuacaccagacaccgugucccacccacgcuuaccgucuacaccagacaccgugucccacccacgcucccggucuacaccagacaccgucccacccacgcucccggucuacaccagacaaugugucccacccacgcucccggucuacaccagacaccgucccacccacgcucccggucuacaccagacaccgugucccacccacgcucccggucuacaccagacaccgucccacccacgcuccccgucuacaccagacaccgugucccacccacgcugccggucuacaccagacaccgucccacccacgcuccccgucuacaccagacaccgugucccacccacgcucccggucuacaccagacaccgucccacccacgcucccggucuacaccagacaccgugucccacccacgcugccggucuacaccagacaccgucccacccacgcuccccgucuacaccagacaccgugucccacccacgcucccggucuacaccagacaccgucccacccacgcuccccgucuacaccagacaccgugucccacccacgcucccggucuacaccagacaccgugucccacccacgcucccggucuacaccagacacugucccacccacgcucccggucuacaccacugucccacccacgcucccggucuggguuugaagaucacuagacacucaacauucgucugauucuucuccuucaaggcauuucucccaguucagagcuuauuuauuacuuuuguuaugauuauuuuuugagagagucuugcucuguugcccaggcuggagagcagugguguggucauagcucacugcaaccucuuaacuccugggcucagccucccgaguagcugggauuacaggcaugcaccaccacgcccagguaauuuuuguuuucuuaguagagaugggguuucaccauguuggccaggcuggucucgaacuccuggugucaagcaauucuccaaccucggccucccaaagugcugggauuacaggugugagccacugcgcccggccagagcuuacauauaaugcauaauacaaugcuguguucacuuuugcaugccuccgccaucagacugaacugcauaagggguagaccauguccuuccuguucaccaaggaaucugaaguaccuggcaccucacggaugcucagaaauauuuguaaacgaggccgggcacaggggcucaugccuguaaucccagcacuuggggaggccgaggcgggcggaucaccugaagucaagaguucaagaccagccuggccagcauggugaaacccagucuccacuaaaaauacaaaaauuagccaggcgugguggcaggugccuguaaucccagcuacucgggagacugaggcagaagaaucgcuugaaccugggaguuggagguugcagugagcugagaucacgccauugcacuccagccugagugacagagugagacuccgacucaaaaauaaacaaacagaaauuugcaaacgagugaaugcagcagcuacauccaccucgcugugugacucugggcagguggcugccccucucugggccucaccuuccccgccagggcgagaagagacaccugcaccugcgucauguucccacucucaaacaggucguuggccucgaacagguccacaggguucaugccguagcugaccauggccuugaugaaguuggacagguuuucuagcugggaagaggcaggagagggacagugagugggccucagucuccccaccuguuagaugggcccccagcaccaucccugcuccgcuccaccagccccucaccuggugccaguucugcauggagcgguugaucuuggggacggagcccggcuguagcuuguucaugagucuggagggcacaacauggggcgggggaaacagaaaccucugugagcagcgaggaaccgugaagacccgaugcugaucucagccaagcucacgccuuccugggcaaacucacggccucucucugggccucaguuuccacucuuuuuuuuuuuuuuuuugagacggcgucuagcucugucacccagacuagagugcaauggcacuaucuagacucacugccaccuccaccucccggguucaagugauucuccugccucagcccugagccucccgaguagcugggauuacaggugccugccaccacacccggcuaauuuuugcauuuuuaguagagauggaguuucaccauguuguccaggcuggucucgaucuccugaccucgugauccguccaccucaaccucccaaagugcugggauuacaagcgugagccaccaucccaggccucaaguuuccacucuuauaaaguaaucuuuggcuggguuugguggcucaggccuguaagcccagcacuuuggaaggccgaggcaggcagaucacgugacgucaagggcucaagaccagccuggccaacauggagcaaccccaucucuacuaaauauacaaaaaaaauuagccgggcaugguggcagucgccuguaaucccagcuacucgggaggcugaggcaggggaaucacuugaacccaggagguggagguugcagugagccgagaucaugccacugcacuccagcuugggcaacagagugagacuccaccucaaaaaaaaaaaauuauuuauuuagccaccacgcccagcuaacuuuuuuuuuuuuuuuuuuuuuuuuuugagauggagucucgcugugucaccccggcuggagugcaauggugugaucucggcucacugcaaccuccgccucccggguucaagcaauucuccuuccucagccuccugaguagcugggauuacaggugccuggcuaauuuuuuuguauuauuaguacagacgggguuucaccauguuggccaggcuggucucgaacuccugaccucgagauccaccgccccccgccaccacccucggccuccaaaagugcugggauuacaggcaugagccaggccaugcccggccccccaaaaauuucuuaauuaagaaaaaaagugagaaaaaccaagauuuguuaagugugagacagccugugucccugcguguacucacgugcauaagauaguuccauccuucaggcccuucuggaagucggggccgauggagaggccggugagucccucgauccaggugcggagcucugccuccuucugggggucauauuuggacaggagcugguggagcaaagggcacgagacugagcugggcugggggcacccccagcaggaaccccacagaagcucugcagaggguggggccggggacuccagggcaacagcagauagagcggccuggagguccccccucaccacacccacgcagaugcucccuuuucccaucauugggggcgccccagccacugcaggcgggcacagauaaaccgcccuccaagcaggccgacaaccggcuuagaacucacugauaaacaucagcucuaauccacucccggugcaggacaaaccuggccggaucugccuccccgcccugccuucucaccuccccgcuauaucacaccugacguuuaccacuucaaccaccugaaaccgcaccauuucacagcauuucguacgucugcaauguugugcaaccaucagcucuuuuuucuuuuuuauuuuuuuugagacagagucucacucugucgcccaggcuggagugcaguggugcgaucucggcucacugcaagcuccgccuccccgguucaggccauucuccugccucagccucccgaguagcugggacugcaggcgcccgccaccaggcccagcucauuuuuuguauuuuuaauagagacgggguuucaccguguuagccaagauggucuccaucuccugaccucgugaucugcccgucucagcccuccaaagugcugggauuacaggugugagccaccgcgcccggcccccauccugcuucuuagcaacucccgaaggagcugcccccgaggcugaccgccucuagucacgcaccuggcuccuugccaccgauucccugccaccuuucugcacccggccauuccagcuuucuuggccuucggugcucugagacaccgccguggggaaugggcugugugcuccugggcagugggugugcaccaguggggaccucgagugucccuauccagccacuagugaccgcggagacagcacugaggcagacggcaaaguguauagggggccauaagcaugggggcaggucguguagcgggagcgggagauaaacgcuggagggagaauaaaguaggguuugggcugggugcgguggcucacaccuacaaucccagcacuuugggaggccaaggcgggcggaucaucugaggucaggaguucgagacuggccuagcccacauggugaaaucccgucuguacuaaaauacaaaaaugagcugggcgugguggugggcaccuguagucccagcuacuugggaggcugaggcaggagaaucgcuugaacccaggaggcagaggaggcagugagccaagaucgggccacuucacuccagccuggaacagagugagccucugucuuaaaaaaaaaaagaaagaaaagagagaaggaaaaaaaaaaucaaaucccucucccugcucugcacccaucuccccagguucccgcggacagcuccccacucagccuccgcuuccucaucucuuccugggauuauuuggguuaggguccccugaccuggaccugccugggaugauuuggguuaggguccccugagcuggaccugccugggaugauuuggguuaggguccccugagcuggaccugccuaggaugauuuggguuaggguccccugagcuggaccugccugggaugauuuggguuaggguccccugagcuggaccugccugggaugauuuggguuaggguccccugagcuagaccugccugggaugauuuggguaggguccccugaccuggaccugccugggaugauuuggguuaggguccccugagcuggaccugccugggaugauuuggguuaggguccccugagcuggaccugccugggaugauuuggguuaggguccccugagcuagaucugccuggaaugauuuggguaggguccccugagcuggaccugccugggaugauuuggguuaggguccccugagcuggaccugccugggaugauuuggguuaggguccccugagcuggaccugccugggaugauuuggguuaggguccccugagcuggaccugccugggauuauuugggauaggguccccugaccuggaccugccugggauuauuuggguuaggguccccugaccuggcaccugccuggaaacagcucguagcccagaggaggcaaaggcggggaggccccccaguaccagcucacagcccacccagcuuggcuuuccacgcccgggggcagccccgccccgccggcaacuuugaucccgaggaaugagaacgguggcugcuggguacacagcccugccuugcccagcugcgccgcgucucugccggcucaggggcccagguccccuggccccacccccagccgcugccguccucccccacccccgcccccccgcugcccggccgccggccuuccagcacauuccuguucaccacaaacugccaggaaugcgcgcugccuccccggcuaaaucugaaccagcuguucccagcggguccggacccccaagccgggaugcaaggccgcagacacuguggauccgagcugccuccgugccguccagccgggagucaacugagccacggggaagcggggcggggggcgggucucuggcuguuucaagcagccgguaaagcgggugugagcgggaagccagggggaagcugguuucuaauugggaggcgacccuuccgugacccuggcaagcuggccgacgccucgcccacccuccaaacggacagacugaggguugcgcggggagccugcuaagcggcucuuccagccucuguccucacccccgccagggcagguaucaaccugcccccaccccaccccaccccgucuccggaagccgccccacccuccugugcccgcucccacuuccgcaggcccagcagguacuggguuccggucuuggcccugucacuugugggcuguguggcccugggcagcuggaacgacgucucugggucccuguggacaccggugcccuuagccggcuguaugcagggugcggcagggugcccaccccacugcacggggggcucuaugaaugcagggugcagauggccccuugaaggaggagucgugagccccgggcuggggacccuggcucaggccuugaccaccccaagccucagccucccuuuuuggccaagagcuggucugaaggcuugcaggggcucacagcggggaagcaggaauucucccuccagucugccggcccuggagugccgccgggcagguggcuguuggggcuggcagggccggugcccucagagcgugcagaggcaguuuccccugcagaagucagcuguaaggacaccuucccaggugcccagugggcgucgggggagggggugggcggggacgacaccccccuccagcuggaagguccuggagggucaggucccgguccuguccgugggucucgcaucacaacccccgccccccacuuucccugggaauccuguccaggacccugcugugugacccugcagaagugucugguccucucugagcuagaaccacaagugcucucuuaaaaagugucuccccuagcccuggcuuguuuuuaauuauagagaugggguuucgccauguugcccagacuggucucgaacucgcugggcucaagccauccacccagcuccgccccccaaagugcugggauuacgggcgugagcccccgcgcccugccgggccccagcucuucuuucgaggcugcaaaaccccacauaucucagggccaccuucagagaaccucuuuguuauccguuuaaauuagucagaugggagacaaagaccgugcaaagcggcuaccgccccuccccccaagacacccccaaggugucccagaggccaggaaauuccuguuuguggggggguaacacuucucaaaaaccacucggccaugccccuuccccucccaaagcuaagaggccccaaaagcagaaguguggccaggagaugacgggguugcuggggucccccccagacccccagagcguugucggaccuugaacggaccuucucgaagguugagugggcgccaggggcuucacacguggggguccuggggccauggcgaggggacgaagucagacccaacuaccccuagauguugggggggggaaugggucacucgucccccagaucucagaccugggugcuccccaagauucgcgggagccucagggggugcccgcagacauccccccaccaggcgucagggagaacaagggcccguccgccccgggucuccaagcucccugcccgggaggugccgggggcgccugggggcuccugcaccggucggagcgugcgacggccgcgcugucggggggacaaggggcgccccucacucacccgguucuugaccucggccgacagcccguacgaggggcccuuguugaacugcguggagcucauggcuggcgggcgggcggcgggacggggccgcacaggacgggacgggacgggaccgccgggcuggcgcgggguugggacgcgccgggcuccgcgcgccacgccccc

SEQ ID NO: 16312 - RNA, 5981 nt, Homo sapiens
cucaccugucaggcgguagcuacugcaccagccgguaggugauguaccugccagccgucucacugggccggaugaucuucaccaccugcagagacagagagcaggggcugcgaaugcuugaggggucucacugcagucaccagacagcaggcgggcagcacacgggcuggggauggccggcagggguccgagauggcugacccugggcugugggacccgcucccugggaaccugggucacgcucuucucugggcccaguggcccuggcuuuaagagggggauauuggggguguggucucgagguccccuccaggcccuggaucaagggggaggggcugucggggagggacagaagcccccuucuccgaguggucagcucagagcagccccagggccccuucuccccacagggcucaccugcccacgcuuuaucccaaaguagcgcgccacagggucccccgccuggauccugggcagcugguucucucggagcuuacugcgaagcaccgucaggaaaaugccagacagggccguugggggggcagggguguguguggggggggaacgcggaagucucgagggacagggaggggcggggccgguggggcuggaaaggauacuaucgggccagcagcucugucaccuccuccuuggucaugacgacgugcucagggacuagcugccgagagaggaagccaccaggcaucaccaagggcuggugagaccccacguggcucccaggugccaccacagccccugcgccuucagacggacaagagcccugaaccccaccccgauccccggcacucagggagcccacccaccccacccuggcuccacaggcgggggacggagucacagcuccuggggcuucugaggcagacgggcugggcacagccaccuccugcugggacuccuccugucccagcacuagggucccuccacacucccagcagucccgauucuacaggcuggggugggcccgggaucugcauuuuuuuuuuuuuuuuuuuuuuugagauggagucuugcucugucucccaggcuggagugcaguggcacaaucucggcuccccgaguagcugggacuacaggcgcucgccaccacgccuggcuaauuuuuuuguauuuuuaguagagacgggguuucaccguguuagccaggauggucuggaacuccugaccucgugauccgcccgccucggccucccaaagugcugggauuacaugugugagccaccgcgcccggccgggaucugcauuucuaggaagcucccggguucggcugcugcaggcccagggccacccuuugagaacccuguccuccaugcacuaauaggaacaccugcccugggccccagaucccacaucuuccuggccacccacaaacgcugcaucucugccggccccacgcaggcgggauuccgcggcgcgcgcccaccucgugcuccgugauguugaugagcagcuccugcugcagaaacugcuccaggauguacuugggggccaugucgaccagggacuggaagagagcggcucuaaggcacggcccggaggggcccagacaaccccaaccccauuuccugccucaagcuaccuggggcuuacucgugugccccaacaacacacccacgucgugaaucagaaaaccccaccgccagcccaggagccuucaacagcccgccccuccccagccucucugcucaucgagagccucauccagcagugaaguggccguggaaacucggauguguuuccauccaucacacgcuuccaggggcggcccucagagcuggcagggcgaccucuuccccauacaggggugcugcucuguguggcugcgugaaccccacagcuggugggccagggacuaaacugcucugcugacugcccgucacagcacagcagccuggcuccagaguguccgacagacagacggggaacacggauaggccccuggaggaccccgugccgggccuccucugcaagucccccuggacaucagcucaggauaaagaaccuccggcuccuggaaucugcaccaggccgagggcuggagcccacaggagcuggcgagaggcacagugcccuccgcccugacgccccuccugagagcugggggaggacggcggcugccugggguggggcccauggacgcggugggagggaggcggucggggcuugccggacaucccggccacauccuccagggcacccuggcuggccuggcccaaagcccaaggcacgugggccgccuguggguacugcuugcgggaggaggcuggggagggggagaggcuggcgggguggggcaggggugcccaccugcuuggcggagggugucaugcccugcugcaccacgaugagagcccgugugauguucuccuccugcaugcgcuggcaguacaccuugauggucuugaugcccaccuugggcuccucugcagacagagagugugcuggccugcacgagccugggcccucguggcccucgcccacccagagcccagagcacccagguuccagccccauuccacacaggugucucuccugcucgggccucggcuuccgcguuugcaaaacgaggccugaguugcaggaucccaggacaggggaagagagggcugaaaccucucauucacccggagacagggacagggggcugacaccccucagucacccagagaccagggagaagcagagaccuucgacucugagaggcucccacccugggcaguucuggggaggcgggugacucagcaccaaccucuccaacaagcagaccucacaccccaggacgcucucuuuaagaagcaucaccugaggccgggugcgguggcucacaccuguaauccuagcacuuugggaggcugaggcagguggaucacuugaagucaacaguucuaaaccggccuggccaacauggugaaacccggucucuauuaacaauacaggaugggcgcgguggcucgcaccuguaaucccagcacuuugggaggucaaggugggcagaucacgaugucaggagaucgagaccacccuggcuaacaaggugaaaucccguuucuacuaaaaauacaaaaaauuagcccacgcccgcagucccagcuacucgggaggcugaggcaggagaauggcgugaacccgggaggcagagcuugcagugggcagagauugcgccacugcacuccagccugggcaacagagcaagacucugucucaaaaaaauuaauuaauuaauuaauaaacaauacaaaaagaaaaaguagccaggugagaugguguaugccuguaaaccuagcuuuuugggaggcugagguggaaggauuguuugaaccugggagguggagguugcagugagcugagauugcgccacugcacacuccagccugggugacagagggagacucagucucaaaaaaaaaaaaaaaaaaaaagacugggcgcgguggcucacgccuguaaucccagcacuuugggaggccgaggcgggcggaucaccugagauuaggaguuugaaagcagucuagccaacauggugaaaccucaucucuacuaaaaugcaaagaaaaacuagccaggcgugguggugggugccuguaaucucagcuacucaagcugaggcaggagaaucgcuugaacucaggagguggaggcugcagcaagccgagauggcaccacugcacuccagccugggcgacagauugagacucuuuuucaaaaaacaaaaacaaaaaaaaaacaaaaaaacccagcagcgucaccagguccgguuggcagacgugcuccgucaccccacugauuaauucugggcguggggcugcgccccuaaggcgcuugcaaucccccaaccgcugagggcuuuagagccauacuagggaggcagacaggugcggagacuuccgcaaagcaggugcugaaaccgagggucccagggguccugggaaaagaggcccgagcacaagcucgagggacgaguaccggacgcugacaggggagagggggcauggggugcggaggaaugggcuggggcgggcaggggccgcagcucacaaggaggcugcgcugacccagacggggccuccugggccaggccaagaagcuggaagugcacccaacggccaggaugggggagccaagggacacuagggcaaaggacauggggggcugggggugaguggggaggcccuugugacucuccucguuggcaggaagagagaaggggacugagagggaaacuagaaagaagcugagcaugagaggggucagagaucaacggcaucacccacagcaaggaaggggaggggaguuuuccucccagacugggcagagagacaaaugcugggcaccaggcgagugggggugggugcuagcgaccggcuccucggcaggugcucugguggcuucaccggaacucccccgggacccgcugcucaccuggaaagaacacaaacaucuggucgguggggucaucguugugggccaccagcacggugagguccgugcgccgcggccgccccucacucggcuuguccccagauugggcuuugaacuccuccagggucuggucaagcucguccugggucaccagauagccacggucguggcacagcugcagagagaaagaaccagcugaccccagggcagagagaggaaggcggccaaagcucgugacccggaagucagaccugcggcugcugcagaggacagaggugaacagcaaacgggaugaacacucacugugugcuccaugacagccaccccggcccccacagccucacaccacaggaugggaccaguaugauccugagaggcucccagagauguccagccuugaccaagaccgucuguccacccagccucacagaaaccuggcagggagcaaagcccuccaaaccacuuugcagagcuacccuaaaggcagggacaaaggcggggcgcggaggcucacgcccgugaucccaguacuuagggaggcugaggcaggaggguugcuggaggccaguucaaggaugcagugagcuaugauugcaccacugcacugcagccugggcgacagaaugaaacccuaucucuuaaaaaaaaaaaaugacagggaccgaaacagaugugacuucaggcugacaauguuugaggaucggagaaagaagaaucaggcugcggggggcuucgcugaggacaagggcaaagggugggaagcaagacaaagcaaaagcucucaaacggccccaauggcugaggcaauacccugaaccgcagguccucaggccugugcccggcuuccaaaccggacucgacccaguggccuccaucugccccagaccccaaggcacggguuccgagcuccacguccccaucgaaagccccagcucgcccgcugcuucccaaccaccaacucugccagccucggaugcugaagacuccaugggguucaggacgcaaggacaaauagcgacgcugaaucacagagaagggcagagucugggggcgccccccguccccauucgcggcuuccuccuccucucgccgccacgcgcgccgcaccagcccaagccgcccacccaccccuaagcaccgcacccagacgucucgaaacccccucccuuccccgcugccggcucaggucggguccagcgccugguauccccggcgaccucugggccucccguaucggcccggcccuucaucgcugcugcuccgacgagaguacgaggagacgccgugcucgaccccaccucgggccccuacacccgccgcccgcgcccccgcccccaacaccaggcgcggcucaccugcaugauggucuugcggauuuuccagagccgguacgucuccuccucgucguccauggcagccuccgccgccgccgccgcucgcaccccuucuccgcgcgagaacccgcgcggacugcgccugcgccgaauccgaaucaggcccccuccgccuaaccccgccccgcgcuggucugucgucggcgaaug

SEQ ID NO: 16313 - RNA, 5981 nt, Homo sapiens
cauucgccgacgacagaccagcgcggggcgggguuaggcggagggggccugauucggauucggcgcaggcgcaguccgcgcggguucucgcgcggagaaggggugcgagcggcggcggcggcggaggcugccauggacgacgaggaggagacguaccggcucuggaaaauccgcaagaccaucaugcaggugagccgcgccugguguugggggcgggggcgcgggcggcggguguaggggcccgagguggggucgagcacggcgucuccucguacucucgucggagcagcagcgaugaagggccgggccgauacgggaggcccagaggucgccggggauaccaggcgcuggacccgaccugagccggcagcggggaagggaggggguuucgagacgucugggugcggugcuuaggggugggugggcggcuugggcuggugcggcgcgcguggcggcgagaggaggaggaagccgcgaauggggacggggggcgcccccagacucugcccuucucugugauucagcgucgcuauuuguccuugcguccugaaccccauggagucuucagcauccgaggcuggcagaguuggugguugggaagcagcgggcgagcuggggcuuucgauggggacguggagcucggaacccgugccuuggggucuggggcagauggaggccacugggucgaguccgguuuggaagccgggcacaggccugaggaccugcgguucaggguauugccucagccauuggggccguuugagagcuuuugcuuugucuugcuucccacccuuugcccuuguccucagcgaagccccccgcagccugauucuucuuucuccgauccucaaacauugucagccugaagucacaucuguuucggucccugucauuuuuuuuuuuuaagagauaggguuucauucugucgcccaggcugcagugcaguggugcaaucauagcucacugcauccuugaacuggccuccagcaacccuccugccucagccucccuaaguacugggaucacgggcgugagccuccgcgccccgccuuugucccugccuuuaggguagcucugcaaagugguuuggagggcuuugcucccugccagguuucugugaggcuggguggacagacggucuuggucaaggcuggacaucucugggagccucucaggaucauacuggucccauccuguggugugaggcugugggggccgggguggcugucauggagcacacagugaguguucaucccguuugcuguucaccucuguccucugcagcagccgcaggucugacuuccgggucacgagcuuuggccgccuuccucucucugcccuggggucagcugguucuuucucucugcagcugugccacgaccguggcuaucuggugacccaggacgagcuugaccagacccuggaggaguucaaagcccaaucuggggacaagccgagugaggggcggccgcggcgcacggaccucaccgugcugguggcccacaacgaugaccccaccgaccagauguuuguguucuuuccaggugagcagcgggucccgggggaguuccggugaagccaccagagcaccugccgaggagccggucgcuagcacccacccccacucgccuggugcccagcauuugucucucugcccagucugggaggaaaacuccccuccccuuccuugcugugggugaugccguugaucucugaccccucucaugcucagcuucuuucuaguuucccucucaguccccuucucucuuccugccaacgaggagagucacaagggccuccccacucacccccagccccccauguccuuugcccuagugucccuuggcucccccauccuggccguugggugcacuuccagcuucuuggccuggcccaggaggccccgucugggucagcgcagccuccuugugagcugcggccccugcccgccccagcccauuccuccgcaccccaugcccccucuccccugucagcguccgguacucgucccucgagcuugugcucgggccucuuuucccaggaccccugggacccucgguuucagcaccugcuuugcggaagucuccgcaccugucugccucccuaguauggcucuaaagcccucagcgguugggggauugcaagcgccuuaggggcgcagccccacgcccagaauuaaucaguggggugacggagcacgucugccaaccggaccuggugacgcugcuggguuuuuuuguuuuuuuuuuguuuuuguuuuuugaaaaagagucucaaucugucgcccaggcuggagugcaguggugccaucucggcuugcugcagccuccaccuccugaguucaagcgauucuccugccucagcuugaguagcugagauuacaggcacccaccaccacgccuggcuaguuuuucuuugcauuuuaguagagaugagguuucaccauguuggcuagacugcuuucaaacuccuaaucucaggugauccgcccgccucggccucccaaagugcugggauuacaggcgugagccaccgcgcccagucuuuuuuuuuuuuuuuuuuuuugagacugagucucccucugucacccaggcuggagugugcaguggcgcaaucucagcucacugcaaccuccaccucccagguucaaacaauccuuccaccucagccucccaaaaagcuagguuuacaggcauacaccaucucaccuggcuacuuuuucuuuuuguauuguuuauuaauuaauuaauuaauuuuuuugagacagagucuugcucuguugcccaggcuggagugcaguggcgcaaucucugcccacugcaagcucugccucccggguucacgccauucuccugccucagccucccgaguagcugggacugcgggcgugggcuaauuuuuuguauuuuuaguagaaacgggauuucaccuuguuagccaggguggucucgaucuccugacaucgugaucugcccaccuugaccucccaaagugcugggauuacaggugcgagccaccgcgcccauccuguauuguuaauagagaccggguuucaccauguuggccaggccgguuuagaacuguugacuucaagugauccaccugccucagccucccaaagugcuaggauuacaggugugagccaccgcacccggccucaggugaugcuucuuaaagagagcguccuggggugugaggucugcuuguuggagagguuggugcugagucacccgccuccccagaacugcccagggugggagccucucagagucgaaggucucugcuucucccuggucucugggugacugaggggugucagcccccugucccugucuccgggugaaugagagguuucagcccucucuuccccuguccugggauccugcaacucaggccucguuuugcaaacgcggaagccgaggcccgagcaggagagacaccuguguggaauggggcuggaaccugggugcucugggcucugggugggcgagggccacgagggcccaggcucgugcaggccagcacacucucugucugcagaggagcccaaggugggcaucaagaccaucaagguguacugccagcgcaugcaggaggagaacaucacacgggcucucaucguggugcagcagggcaugacacccuccgccaagcaggugggcaccccugccccaccccgccagccucucccccuccccagccuccucccgcaagcaguacccacaggcggcccacgugccuugggcuuugggccaggccagccagggugcccuggaggauguggccgggauguccggcaagccccgaccgccucccucccaccgcguccaugggccccaccccaggcagccgccguccucccccagcucucaggaggggcgucagggcggagggcacugugccucucgccagcuccugugggcuccagcccucggccuggugcagauuccaggagccggagguucuuuauccugagcugauguccagggggacuugcagaggaggcccggcacgggguccuccaggggccuauccguguuccccgucugucugucggacacucuggagccaggcugcugugcugugacgggcagucagcagagcaguuuagucccuggcccaccagcugugggguucacgcagccacacagagcagcaccccuguauggggaagaggucgcccugccagcucugagggccgccccuggaagcgugugauggauggaaacacauccgaguuuccacggccacuucacugcuggaugaggcucucgaugagcagagaggcuggggaggggcgggcuguugaaggcuccugggcuggcggugggguuuucugauucacgacguggguguguuguuggggcacacgaguaagccccagguagcuugaggcaggaaaugggguugggguugucugggccccuccgggccgugccuuagagccgcucucuuccagucccuggucgacauggcccccaaguacauccuggagcaguuucugcagcaggagcugcucaucaacaucacggagcacgaggugggcgcgcgccgcggaaucccgccugcguggggccggcagagaugcagcguuuguggguggccaggaagaugugggaucuggggcccagggcagguguuccuauuagugcauggaggacaggguucucaaaggguggcccugggccugcagcagccgaacccgggagcuuccuagaaaugcagaucccggccgggcgcgguggcucacacauguaaucccagcacuuugggaggccgaggcgggcggaucacgaggucaggaguuccagaccauccuggcuaacacggugaaaccccgucucuacuaaaaauacaaaaaaauuagccaggcgugguggcgagcgccuguagucccagcuacucggggagccgagauugugccacugcacuccagccugggagacagagcaagacuccaucucaaaaaaaaaaaaaaaaaaaaaaaugcagaucccgggcccaccccagccuguagaaucgggacugcugggaguguggagggacccuagugcugggacaggaggagucccagcaggagguggcugugcccagcccgucugccucagaagccccaggagcugugacuccgucccccgccuguggagccaggguggggugggugggcucccugagugccggggaucggggugggguucagggcucuuguccgucugaaggcgcaggggcugugguggcaccugggagccacguggggucucaccagcccuuggugaugccugguggcuuccucucucggcagcuagucccugagcacgucgucaugaccaaggaggaggugacagagcugcuggcccgauaguauccuuuccagccccaccggccccgccccucccugucccucgagacuuccgcguuccccccccacacacaccccugcccccccaacggcccugucuggcauuuuccugacggugcuucgcaguaagcuccgagagaaccagcugcccaggauccaggcgggggacccuguggcgcgcuacuuugggauaaagcgugggcaggugagcccuguggggagaaggggcccuggggcugcucugagcugaccacucggagaagggggcuucugucccuccccgacagccccucccccuugauccagggccuggaggggaccucgagaccacacccccaauaucccccucuuaaagccagggccacugggcccagagaagagcgugacccagguucccagggagcgggucccacagcccagggucagccaucucggaccccugccggccauccccagcccgugugcugcccgccugcugucuggugacugcagugagaccccucaagcauucgcagccccugcucucugucucugcagguggugaagaucauccggcccagugagacggcuggcagguacaucaccuaccggcuggugcaguagcuaccgccugacaggugag

SEQ ID NO: 16314 - RNA, 850 nt, Homo sapiens
ccgcgcccccaaccgcucgggcgcagcagccccgcucggcccggagacgccccgccguggcccucaacgguccagcuccgccccagccgucccggaccccgcccccugcaagccuggacccccgaccccggccccggcacgcgcgccugcaacggccuggacggccccuuccccgaccacgacccgcgcgcguggaacaaccccuuccccuuccccgaccccagcccgcgcgccuacaacggccuggagggccgcggagcgcgucgcaguacggucacccgcguccgugcccggccggggguggggagggggagcccccagacgccccccaccaaggucacuggagccugaggguuccccacgccggcgagcggaggcagggaucgcgcgcccgccccaacggucaccgggccggcaacggccgcggcgcuagcucaccauggucccggccaggccaggcgcggccagagccccacagagcagcgccggcuucaguaggcggcaaaggcggccgaggcucaucgcggcggggcugggagccagcggcuccuccccucguccagccgaccaauggacgcgcgucggcuuuccgcgccuccuuucccacggccacgcccuccagagcgcucauuggucagacgcgucgguguugagcgcucgcgccgacgucagccaaugggaggccggagugggaagaaggcggggaagggggggcgggaccggacgugcggacuuguuguuggcgacugcgcaugcucgcuugugucuaggaggccguggccuggcuggcggcgcgucgggaggcagcgcaguuauccggcugguugacagcagcgcggccgcaggccag

SEQ ID NO: 16315 - RNA, 11720 nt, Homo sapiens
cccagaagaggaggccagucacaauggacagcgccggggccuccccaaggccguguguaugaacggcacagaggcggcgcagcugagcaccaaauccagggcggagggccgggcccccaacccugcccgcaaggccugcuccgccagcagcaagauccgccggcugucggccugcaagcagcagugaggcuggccgccugcagguggggcgcggcggggcccggguggggcauguggggacaacgccuggaugccacagccagccgugagcauagcccgcgcuagucagucauggugaccgucacguggcugcgcgugguugccauguggccuuuggguggcuuggccacguagcgauccccguggagggugccgucucggggccuggugucuggccagcgugcuggucauggaggccuacguguggcggggcucugggggggcgugccguccucacagccaccucucagagugggugcauuccgaggacccugcccugggccuggcgcccccuccccaugcccgcgccgcuuccaggaaaggcuuaugcugggcucagcccagaggcuuuugagcaccaguggguggugggugguggggaggggccgcggccuccauggcucugccggggugccgcaggcucugagccagcugccaaguauggcugaggcugagucgugccggacgcugcccugucucucccugugugccugccuccucucccagccccagccccagccccgggugggagacggagucccagaggugucagagacccuuaagucaccugccgaggaugcgggguggaugggggcccgaggcugaagccccugccuugccacagccccucucccagguuuugggggccaccgccugaguuacaugucugucccccaaaugggugcccacagcccauccaccagcgucagagcccgccaggccccacugcaaaaggccacacaauguaccccgggagugacucaaggguggccuucccuggccuccccugcugccccccaggaguccgguagccccaugacuguaccucagcuucuccauccucccaggggcccgcgggaggcggagaaccggugcccaggcugaccucuuccgucuuccuuccacccugcagcccguguccaggagccccgccaggugcccgcgccaggcccucagucuuccugccgguuccgcccgcccucccggagagguggccgccaugcuucugugccgaccacgccccaggaccuccggagcgcccugcagggccgggcagggggacagcagggaccgggcgcagcccuccccccucggccgcccggcagugcacgcggcuuguugacuucgcagccccgggcggagccuucccgggcgggcgugggaggagggaggcggccuccaugcacuuuauguggagacuacuggccccgcccguggccucgugcuccgcagggcgcccagcgccguccggcggccccgccgcagaccagcuggcggguguggagaccaggcuccugaccccgccaugcaugcagcgccaccuggaagccgcgcggccgcuuugguuuuuuguuugguugguuccauuuucuuuuuuucuuuuuuuuuuuaagaaaaaauaaaagguggauuugagcuguggcugugagggguguuugggagcugcuggguggcaggggggcuguggggucgggcucacgucgcggccgccuuugcgcucucgggucacccugcuuuggcggcccggccggagggcaggacccucaccucucccccaaggccacugcgcucuugggaccccagagaaaacccggagcaagcaggagugugcggucaauauuuauaucauccagaaaagaaaaacacgagaaacgccaucgcgggauggugcagacgcggcggggacucggagggugccgugcgggcgaggccgcccaaauuuggcaauaaauaaagcuugggaagcuuggaccuggccgucuggguuuuguucgcgucucaacguggauggggcggcagcggggcgggcgccguugacaugcggagggcaguggggacucggggcgcgggagggccggggccggcucccucagggccggcggcagcagcgguggcggcgcgguuauugcucggaggcggcgcgggcugccgccagcacacgccgcagugagguaaacggucucggaggucggcagucacgguguugagccgccucccggcccagggcggcgaacucgucugcgaccguuagcgccccgcggcccccgcccgggcgagcucgcgcacgcgcccggcacgcggcggcuccaucgggcccagugggcugcgcgacccucggguggcgggcccugcgacuaagcggccgccccguccgggacugagggcgagugaucguuguccucaggagcccgaagcugagagccguucacgccccuuccuucccgcccagccggggucuccgcggcccgcgccucacgacgcccagcacccggcaagcaccggaaagagcagugcacacuucggcggcgcgagggcggccggggcucugcgccugcgcccugaagcggcgagcgcgccuccgucgcccggcgcgugcgcgaagggcccgcgguccccgcgcauucgcgucggggcgucgcgcccccacgucucucccgccgccgaggccccgugcggcgccggagaagcugccagagagaugggcccaggacgcgggacuuaggccgggcuguggucgggggacgugggggcggcggcgaccaacgcgggagucgccacgacgggcucggcgaggcgcggcggaaagagucucucgucgaggccagccgccagcuuguccagcaccgacccggaugguaggacgcacaggcccgagccggggcaccccccgccgcccggcuccuccucgaugacggggauggcggggucgucgccggcgccgcccagggugcgaccgucgggcgggccguccacgcugucgccgcgccgcaagggcgcacgcgcgggucgggccgcgccggcaggcggugccgggguuccggccagggccggggccgcgcgggcgccggggucgcugugcugccggccacgcugccacuguuugcgggcgugcgggugcgcgcgggcgcggugucgcgcggcagccggcgugucgucgaagugcgggucguggcgcaggaacucguggaacagcgcguccgucuucucgucgaugcuguagucgcggcgcgggcggcggggccaggcgcgcgggcugcggggccgggcgggcgcggcagguggcucggugucgucgccugcgccgcggcccucgaugcuggcguagccacuguccaucugcagcagccggcgcgccucgccguccuugggccgcggcgcgggcggggagggcggcgggaaggcgggcgccgcgcccccggagccugagcccgagcugucgccgcugcgcaccgagucgcggucguugccgcugcugcugugguccgaggcggccgcaugcagcucaagcgaggcgcgcaggcuccacaggucgcgguagcuggucugggccugcucggggcccgcgucccgcucggcguccggcuccaguggcggcugcugcugcucaggccccgcgcugcccgcgccgcgcuccgggggggaaucggggcucgcuccucccgcugccucggccgccucuagccugcaagccaggccgcgccgucagagccccgccgagccccgcgcccccuacccggccggccaucccgccucuggaucagggaggguggacgcgggugggacuugggacucgggcgggccuuggaaggugagagcuuuaaaaugagccaguguguuuugcaggggaugcgucuugcauugacccugagcuguggcgccugcuuauuaagcagggugccuccaugcuggacugcagacggcggggcccccucccuuggaagcccccaggaaaagucaacaugcuucucuccgggagucacguuuucccagccucccaguggacgugggagccgcaggggauggacuggacgcgguugaguccagcucagccccugcuccaggcuagggcucucugcccacccaugcuggauaaccagcaggaggacagugcacagacgugagggucacccgccauaccagggcugccccaggaacccugcucugccccagccccacgccccauucccaucccaccgacgugggcccugggcuucagggaaguugcccuuggguugggggaggggugcugcuggccggaguggucacagcagcuucugagaggagucugcccagccuugggagcaugggcggggcgggggugggagagggccugggaccacagcagaacccuucaggccucggacuccaccagcaagcagcaguaccagcgccauccucggggggccccuccuccccacccaccgcccuacccuuacccagucucucccugcuucccuccucugguccaugcuggagagguggccccagugaguccgccucugggaggggccuugccgcuggaggcaggcgagcgcguguccacggggccuggagagcgcucccugggccgccuaggggggggcgaaggggggcaagggcccacagguccaccccuagcaccuccaucuacugaaaaauaccugccgagagcagggggcgggcuggccagaaaggggcgggggugcgggaaggccacggcgucgcccgcccgggcaauguacuggaugaaguccuccuggggggcaucccccuccuccugcuccgugcucucacuggcugcccgcugccgcuggaaguggugccgcuugggggaaccugcgcacgggaugugccguaagcgucagccggcaugugccuccacccgcuccacacacacacagaaugccuaugcccccccgccacacacacacaaugccugugcccccccgccacacacaacgccuguggacccccaccacacacacacaacgugugccccccacacauacaacgccugggccccccccacacacagaacgccuguggcccccauacacacacauagaacgccugugccccccaccacagaacgccuguggcccccucacacacacacgccugugccccccccacagaacgccugugcaccccccaugccugugccccccccacagaaugccuguacccuccuacacacagaacaccuguggcccccacacacacacaacgcgugugcccugucucugucucacacacacaggagugggcccuggcuugggccagacccuggcuggcaucuccccgggucaggugggugcggacaguggcuguguguacacccuggaguacaggugagaaaacugaggcacggagggaagaggugcugggaccagagagccugagcagggcagggccaggaagcgagugaguggaagggccucuggcaccgauagugccuuguggcagcccuggucaacauguggccacucauaagggcguguccuggacaccugguggccugcacagccuggcugaaacuacggaaggcaugagagagucacauacaggcuggugggggccaacgaggagagggagagaggugcccucuccugccagcuccacccuggucuggagagcgcugggggacugccccaccccugccucggcccccuucucccaacagccuccccagcaaagcuugagugggcaggccccagcaaacagguucugggaugugcugcaaccacauuggacucuaaaugucucuagucaccccugggccccauucauuucaagaucuggauucucucagcuggagcggggcagccagaggaggccuuccccucccuggccccuagcuaccuugggggugggggcugggagaacucaccccacccccgcuggcuggagccacaacacagggucucccacugucugaugauguguccucugucaugcugacagcaccuucucucugcacuuguccccuauccuggccucaccugacgacaggaccugccacccuguccacaaggcagagcgggccccagccccucugggcugcccuggcccugcugagcuggcugagcagggcuggugccugcugccagugcuacagaugggacaccucugcuccccacacaaacuccugccucgagcccagauaaggcagcccugucuccaggauccugccugacccaaggccugcagaauugaagggcuacugucaaacaguccagggaucuaugugcuacagcccagagggcaaaagcacccccugccccggagcuucgguaaguuuuacuggcacacagccacgugcauucgucaugcagcgccucugacugcuuccucgccucaacagcagcagaguuguggagacacagccucucugaccauaaccccacgaacaccaccauccggggccugaugggaaaagucugcugaccccuggcccaguccaacacuuacuucguguuagaggaagucagagcccagacaggcagagggccucggccaaggucacacagcagcugauggucugccagcgggcgagggaggggccccgggggaacccgccuuccacucacauucccagggaugagagccgagcauggcugggaggggaugcaggccacaggccccacccucugcgcuccacagugaccagguggcccccgacacccuccuuuaccaccucauccuggaugccccaauggcccgagagcagucggggcgcgcaaagccuucccgcacagguucccggagcugggugggucuggcucaggccgcccgcacacucagcccucccagccaccugcagaaccucaggcagcacgcccgcuggcagacugggcaggacucagccccagagcaccggcuccccacccagcccacaaccuccugcuccuggauguccagggcagccccuggcagccagcacccagcccacaggggcccacucuccaccaggugcuacagcucaccucucguguccagacuggcugcccgcuggcugggcuccagcuuccacuucuugaccuugaaauaggggcuggccccauccaggcuggcauggcggcgcaggcgggugaggaacugcagaacgguaccugccccggaucccgggcccgccuccccaggcccugcugcagccccgggcccuccagccuuggugcuccugguaccggcauccaacuggcagggaacagagauggcgcucaggcuaagacuucuuccugggcccgugugcuggccccagguggccguaggucugagagacagucccaagggccccccaucacugggacagagagggguaccugcucggagaggggcagaagcgggaggaggggcgcucaguggcugggugggcuacacuaaggugcucugcccucuggggaaggucccuggauaugggguuuggagagaaaaggaggugcgugucuagaaggucucucgcccacggcgugggcugcaggugagggagggcagggguggcgcacccucuccagaaccuagggaaugucaaaugaggugggagccuggggugcccccugcaugugugaggacacgccuguguccggugugcggccggcucccucuuucucccgugugcaaugacccggcgggccaaggagggcugcgguggcuggcaggucauagguugaccuugguccuggacuggggacagggaggggaaggagccuccccggcuguggacaccaugggggacacgcaggggcccucaccgaggugccuuccccagagucgcuagaugccgaggggcugaucucugcgaagucaguggcgcccgcggcugaguuguaggggucaccuggcagggcggagcuggggcccacagagcggccggugagggccuuccccgggggcugugggacagagccaggugggggaggaagcagugacaggucaaagagcaugggugggugagggacaugggcaggugaggagcaugcugggcuuggcccccugcccugcuccaccccaccccgcccaucccgagaugagggccacccagaaaaagagugggugagggcguggggguccgggaguccccggggcugccucccgucccccgaggaaccggggcugcugcccauaggcucaccuggaagauggccagaguggccuugggagagguggccggguggggcgugguggcugagcuggccucgccugagucacacucguggauggugacaaucuugaggggcggcaggugcaggugcgugagccgggcauucuucaggugguggaagucccccuccgucaguguguaccugcgacagcaucuggccaucagagcccgcccaccucccaugcccgaugccccagcugccgugcucugccauccacccugccggccugggcaggggcaggcgaaaggggggcaacuggccaaggccgccccaccccacggucccaguccaggagccucugccuuggucccugcagccuccgcacccagcuccucccccgucccggcggccaggaccucagacaggcccuggggugccucccaacgccgccccgcuuaccggcgacccuuguccugcgucuugcggcucugcucaaacagcgccgccucauugaaggagacccggcggcccguggagcugguggacaggaagcguucggucuccgcauccuggcacucgggguccucuccccggaagucggggucugcguggagaggcaggagagggugggccccgggcgggccacgccaggcgccuggucccgggagggcugcuccuccgggcggccacggcagggagggcuggggccgcggcacgggcggccgggcuggcggggcgagggacacucguccauccgcucacacacucacucgcucagcacgcgccugggcccaccuacgccugggcguuaaggaaacagagaugagucggaaucgagcugcgcccagucuggugggggagacagacagacacagacggucaggcagcccgagggggcggcggguggccgaggggcggauggacaggcgagcgcacagccaggcuggccagcaccucaccuugggcugggugggugccguuguccagguagguggugguggucuucuccgcuuccuccauggcccugggagagacguugggagagcccaguggcacggagggcccagauagccacagugggucucggcucuuugccccaagccaagcccugcgcaucacccagucuccagaggcauagcccacccugugacucagaagccagugagguagaccccccaccacccgauggcacccacaaccaccaugcaccugcccagccgaggugggggccucgcaccuguugaggcgcugguggacgucccagcagcgcuugcagaggagcaggacgccagacaacaccaccagcgugccccccacgaacagcgacaucaccaccaccagcagcacguaguuguccaggauggggucuggcucugccugcgggugugcagggggggucaggugcugcuggccuggacgaccuccugccccucccaccuguccccugcacccaccguggggcguccaguggcauugucccacgacgucgucagggcuacuguggcaguggugguggugguggugguggcggcuguggccaugguggcugugggcugcauucugaacuggggaggagggcccuguggggaggaagccuggucagcuccagcuagaccuacuucuccugcaggagccacugcagacaagcugggucuucccugcaggagcaggagcccacacagggggcagugacucauggagagguagcagagccggaggcagccuccacccggcuuggcucugcccagcgggccccgggggcucucucuggaccuccaucucccauccccauggcgggggaggaggccuggcccucugagggugcgccuguacccaucacaacugcacacagccggugcggccuguccugcaagguagcgccaggcccuggagcucagcgcugggcagggcaagcacucggaggaauggggacgccaaggcggugcagccggcucgagaaggacuccagacgcccuguccgccccaucacggggguggggggcuacccccaccccaagaaguucagcuacacccuggcagggcccacccggccaugguuggguagagggagaccucccgcugccugcgcgccagggagggugcaggggcugggcgcgugcucccgggucacgacuccgggagguggaggucuccccggugcugagugcuggugggagugcaagggacaaagaaggcgcaucuguucccagccccggagaagcugguucccauggcgacugcggagcaggccgcggcugggggggcggguugccagggagcggcggggagggggcgcgggggcggcggccugggggggggcggcggccucgggggggcgggcgcgaagccgcaagauggccgcggccgccuccccgccgugcccagcccgggcgcccggagcauccccggccgccuuacgcucgggggaaacugaggcggggcgcggcaccagggaaaggagccgccuggacgcugugcggcgcagccggguggggaggcccgggaaucgcagggggucggggcuggcgccggggugcucggcggccccaggucagcaccgcacgcgcgagaccuuucccggagcgagaggagcgcacaggcggcagccgcuccugcccuucccggacuuccgcccacacgcgacagcgggaaacugaggcccaaagccgggcagggucccggcgggggcugguguccucagcgcucccggucacaggcugcccgggcccugguacugggggaaggggccgcauauguaggucgggaaaugaguucaggcuggaggggguggggacaggcgcaggauggugaccggaggccggggaagauggcaggaggccgaggggaagaggggggcuccugggggaggcggcugcgggagccgagggcggagguuccccacggggcagcaccgcgcccccgagccggccaaggguggggauggcgagccaggggaggcagggacccgacgccagggcugagccgagacgccaucguccucgcccgaccucacagggagaaacugaggcuggggcggggccugagcgggggucccucuggaggcagccggguggggggcgcaaggcccggaucucgguccccacgcccgccggacuccuccgcgcccucccuccggccgcuuagcccacagccggcugcgauccccggccugucccccguccgccccccgcagccccgagcccgccgcgccuaccucagcgccgggacgagcggcccaugggcggcgggcuggcggcgggcggcugcguggcgcucgcggcuggcuccggcgcccgguggccgcggagcaggcggagaauuuaugaauggagagcgcggcgcgggggaggccggcgcgagaggaggggccgcgcacgugaccgcguuggcggcgcgcccgcuccgcgcgcccggugcugcccgguccccggcccgccgcccccgcugcgcucgccgcugggucuggcuggcuccgcgccggccaccgccuccccuucccuuccggcggggcggggggcggagccugcgcucccgggcgcccacuccgcacgcggagccgccccccgcacccgccgcggcggccgagccccgcccccggcccaucggcacgauucaccucgcccgguccugaggucccag

SEQ ID NO: 16316 - RNA, 10561 nt, Homo sapiens
uguguuucauuuucuguuuauuacuugaaaucacggugcucguguagguuuuuuuuuuuuuuucaauuuuauguuuucauacaugaaacucacgccaggugccgggacccccacagcccgaccccccgagggcggguaaugcuuucuugggcagcccuuaccgggcagaggguggcgagccgguuccugccuggagguuccacccucaaccaguggaggcacagacguuauuuaaaaaucguuaaaaaacaaaacagaacacacauuuaaauagguauccaagacaguucuucaaaaaacaaacccgccccuuuuacuccuuuuuuuucuauuuuuuuuucuuuuuuuuuuggaaaaaugaaaacaaaacaaaacccaaaauccuugagcucuacccucugggaccccucccugcccacccucccacaaaaaaauuuacagcgcuacaguuauaacacgugauguucacaucugaaaccauuaacuuucaacacauaaagggggggaguugaggaccugggguucaccuacgagaacaacggugggggacaggcagagccaggacaagaccgacagguggggugaggaaggguccagacaucuccauuaucauuaaaaaauaaaaagugaguggggaaaaaaauccaaaaacuaccccauugaaauggccccaguaggggauuugucccuccccucuggagacagacaccccuagggcaggggcacugagaggcaggggguccaaauuagaccagcagcggaccccgccacggggguuaaugcuacacggaguugucgcccccugcccaggggauucacagcucagcacccccucccauccucgcugcaggaggggcccccagacagucccaaauccacaucccucagguugggccgggaaggagggcucggaggggggaacuccccagcacccagccauucucuccccuuuuucaagaguuccccaaccacuauuggcucagucagaaaauuaauagucuauaaauaccccaaacucaggcaggaggucagaaaacacgggagugggggcggaggaaacagcacaguccgccggcuggggcggggcggagggcaggcuggggggguaguuccccucucccuucccgacaggaaagggugccaugccccugcacccaaaccccauggggaccucagccccagccucugcuaaaacagcuuugcucuccuuguuaaagaaaugaaggaaaaugcaaaaaaaagaucaagaaaagaggauaggaguggaagagaaacaguccccucguuggcuucugugaccuguuggcuugcuguagcccagugggcgcugcuggccugggguggagaccccgaagucugcacuggggggugggguggguucugcgcacugcggccccuccccucaucuguaaagugcauaaugacauaucgacauuuuugacuuaaaaccugaauagggucgggggggaaaggaggcggcggaagggauggggcgcguuucuccgucuccuucacucuccgccauccagagagacugcuacauauuggagcuggggaagguuggcagggaggaccgaccuggcgcagaggugaaaggagacagacggaggaggaggaggaggaggaagaggagggcaggagugaagggugaaggagguaggaagcaaagcccaugaagaguccaggaaaccacggucagaacuuuuuaaaaaaagaaaaaaauaauaaaaaagaagaaaagaaaaaaagacuucuggcugggggaguggccgccugcccuccagggcugggccacguucucuccggggcucucggaguccccgccgcccugggcuggggugcgaggggcgaggguggccgauccgaagauccuaagccaccacgaacucugacuugaugucaggguugacuucuggcuuccacacggaguccucgaagucgaggcccaagccggaggccucgcuggggcugccgccgcccccgcugcuacugcugucgcugcggccggccuugcggcugggugaccagugguacggaccccgcgcgucccgccgggccuuucuacggagccguuucugcugcagaagcagcugcagccguuccaccuugcagcgcguggcgcgguuuucugucugccgaagccgguccccugcaaaggagguaguggccugugacucccaaagccuccaccugcugaacacagaggaccaccccagaccccagcaaaugccccugaggucagacacaguccugcccucccuggagggaggucagcaaaggaaacagucaaggacauccaccaugccgggcacagugguucacgccuguaaucucagcacuuugggaggccgaggcaggagaaucgcuugagcucaggaguucgagacaggccugggcaaccucaggaguucgagacaggccugagccacagagcgagaccccuccucuacaaaaauuacaaaauuagcugggcauggugguguuugccuggagucccagcuacgcagcuggcuucuaauucuccagcucagccaugagcuggggaggucaggacuguccugccucauucuuccuggaguccuacauggagggggcuuggccgcuucugugauccgaggggagauacuuggggguuguaccuugguuuuuuuuuuuuuuuuuugagacggagucucgcucugucgcccaggcuggagugcaguggcgcgaucucggcucacugcaagcuccgccucuggguucacgccauucuccugucucagccucccgaguagcugggacuacaggcgcccaccaccacgccuggcuaauuuuuuguauuuuuaguggaaacggaguuucaccauguuagccaagauggucucgaucuccugaccucgugauccgcccgcgucggccucccaaagugcugggauuacaggcgugagccaccgcgcccggccaguuucccacuuuuaaacugagcugggaggagcccccgcgacgggugcagagcccaagggcaguacaguagccaucuucuggugagacucuggagggaguaacccgccguuugggaguagcuggggccaggcuggcagggggguuguguucgcugcuuuuccaagucacugaaaugcuuaggggugggcucuggccccgccucggccugccaggccugacuuggccauucacagaggcaccaaaugccaucuggagaugaugccccggguggggguggggcaggaggaagugggccuguggccccccgggagcacacaaggacacuuugugcccugacacacaugcugccuucucuccgggcuggagcagagcaguggccacggcagcugccaucccccccagccccugggcaggucagcugcuccugagcccaccagcucacacagaggggccuugagaagcccaggcgggcggggaagguaggacccccgaggguggccacucacccgggggcuugcacaugcggaucuggcucuggcccugcagcagggaggcugagggggcagccgugagcuucucgcaggagguaguucugggggccaggucgggggccggugaggccggggagcacugggcguggcagcggagcugggccagcgaagggggcaugcccugguagugccggguggcgcucaggaggucguucaggaucugcaggauggugccgaugucacgccgcggccgcccgcugcugucuuggcaguugggguguagcgugccugcgggcagagguggccgugagugcccggcacgggcacagucccgcauguccaggacgggcguccacgggugugagcucaugagcucaggcaauggcguggacaugugggcugaugugcacgagggaccacggggcgggagcgggacacguccccaguaugcaggcgccuggugacccgcggccccccgggcagggccaggcgugugugugggggauuccugggggacaugugaagugagcagacggacacagccuguguaugcccagaauauguggagucgccuguggguggauguagaccccaaaugcacagggucacgggacacacgugagcucacacaugugcugugacaccuaccagagaaggucccugagaagacccccggggcgugauucacaaagcucucgaugacggcgccggguuuucgggagcggggggcagggcuggccccugggguagacguggugcuggcaccaggacuggcacugcugcuggccgugggggagcaguccaucugcugaugggaggaaggggcacaugagcacgggguccaggaucaggggaucaccagcaacccagggaccagagaucacccaccagcccaggucaggagaugaccugucaacacaggguuuagagauaaacuagcccaaggucacgaggucacaaccaacccaggacacagagaugacccaugagucaaagaucaagagaucaucuacugguccaggucaugucaggcgaugaccgucaacucaggaucuagaaauaccccaccaaucuaggcugggggaucacccaccagcccgaggucacaggauagcccuuaauacaagggacucaccugggacuaagaguccuuguccuccccaagaccuccccaggacggcccacccuuuggauuccaaccaagggucacccuucccuuccccaggcucaccuccgggcaggugguggaggcugcgugggaccggaaggagccggcugugaugggcgagggagaugcaggggacgggcuggugggcaccggggggacucgggcggcacuggacaccggccggcagggcgaggacacgggggaggcuaugcugggguccccccgcgcagcagcggcggcggccgcagcggccagcacauggcgguguugcaguggagcgugcugggccgcgagcugcagcugcacgaacaucauguggucgcccacacgcaaggccagugucaguggcgaacggcccgacaggaagucacugaccugcaaggagagcgguccgucagcugggagccccagcuugcggcgcccccagcccagcccggcccaguccccccgcgcugugaccuggggccucucgccgccccucucugggcucuggggucccugucggugccacggacgcuuaaauaaaaugaaucuguauuuccggaagccuccuccgccagcccggcccggcccgggcgccgcugggggcuguggggacagaggcgggucagacgggggccugccccucccuggccaacuaggucggucuugcaaggggaaacugaggccagagggggcggggcccagcuggcagucacugaccucaaacaaccuucacuuugccuuucccccacccucaugggccccuagauccucucugccuguggauacgggaggggcuccaccucaggcccccucccagcuaagucaccagggccagcaaguggguggaauuccugcacgaauucuucuguccuaaccuuugcuuucucaagauaaauauuuaucuguccugggcggggcggaggccuagggggcuguggcaaggcugcaggaaggggcccugaccgcccuggggcuggagucccggagggcacaaccugcuccaagcacagaaacccucaaucugcccccguucaggguggguguggguugaaucucacccuguccucgccaagcccccugcucuggguaugggccagagcccugcucuccccaguggccgggauggggggggggguggcggagguuucugagaagugacauaggcugggaugacucagaaccgaccgccucccagcucucccucccggcucuccucuccacuggcaguagcuggcguaaccuucucugcuuggggcccauggggagggaggcagggaggagggcagggugaagcccccacccugcggcccagccugcccggcccccuaccccccugccccaagacagccuuugcaggaagggcccgggguggcuucccgagagcagcuggaguccccaccaccacccgcccugcaacuuccucccuggggaaggcuaaugggcgggcaugacucggugccaggcagggaagcaacccuggggagcccagugucuccgcccagcacccccuccagccccccccaacccagcuccuuccugacgcaggcgcccagggaggagggugugaagccaacacgcccugggcccccugccaaccgcagccccccagcggcggggagcucugcucacacucgccccaggaaaucaccugcagcccccgcccuggcucgggaccccggcucugcccccacgccacugcugcugcugcuguggccacccccauggcagaccacccagcucccggcccccgcccugcccccgcgauguagggaaagggcaggacucuacaugccgcugggaaagcggaagggggugcgggccucggggccagggaggcccgggaagccggccaccccuugcuggggcggguggcagccugcgucccccacccuggcagcgggcggauugcugaggccugugucacccuccugggagguggccagggcccuugucugaggaaggcuuggccgcagccaagaaaaugaggaaagaaggagaaaaaaaaaaaaaaguccgcagcaaaaccgggaaccgggugagggccagccccagccucccuccuggccgcuuacuaaauauuuuccuaacauccugucuaggccucacuggccccagggcugggcacccccgcccccuccccuuucgggguagagaacaaaggccagagagaggaggggagggugacgagauccccacccucucacgaugggggucacggaaggcggaaggagugucacccaagccgccacccccagcccucagcagaaauguaaaaaaggagaaacucgcucuggggaagccacagcggcuggaggggggcuccucggugggggcggagggggcuggggaugcaggccagggugugagcggggaugaggccccauaggccaaggucauccugcaggcagucuugugaaagccaggcccccuucccccagggcagccaccgugggagagaaagcccuccgggucagguggugaaucuugggggagaggagguggggaggccaggccaggcuggcacccaggcgggguggcgcguccccuccccucccccagccuccugggagcacagacaacccccaggccccgucgguggccaaggcacccugcucccagggcugcccuguuaggaaggggcuggcgaggucuuaccugcgucuccgugagacucucgagagcuugcaucacggacuguuccggccuugaggccugagacuacaaagagagggaggagaggggccugaguguggggucggaauccugggcuggaauaggggguggagagggcccugcuggcuggcggggugggggccccagguagugugugugcggacagguaccgagggaggggcuacugccugugugcgggggccucugggggcacgcagccccauggccauuuaccaugaggcccgcuuccacgguggguaccaaggucagcuugcugccaucacccacgccgaacuccugcagcuuccccgaacugagccggcuggggggaggaaggaagagcaugagacuccgcggagacgacacagggacgcggaagcagaggccgcgggggagggcugugcuuguguggggagagacggauaaguucccacccccaccccuucccggcuuccagauccagggcccuaagcgcgugcagagaggucuccgucuggugcugggagccccauccuggcgauucggaccccuucccuccaguggaacccccgcccuggacucuggcacccccucugcaccccaaccaggcacuuucuccuccucugggccccagugugcucuaugccaccuucccccacgaccccagggcagccccugcccccaauucccuaauucuaguccuggcuccucuuuguaggaaccacggguuucggcccgaggagaggcccuggggguugcgccgggccgggcucccccuccuccucccuccccggcgcaggcggccgccgccgcgcagacaaaggagacccucccccuccgccccucccccgaugggccccuccacugggauggacacugcguguccccggaggcccgcggggggagggcuccgggccugcaggcgauuuaaauaccaggggggaggggaggcugcggggagcgcucggaggcgagaacaaagggggggagagagacgcaaguggggggagacagccagacgcagaggaggccgccgagcagaugcggaagccggcgcggacgcaggcgggagggggcgguggcggcccccacacccgcagccgggacccccgcaacgcccugggauuccugcccgcccccaaggggggccgccgaagcccggcccgggacgcccucgcagccgccuuugugcggcgaccccgggcgggggagggggccgaggcaggcgaggccgagcagagggcgcccgagagcgcgcggcgcgcccccgcccccugucuggccgcccccugccuuccccgcgcggcgcgcucuuuguucccgcccgggggccggggcccgagggggcggccggccgggggcgcgcgguaccuacgugucuuuguggagaagagccaggcgcuccuugggcacuuugaggcgcugggacaaccgcuugcgcagccccuccaccgucucgucgggcggcacggccaggucguagcgggugcccguggugcuguggauggcgaggcucaugggcgccgccucggccgccgggcccagcucgcaggcgccgccgggggccccgcgccggcagcuccgggcgccgccgggcugcggcuccauccccggcgcgcgcuggggggcugggggcggcgggcgccgccaauccucgccgcgccuccgggacaggggcgagaggcuccccggaugccggguccuccgggcacucgggggcgcggagcagcgcgcguccuccucgagaaagucccggccgcggaaugcgagaccgaaauccaaaauccgaguggcgcuccgaggucgcuccggcuccugggggcgccuuccggggguggggacggcacuugcuucuccuucaaagggcggcgggcgcgaccgggacgcggcgcgguuaaggguccuggggagggggcgccgcucggcugguggcgcugggugccgucugccgcccgggucgcgcuuccucgcgcguccccucccuuagcaacagccgucgccgccgcucggaggaucugggggugaaaguaacaagaaaaaaaaguuauaauguaucaacguuccagggggcggggccgccgcccccucccauucacuacuuacuccgccggccgggcgccggccaaucgccgcgcgccgagcgcccagucggccgcgagcccgggccuaugagagccgccgcggcaccgccccacguggcagccgggcccgcccccucgccccgcccccagcgcccaggcgaccaaggggagcgcagcgggggcggggcuggcgccucuccgcgcccgcccccgccccgcccgcgcccgcagccauucauaagcgcccggagcccgcaacaaagggcgggcgcgccccggggggcgcgggacccaggucuggagacgggucugguaccccucgcgaucccaagggagcggccgggagcgggagggggcgcgggccauuguucccggcgccgggaggggcaggaagucguggggccaccccgccgccuucguccgggaaaagccgcgagcggaagcgggagcgcgaaguccgcgccucguggccggggucccggggcgggcgggcgacggugaggcuagggccgcggccccggggagggcguggugcgugggggcggaguuguggccggggcggggcgcccgcaccucggugacguggccggguggcugccgccgggggccccgcgcgcccacccgccggccgcgggcagaacccguuuccccgaggcgcgcccgcucgagccgugacgugacgcggcguccccggcugcgcccgcgcgcgcucggggaugcggugagucagcagcucgggcgcgcccucugccgggcccgccugggagcgccgcccggagucccggggagggggcgccgcgcugccccuggcaggggaggaagacgacugggcugcgcgcgggggaggaaccccgaucgggaacgaaagacuguagucgggagacugggaccguguggcugggcaacggagggcggaacggcaaccaguucaaggucacccgcggugaagggggagugccccggggggcggggcgggggcugagguccggccagggcggcgcuggcugcgcggagccccucccaccccgcaccccggggggcuucccaggaccggaggcuccccgaucccuccugucccaagaacaaagaaaagugcgggcauccugagccaucuagagugggcacccuuccucggcccgcagguccccccccuccacacucaccgggcgcggccgguucugcgcuccaagugcugcgaguaccuucguccggggccgaaugcgcgcuggccgggccggucu

SEQ ID NO: 16317 - RNA, 25904 nt, Homo sapiens
gccaccgcuuccgccgggccauggggccgcgcgugcugcagccgccgcugcugcugcuccugcuggcgcugcugcuggcggcgcugccgugcggugccgaagaggccucgccgcugcgccccgcgcaggucacguugucgccgccgccggccgugacgaacgggagccagccgggcgcgccacacaacagcacgcacacgcguccgccgggggcgucgggcucggcgcugacgcgcuccuucuacgugauccugggcuucugcggccugaccgcgcucuacuuccugauccgggcguuuaggugcgucaggcgcacgugggcgccgucucucagccuuggccaauuagcgcgcgccuagugcgucacgugccgggccgcgggguccuccccucccucccucccucccucccucucucccuguuggagugggcgugggcggugcugugcggggucgucacguggugugggcggugcaggggccacgggacucacccgcucuccagccugcgccugggguuggaggugcccagcgcgccgccucuuaacucgggggugacgcugcccguuucccagguggggccacugaagccggagcaugccgggcaggggucaggcccuggcggggcgagggggccuccuuggcuccuugucgccggaugcccguccucguucucaucuucccgccugccgccaggccuuuccguggggucccgauauuuuccuuucugcuucuacccacugaagcugguucgucgccagggucggccacgugcccgccuugggugcucccacagcccgggaggugcagcugcguccccagacccucgcgggggucuccagcuguaggcagccccugggcaggaggggcuucugcguguucaggccaccccggcuucccuggccuguggcuccagucuccucugggcuccugacuacccaguguggcugcuucucccgggugggagagacacagcgaggaccuuaucccuccccaucaccacccuggcaaagucaagccgcuuuuuauuuuuuauaaguuuuuauuguagcgauggggucucgccauguuacccgcgcuggucugaacuccugggcucaagugauccuuuuucguuggccucccaaagugcuggcauuauagaugugagcaccugcacuccgccaugcugcuuuuuaugggcccugugcagagccuccccugugcuccacaccucuuccuguggaagcaccugcugcgcgcucuccccugccuguaugccgcgcccucccugccucccgggcugcuggggccaccaggggcuuggcccugagacaggcuuccauucuguugucuuuggcaaagucucaccccugugugagccucagucuuuucaucagugcaaugggagugacaucagcgugccucuccugggguccuggcgcaggggagaugggagggccugguagggcacaugucuucuuacugucaucgccaugggagugaaugguaaucacuuggcgauuaggacaugaaagaagcaggcacagcaaaaccagggaggucugcagcagggcucggggcuccaguagaggacggcaaugagaguccugagggaaggaggaggcaggguuggcggggaggggccacugacuaugccuggaccuacuuccagguugaagaagccucagcggaggcgauacggccuccucgccaacacugaggaccccacggagauggccucgcuggacagcgacgaggagacgguguuugagucccggaaucugagauggugugcacccuuccccagcucuggggccucggugggcaggcugggcuggagacucagcaggacccuggggacuuggccaagccauggaguggucccugcaaucacagcugacagcgguagucaggccauggccccacugggcagggcucaucccuucucccagccuccauuuacaacuuuuuuuuuuuaaacuuaaauguuugucauuuauuuauuuuugagguggaguggcgcgaucccaacucacugcaaccuccgccuccgggauugaggcgauuuuccugccacagccucccgaguagcugggauuacaggcacccgccaccacgccucgcuaauuuuuuguauuuaguagauagagaugggguuucaccauguuggccaggcuggguuccagcuccuuaccucaggugauccaucugccugggcuucccaaagagcugggauuacaggugugagccaccgcaccugaccuaaguuuuguuuuguuuugagauggaguuucgcucuuguugcccaggcuggagugcaauggcacgaucucugcucacugcaaccuccaccucccagguucaagcauuucucccaucgcagccuccugaguagcugggauuaaaggugcucaccacuacacccggcuaauuuuuguaguuuuaguagagacaggguuucaccauguuggccaggcuggccucgaacuccugaccucaggugaucugcccgcuucggccucccaaagugcugggauuacaggugugagccaccguggucagccuucuugcuuuuuuaaggcaggaaagcggcugcagggcuuaggguagugguugcuccaucugggccccucccugagggaugaggucuaagucagguggagaacugacugcaggaugcuucugagcgggcggggucagggagggccucucccugguguaauggggcuggcuucuggaagagugucucaggccgagggaacagcagggagcggccgggcugcgcagaugccgggcgggacugggguaggccugggcaucgaggcagcugucagggguuagcaggguucugggcagggaaugauggguauguugcgcugcaguguggcugcuggggggaccuuggccuguugggggguggcaggcauggaggcugggagaccaggagacugggcggccucuggggacagcucugacuuuuugagcccccagggagggaggcacugggaucccuccgcaugcucugacuccauucugggaaccccucccagguuucuucuaccuccuggcugggggccccuucccccggagugggcaguugcacagggcccaggaggccggggagggaggccaguggggggaggcugggcccugguagaccgaggggccuggacaggcugccugccccugccugaccugggugagccucugcccggcagggcgggcccuucacuccuucccucucacccuugacccccugcuuucagaugcugagccagggaggcggcccuuccagcagccaugagggaaggacaggagauggggcccaccccagugcccagcaacccccugcuccaccgcucauuccccugcuggccccggggcuggucucacccagugccaacccgagagcuccuuuuggaaccugcacagcccgccgaccuguugccaccugcacccaccgcuggaccaugcagccucgccuccuggaugcugucccagccuggccgagggucccaggugaagacuggagggaccccaacagccaccgcccaggacgcugaggcucccuugccugacugugacuugugccucucuccugcccccguggggacauggcagcccagagccaaggcugggugggcaggugacccaaggaaccuuucugggaacaccuucucgccgggcugggaacaauaaaugcagccaugucucugcagcuggugcugaccccaugccaccucuagacccgugcguacuggugcagccaguguggggguggguggcggagcagggcucaagccagccucgguuccccaucugcgaccaugcuuggguucuccagccuugcucccaaguaaggaacccaucuucagcugccugggaugaggcccugccugucagcaucucucuuccuagagagaacuccuauucauccgucaaagccccugccccagggcccccucuaugccaucccuucagccugggucucaugggcccugcccuggaggauccccacaucacccucaugaauaccucuggcaaugauuccagggagccccagagcucugcugcaggaggcuggaguuccgugcggccuggguccccaugccggacacuccucccccaucugccuccugugggacuuggagccugagaccccaucccaggcaaggugcuuaaucagcuucccuggggccuuguucuuccugcaggggccugugucugggcggaguccagcccuggccugucauccugucccccaugagguuagccuuggagagaccauggugcguggguacccauggccugaggucccccacaggcaaccugucuggagcugccacugcccugucacgaggaggagcugccaccagguggcagccuugagccgcccaguccucuggcugucuccuugguccuaacccuucaugugggaaagcaaguccagcacagcccauuugucacuccacuuccugaacccaccguguccucacauccacugggggaugggcagucccccagguuugcaucucacauaccugccgacccucccugucugccgccaggguugggaggggcugucuccacugggggccaggcuaucgccccuucagaccaggguccccuguccugguacuaucuguucccuugggcauguccgucugaccaggccugccaagacucugcuuacguuucuccuuccccuuccagugcccuggguccuucucugccccagccucagcugccgccuccaggaaguccucccugauugcccaccccagccuguucuuuaggggaauccugcagggaagguuggggaagcaacccuuaaagugagggcagagcccgagggaggccccugagacugcagguggggagggcagcuuggcucagccuggcugugugugggacuggggacaagcaagucacaccuaugacucgggcucugcuguuccccaucugucuggccguugcgucugucuccaaacucccguuugcaucucuccaucugccuccuucacuuugucucuguccgucucugucuccaugucugacccuuugggacacacuuuuaacaggcacggagacaccagccccggcccccaacccugugaucugugccccccgucccacagcucugagcgcuuucaccagcuucaaaaggcacauuaauuacucuaaugaggucaggagagacccacgcucugccauccggagucggaacaugccgcagcccccagcccagccgccgccgccccccgcucgagcagggagaggggcucugcugccuccguccccucugccugucggggcccgugcugcaccccacguugcugcagaguaauuggcagccccccaagguuaaugcacuguuagccagggguucuccugggcucagagccggagaggggccugucagcgagaaaugaaaggccccaggucccggcuggugcucggcuugugagcgugugugugcccgugggagugcgugugugugcgggugccugggagcuugcgggggcgggcaguggcuuccuccaccucucccacgcagacacgcagacacgcaggcacccacaaaauacagucucauagacacacgguaagcaacucggacaguuccauggaugggacgcccgcagccccgugggacacgcgaucacacacaugggugugaccugcucagcuccuaaccccacgccggggagugucucagacccaugccccccacccuugccccucggugugcccacuggacaagcagcauaucaggucugugccucugggugggggggggugggggucucugcuucagcagcgggccccgcccaggcuggaguccaguggacucacugcggggcuucuccgcuugugaaauaggggcgggugggcgcuggggacguggccucaaaggcgggaugcguuggguuccuugcggcgccggcuugugcccacagcuuggggccgacauucauccuggggagauagagacagggcuccucugccgcccuggugccggggugccccagggauguggccccaugugccaaaucacagucacucggguuggcaggcgacggagggcucucugccucuucugggggugcugagaccccuguacccucgacuccccaccuccagggaucucacccccaggugcccaucuccucuguggggggccugagccaccacugaccccacauuaaggccacugacguccccguccuaggccagccagccccugagaagcacccagugcuuugcugugggacacaaagccacacauggcuauucacguuauuucauuaaguuacauaaaacuggagguccagggccucagucaccauggggagagguccucagucgccauggggagagguccggguccucagucgccguggggagaggucuggggccucagucacugugguggacagcgauuggugggggcagggacauuuccuuugucuuggaaaguucuggacgcugguggugucuggacacuggagaacgggucuguguucaggccccagaccugaaggugggaugagggagagaggaaggaggaggaaggggaggagggaggggacagagugggaaggagaaggaugugaauggagaggaaggaugggaggaggaaggaaggaaggagggaaggggaggaggaggaaggagaggagggugcagaggaugggggaaggaggggggaggagggugugaaggggaaggagggaggagggagcggaggacugagaaggggaggaagguguaaaaggagagggagagaggaaggaagggaggggguauuaagggggaagagagugggaagggggaggagggaggggaggguaguaugaagggggaaggaaggagggaggggagaagggugggaaggggaggaaggagagagggagggaggggaaggugugaagggaaggagggaggggaggugggagggaaguagggagggggagggaggggaaaggugugaagggaaggagggaggggaggagggagggaggagggugugaagggaggagggggaggagggugggaggggaggagggagggaggagggugugaaggugugaagggaggagggagggaggggaggagggagggaggagggugugaagggaggagggagggaggagggugugaagggaggagggagggaggggaggagggagggaggagagugugaagagaggagaaugggaaggaugggagcuggggaggagggaggagggugagcugggaauggggcugugugccugcucuuuuccaccacuggcugcagggguugcaggaaucuuggguccauggcuggauggggguggggauuuucauguuacccacuggagaaagggauacauuuuuauuuucaaggacagcgacccagcccaggggaaacgccccuggccccuggggcuaagcgcagaccccagcuccgugcuucgcagguggggggcgauggacagcgguggggcucccgcccugaguggagccugugaccugcccgggccccagcgccccgugaccccugccgccugauccuugccuggcugagauggggcuucugaaggcugccggcaccagggcaggcagcgcauuggguccaauuuauucuguaaugagaaauucuccccgcauauuuuuagcuuccuccuggcgucgcggccuuugaaggcugaggggcugcgggacgcugaucccaagcccuguggccuggccaugugggcagugggugcugggcacgggcuggacaagucccuuccugagucuggguagaccccagucccagcagugcagagcagggggcggggccagaccccaucaagcccuguacuggcuccagaccagggacugagggcgacccuggauaaccccugaccuuggcggacaccuguucccagagugagccugauuucugacccuuggcuccacaggaagcuuacucuagagugaccuccggccgcggcugcgucccaaagccgggacagcucccagccccaggagggaacagggcuucuuggacccccacaguggccccccugccaggcagggguuugccggggcagccucgcccagggccaggccucggagacgcccugcccuccccucccuuccccagguccuuccucuaggagcggccagcgggcgcggggagguugaaugggggacgcaccgccuuuguucccgucccugcuugggcucugaccuugagagagacaagaacagaaggaaaacggagcuucugcucaaauccguucagcgguggcggugguggcggcucucgccucgguggccccugcaugcaaaugaguggcccugccaugccuggguggagguggugcccuuccagcucccaccugugcaggucccaguccugguuugagaagagacccccuccucccgacccuggcccaccccuccucacccacgagaucccuugaagcaggagggggcuucuggucccaggguagaaggaagcuuccagaacucccaccuuugccagguggcaugcuggggccgggcacgccaagaccccaggcucacggccccuuguccugugcuugggugcagccgccacacucugcuccgaaagugcucaccuccgggaguggccgucccccucccuaaaagagccccccaccagacggagccgcccgggaagcuucuccagccugucugggcuacagagccuuguguggcuagaacccaaggcccucacuccaggggugcugagagagccuguccagagggccugccucagccaccaccugggacagguucacgcccuccacugaagagacacccggccagcccugggccuucgaccugggacgucuguaguggggucaggggaugagaccuggagcucagaacagacgggcugagcucccuggaggagagagaacugagaaccuuguccuggcagggacgcuagagcacugggugggacagaccuuucuggaagagcaagauuuuaacaggaagaaaaaguggaaggacuucccagcaggacccagccugaacaaaggucaggugguguggcccgcguggcccgcuggggaaucgggggaggagggcacgcaggagacacaggacagagcccaccacgucucagagcugugggacggugguggguccgguccccaccccaccuugcuggggcacagguuagcuugcccaucucuggguucacggucccugccaggaguuuggguaaugccucacacagggaccuucggguccaagggcuguuggugcuugcccugcaguucccucuccugcacugggccuggugaaugacacuaauucagagacguacaacacgaucugggcaucgccagcaaaguccagccagcguuugaugacagccuacccuccacaagcucagagucuggugagggaggcuguggcaugaauaagggcaaaaacagagggcaggccaggugcaguggcucacgccuguaauccuagcacuuugggaagcccaggugggaagaucgccugagcccaggaguucaagaccagcguggccaacauggccagacacugucucuauagauuggaaaaaagacaaagcagaggccaggcccccaguuccccaccugugucagccuaccaggaggagaaaucacucggcguucccugaacagaucagaccccgggucuuugcacaagcugugcccccgggcagcggcccuccccugccugcaggauucgugcguggagacugauuugcugucggccggggcuucacucugggcuucuuggaucccauccccagcugcucacacuccacaucgguccaccuacuaugcucccggcacccuuagggcugagguguagggacuuacuccauccccagggaacagcguggguccggagaggcgacucccaggagggccccagggaggucgcagcccgagcagcuuuggacuuuggccagcgccccucugaaacucugccccggcccccgcagggagacuggaguuggccgagcccgauuugggacgcgugcgucgggguuggugaggcugcggauagcgcuggaaccgggcaggugagaggcccgggacccagggccgggccggguggagcgcgugggggcgcgggaggcagggugcgcccccgccccucggagaccccaggccgggccacgcggaugccggcggggggcgcgcagaaucggggucgcugggggcaggccccgggggacgagccugagacggggugggccggggcagggggcgggcgcaggcuggagacccccgcccaguccccgcgcggccggggcacggcgggagggggcgcccgcggcccucccgacgcucgggcgggacaaaggccggagcccgggccccuccccggcgggugcggcggcggcggcccgcgcuccgacaguccgcgcggccggguccugcgcccggggcgaccccggcgccccgccccgccgccgccugacuucucggcgcccgaggucgcgcgcgcggaggcgggggcggcccgggaucuccaagcgccgccgcgcccuccucccgcccgcccuccgcccgcccgcucggcggcggcggcggcggcggaggaggcggagaaggcuggcaggcggcggccgggagagcgagcgcggcggccggaccggggccauggcgcccgcgcagcgcccgcugcucccgcugcugcuccugcuguuaccgcugccgccgccgcccuucgcgcgcgccgaggacgccgcccgcgccaacucggaccgcuacgccgucuacuggaaccgcagcaaccccaggugagcgcggccgcgcgcggggggcgcccggggaccccccaacgccccccaagccgcgcccggccucgcgcccccggagcuccgggcgccccccacgcgcgcgccgccgccgggaugcgggcgcccgguucccgcgggagccccccagggagcuccggccccccggaguuugggggacucgcccuuuucgcgccugccuuccccggggcgccccauugcccuacggacuguggggacucgcgccccacaucccccagagcgccgacgucuccuggaguuuggggaaccccucugguacccuccgaugccggguagccccugaguugccugccuggacuuggggggaccccugauccacccgcuucucuggggagcccccucgguuucgcauuugguggggauccccggggaccuuggcaccggaggugggggacuguggcccucgagggaucucuggguucguccugcccgcagguccccagaugaacuuggggaaguuggagugucccucccucaggacccagcaucugcuucacuccagggggccaagggcccagcuuugaaaggagacugaggggccggggagcugggggucagccccgggaggggcagugggauggaguccucucuuguccucugggcgcugaccaggaaacugaggugcagaggggaugaggagcuggcucaaggucaugcaagggggggacuugggggcaggacccagguggcccagugcccugccugccacgcccggccgagaugccgcacccgccugcugcaggcccccuuguuuugaaccagguccgggccaggcacaacgugggggacaggagaagcccccguuggucagagcaaaaaaaguuugccggggccuggccauggccuggacguggguagaacccucugaaccaucccagggucuccaagacaggagcaggcugcagcuucccugggggucccgugggagccggggcuuuggggguccuggggcucgggagggagucagccccagcacucagggugucaccgucuuccuaaggcacacggagcugcacaucgggggcugaggcggcccccccccacucuucugcuacuggucacuuucucuccguuuuccagccgcuuccugugccgaccgagccgcccucuggagcccgccaccccuccuuguccccucugucuccugcuguccucgguccccgggaggaaaguugcaugaaggggucucuuugaggcgggcucggggacaagggcggcccguguuccgccguggggguggggaacacgcacaggcccaccccccacccuggucaacggccucgggucgggcccugggggcugagggcagggaccccgggccgcugggggacggcuggcccaccucagagcggguccccgagccgcccgcugugcuggucacauguggguuugauuaaggcugucgcuggccgugcggggaguccagcgggcagcgcuuccccggcccaaguuuuugguuucagcugcggaaucucccguccccagcguggccuguccuuuguucuagcaaacgccaaacacacgaggacccggcaaccgggggaggaagguggucaccagggccguccugcugccccaccugccacagggcugugggcugcgggccggacccccggccaggggaaggaaguggccuccccagugccuggcuuggcccagccaccuccuguugcuccgggucugaccugguugcccagcucaaaccgcugccugagggaacggccuugcugguccgcagagccgaccugggcagcaccgaggcugccuccuccuuccucuccugccugcgguauccaggguugcuggggacggagccgacacccugcaguggggcccagggcugggugagcaccuucccgggaagccgggauccagccagaaucagggcuuugucgcggacaucaggggucucugcaguucucagauuugguguccaggggcaccugcccgggaccugugccugaguggcgggggugucaggcacagcaggggguggugcugggccuccguauccaaggggacccuguggaggggacaucggcuuggggagaggaguggcgucagccggcaggccuaaggugugaggcugggcuggccggggagggaugauggggucgggcaggugugugggggaugcggggaccccaagucuuugagaggggcauacagaaaggcacuggagacggggacagccgcgauggggggcagacagcagcgugggcaccaggggaccgugugcucgauggggccugcaggcccgggcagugccgcagcgucgccggccgccccuuccgcccauuggccuggcaccugugcccaggcgaugacuguguggucugucuccacaucacacccucucugcugugagaggcgaugccugcacccaggggaccccgcacccaccuccuugggccgcuauaagguggggccccguuggguggucuggcuggccggccccgccacucccaccggugacugcacagcguccguccaacccacuccccaaccugggcuggguaccccugagcuggccgccaggagucucugggccuguucccagccgacccgcaucgggcuggggcguccagggcuuggaccuggccggcugcccucaccuguccuguuggaccuggccggcugcccucaccuguccuggccacaacaccgcgugugcauucccacggcugcucauguguguuugcgugcagcgguggggaaggguggcgugcaggugugccuggagucgcauccggcugcagguuacaugugucuguguguggcaggaggcugcgugaauccacagggcacagcucuggcguguuugcacaugugucugcgugauugcauaugaggugcaugugugugcaugagugugucugugcguggcacccgcguuugcaugugcgugcccuugcacgggaugucugcaguguccgaggucccugugcgugucugccuguggcaugcaugcguuuugucugugcguggagugcaggugugugugcgugucugcguguggggugcauguaagugugucucccugggggcagugcuggcuggcugagggccugcaaugugggggcagugguggccccagcacgguccacaauggcaaccccgcuguuggcccucccucuccuccuccccuggggacgggaccagggcccgugugcagacggccaucaagccucagagcaggguggacgcaggggccugugguccccgggaguccccaccuucugauuggaaaucugcagccuugggggcacugggugggcgcuugcccacacugggcaucucugggcuucggccacccucccgggguuccccacggacccaguggcccucgggugugggcagcagccggguuccccucaaacacuggauggaaaauggugaccuaugcaagggcucacuccccgagggaggagccgucccccagcagagggcagaggugaacggggugucucgcuccccguggcuccgcuggcgucccucggccucucggggagccggcuuugaagggggugaugccguguucugcugcauaaggguuuuuuguuuuguuugagagaagcugguccacucggcauugggggcgcuaggagagccgggcggugggccugggggauucggggccugagggugggguccuggaggccgugggguaccuggacucagacucgggagucugggagaccugggcaugacgucaggcagguggcuuagcagccuggaacccccaggccugcucugcgaagugggggugacggagcccugcggugggugcggcucggccgauagggccugguguggaugggcaaaggccugaggguggucccagggguuaguguccccuccccagaagggaaaccgaggcagcuccugugguggggaggaugcuucugccgaggcaccauggucucugugucucacggucucuuugggucucugucuuccccaucucugggcauccuggggugccauggguggcccaggccuuccgccuccacugcaggccucccugggcggccucaguuugcagagaagggaacagagguuccguggcggggggccgugaacgcagugggauuugaccuucccccgucucugggcugacgucuccgcaggucugcaggggacuggcccuacgugggucccucggggucacggcggaggcaguggguugugcauucauggggguccgggugguagcguuucuguggagccgguggucuccuugucauccaugaggguccugccccgguggccguguguuccccgggacacggcuucucuccuccccaggaaccgggaugcagccaggccuugccccucaguccugugugugggaccagccucuccugcagauggguccucagggagagcugggcuuuguaccuugcugggggaagggcugagcugcucccgucccugugcccaccgucccgucgccccagacacgcggcuggagccugcggaggagcagacgagccggcgggguuuuugcuuuaaccucaagcaggcguuugaacucuguggccgagucgguccugguggggggcucgugccacaccugcucccagaccaggcugguguggggucuggccgagagacucagcggcguguccccccagcucugugcgccccuuguccaccugcccugugggucaggggcccccaauucagggacagagcagccgaggcccugaaagacggugacucacccaaggccacccggaaguugggcagaguccagggugucccaccuggggccggcccgggggaagccagggacagcccugggaggggcaggaagguggguggccgacggcagcugcacucuguaccagggccacccacgcccacggugacggaagcccagguggggcugacccugcccggcccaucuuuuuccuauuuugcuucauuucuagggcccugccucaguuuacccuccugcaccacaaggccauacuuguccuuucuugggcagaccuugcaccaucccggggacugauuucccuucaggucccacccagguccugagcaggaggaaaagcuccaguccucagucaggggggacaucucuuccgucccuggaaaagccaggugugggugcugucaccccagcaggucuugcuggggguggcaggaggggacgggcggccucagccccacgcugggcuucaggacccgggcugccugcucauccggccagccugggccuccccgggagcuucuccacccuggaagagagaugcagacgggugcaggcguccaccugcccacccacgggguccuggcugccggccacaccacugccucaguuuccaguccuggaaggcagcccagcccacccccaccccaguuuugggugagauuccuaauuagucgcuuagcuauuagcgucuaauaacuugacaauugcccgauuggagcuaauuagcuccaggccgcuugcuggaagcuggugacagccaggaggcccgggugggcaggaggggagcccugcugggugagccucugccuggggccuggagggcugccuggaggcguggacuuuggcacccgcagguugagugaguguggggggaagguguggcccggcagagggaacccggaggaguaaaaacugccaccgcugcucugucugggaaaaaucccaaaucagucauuaaccccuuagugagaauuucagucucucugccgcuccggggaggauuugcauaucgaggcuucaucacuaauggaggaagcgaaggcuuugucugccucuccccaggugcgguuuuggggugggggcccccuccccccugcaggcgccacccucaacaggggcaacgcgcccaccucgggcuugcccgccaacuuggaaccgggaaugccaacacagcaaggccgcugcuauuuuagagacgcaaagggaaaaauacggccccacuccggcaggcagagccggggguggggguuccccugggaccugcccuccaacacacacaccugugggcugcuccccacaacucuggcauugcaaaguccucgccucuugaccuuuuuaauucacucauuauugagcaccacuguaugcagggccuguguagggcccuggggaggggacagaggaggccaacaucaggauccgggauucagacagcaaacccuguaaagagcagaugugauauggggcggggcacagggaacagcacugcaggcagugggaacagcagcugcagaggcccuuggugggaacagggacagccgggaggcugguguggcuggaagggaggagucuuggagagaggaggaugaggagggcgcaguggaugggccacacaggccuggagggguguggauuuuauucugaggaucaggaauggauggagggcucugagccgccgccaacguguuacagggucuguuuugcagaagagcgaggcuugggauauggggaggcugggccccggcagacccucaccgcagccuggaggggcccgggcaccuggccgcucagccacacagaagccucggucucugacauuuuaccgaaggcagaacaggaggagagaacacaguggugucagacgugggggaaggaggcaccauuggggaaccaagaggccagagggggaccuacagggcuggugcugugggcacuuucagaggcugcucugucucaagaaguguccugcuaggagccagguucuuuuuuuggguugaauguggcucccuggggaucacugccgggacaggaggggaaacugaggccagagggcaguggggagcccagacgccccuguggucccuccacggaggccuccccugcagggugaccugggugugggcagucccaggcgggagcugggccuuggcuaccaucgaccgccugaucaaugggcuuucacuugggcugggcaggaacgaaaaugacuuuucaaaaaggcuggagcagcuucugcaucgaucgugcccaaggggccagcgggucaaugagaugccugugcccggccggccaauggggcagccugaggggugggcugaggccgagcccaucuccaucugagccuguaugggggcugcccccgugucugugcggacgcaccccgaguguccaacagccgggaggaccauccccuugcacggaggggaaagggagccucugagaggaggccggaccucgagacccaaggguucaaauccagacgcaagcccagaacugcaagauuccgaagccccggaagggccccugcccuccaggccuggugcccgggggagauuucccugcaacacgcccucccauguccccugugcugggcucacaggggugaugaaggaggccugggaagcucucugucccuggacgaauccaaccagguagggaagggcuggagggugacuucaccgccuccgccgcccugccuugaaauucuuugcucuggagaucuucaugccggaucccuaguggggaaacugaggcgcaagugagcacaccugucugccccuucucaccccuggagacccaggaacccccggccccgccuggcguggcaucucaggguggcggggggccgggcugaugccaucugauaaucccaccacccucucucucgagcugcugugccaauuagugcccccaguguggggccugcggcgggcucaccccugcaggccgggguggcgguggcugugccgggcuagaggcagugccagggccgggaucguagcagccugcacccaugugcugccaacacugguggggccucaguuuccccugccugugcauggagggaggaggcaggagcggugugggggaccccccauuccucccuguucaggucuuuuaugugcuaauaagccccucucagggccccccucgugccccgcuugguccaggccgccgguuacaugacaggggcccuggggaccacagccgggagaucuaagggcuccugccgccaucgcccgaggcagugagggaaggggagccgccggucccuuccucggcugaucucuauccucacagacgaggcugggucagggggcucccuggaggaaggggccuguggguugcgucugggggaccucagggcaaaggccuggaggcagggcugggggcugaggugucaggagugcaggcacccaagagggagaccaggaggccgccggauuccggggcucggggcucgggagguuucuggguuccagaugugagagggugguauggggcucgcagggucacacaggaaggcagggguggggcugggaguggagcccaggaugucuccgagcugggcggcagguggaacucggcaggcugagagagagggggcggugggcggaacucugggggugcugagaggaggguggagggauucuucacgccaagcuccguucucuuuggggaaacugaggccagggugggggcagagcuugccccagagcgagcuggaaugcccgaccugugucccccacgcugccccgguccuucucaacaggugggagugcagaaugaaagcagggcugggggcugccuggaggaggcggcacagauguuaagcauguuagguagaugcgaaguuucuggagagggaauucuuguggagggacagcucgugcagaggcccggagucaggaaccccccgccggcccuuugcacacagggguccagaugucacccaccuggacacccaccucgcugcuggcccugccguggggcuguuggggacacugaggcaggagguggggggcagugccaggcaagagaucgugggcucccaaccuuggaagcccgccgugauuggggugugcaaccccaccugcugaccgcuaucaccauucagggcccaggcggaguccaccuugugaacugaccccucccccauuccccggccugacuuccccgugcaccuguccccugacccgucccuccccgcucacccugucccgugcccugugcaccuguccccggagccaucucuccccgcgcacacugacccgugccccaugcaccuguccccugacccuguccccccuggcgcacccugacccgucccccgugcuccugaccccggcccucgccgcgcaccccgacccgucccucgugcuccuguccccugacccuggcccuccccgcgcaccccgacccgugccccguuccucgcuccgggcgcugaccucuggccgccuuguccccgcagguuccacgcaggcgcgggggacgacggcgggggcuacacgguggaggugagcaucaaugacuaccuggacaucuacugcccgcacuauggggcgccgcugccgccggccgagcgcauggagcacuacgugcuguacauggucaacggcgagggccacgccuccugcgaccaccgccagcgcggcuucaagcgcugggagugcaaccggcccgcggcgcccggggggccgcucaaguucucggagaaguuccagcucuucacgcccuucucccugggcuucgaguuccggcccggccacgaguauuacuacaucugugaguggggucgggccggggcugccggggcccgagugggcggggacgcgggggcggggccaggaagugggcgggaccacugggguggggccggggagugggcggggcagcgcagugggcggggccgcgguguggggccaggggggagugggcggggccgcggaauggggccaggggggagugggcggggccgcggaguggggccagggccggugcuggccacugacccaccccggucacugacccccuccagaugucaagugcaugauggacgugccauucucccaaccaucccgggaggccaggacuuuccucguccuucguugcauauggggaaacugaggcuuggagggggacugaggcugcacuauugugaucucgggccuccagcucagaccacuuggugguugggccaguagaccuggcucagccccccgauagcgagaccagggugcccgagccccagcacacugaugagggaaacugaggcauccggagcccagcaggggaggggagcuugguggaagccacagcuaggcugagugcuggggcuuacuccugcaaucccagcacuuugggaugccgaggcgggaggaucacuugaggccagcguggacaacguagggagaccuucucucuacaaaaacauaaaaacaauuagccaggugugguggcaugggccuguggucccagcugugcagggggcugaggugggagggcugcuuggagugcaugagcucuggucgcuccacugcacuccagccuggguggcagagcgagacccugucuuuaaaagaagaaaaaaaccccacagggccccugccgcaccagccgcacccagacuggguaggggucuccagguccucccugccccgcacccacccccgcaucuccccgggacccaugccaggcucggagacucccugaggaccguggggucuucaucugaagguuggguggcggcagccuuggggauagucacaucugcaggaccccauggugggccaggcugggugggccaggcugagggaggcugccagucccugcugcuuaucggagguccgaagcuggccuuuuugucccuacgaaaggccaacggcagguggggaacacagcagcgccagccggagucccaguccugcuuggccaugauaucugugaccuuggcgggggaaugaggggccaggcacugcccaccugagauggggaugauggcaucacacucguggcuuccgccguggcgcugagacugagggauucucguggaguggggaccccggcuucucagcaucucggggccugagggauggggagucagggaucuggggucugugcccccaggcugcaggggggccagugccuggacacccagcuccugcugugugaaauuaaacuuuacaaggccccauugccuccuuucucugcucuaguuggauuuuucccuuuuaauucagggaagaagcgggugggggacgggggaagguguuuaaauuaaguccccauaauaugagaaaaauuacauuuuucuuucugagacggcaguuucauaaagauaauuauuguaauuauucguccuaccucugugaugaauguuauuuuuauuacaugcuuuuuaucuucaucuuccagugugagggguuucuagggggcgggcagaggugguggccaugagagccaggccaucaggggcccagggcccggcagagacagcaagaccacauccaugugugcgugcacauggacccaccccuguucgauuguccacacgugugcacaccccagcggccccggcuucaggcguccuuuuccuccucucuugauccuugcagacgcccccacugcacuccaggaugcuucugggggcccgaaagcaggggcggugaugcuggaauuuugggcguaagaaccaguuggaaauaaucuuucccagccaggcguggcgguggcucacgccuguaaucccagcacuuugggaggccgaggcggguggaucaccugaggucaggaguucaagaccagcccggccaacauggugaaaccccguuucuacuaaaaauacaaaaauuagccaggcaugguggcacacauuuguaauccuguuuacuugggaggcugaggcaggagaauugcuugaacccgggaggcugagauugcagugagccgagaucguaccauugcacuccagccugggcgacaagagcaaagcuccaucacaaaaaaaaaaaaaaaaaaaaaaaaaaagaaucuuucccagagaaucuacuguguugccaggcgagguccagagagggagcggcuuguccacaggcucucagaggcagagauuugaacccaggucaaucauuucacuauuaauauaucaccucuuugcugauugcuugaaaacaaauacaucauuuuccgagcucacccugugcugcccuggggugaggcagagcagaacaaaaacacagacacccccagguucuggggucaggauuggacagaaggaggagcagggggaaugugcaggagacugcugggaaacagggggcauugugucuggggcuuugauguacgauuaggaguuuuaaggguggcucuccaccuggggucaggguugauucaccaagguggggaagggaguacagccccaggaggucucaggcaccaagaggcacuuccccacucauccccauccccucucuucuagcugccacgccucccaaugcuguggaccggcccugccugcgacugaagguguacgugcggccgaccaguaagugcucagggggaugggcaggauccaggcccccaccccuguguccuaaacccacagaaccagugaguguucagaagagccaggacagggggccucggguuucccuaucuugcccugccuugccccagccucgauuuccccgucugaugaacaugucagaccuucgagagugaagguuagcugagcgcaguggcucacgccuauaaucccagcacauugggaugcugaggugggagaaucaauugagcccaggaggccgaggcugcagugagcagagaucacgccacugcauuccagccugggugacagagcaagacucugucucuaaaaaacaaagcaggccgguuggguggcucacgccuguaaucccaacuuugggagccugaggcagguggaucaccugaggucaggaguuugagaccagccugguuaacauggcgaaaccccaucucuacuaaaaauacaaaauuuagccgggccugguggcgggcuccuguaaucccagcuacucaggagacugaggcaggagaaucacuugaacccgggaaguggagguugcagugagcccagauugcgccacugcucuccagucugggugauauagcaagacugcgucuaaaaaauaaaauaaaauaaaaauaaaaauaaaaacagaguggccgggcacgguggcucacaccuguaaucccagcacuuugggaggcugagguggguggaccccaaggucaagagauggagaccguccuggccaacauggugaaaccccgucucugcugaaaauacaaaauuagccgggcgugguggcacaugccuguagucccagcuauuugggaggcugaagcuggagaaucgccugaacccgggaggcggagguugcagugagcccagauugcgccacugcacgccagccuggcgacggugagacuccgucucaaaaaauaaauaaauaaauaaaaauaaagcaaaaaaaaaaaaaaaaagauuaaaagagugaagguugaauucaacagccaggucccccacuucaggccaagugacuuugcccggagagugggcaucggggauggcaccaagagggagcagagggccugccugguggggugaugagcccguugggcagaugugcacccugagggcgggcggcacguggggagcccagugggguucgggcggccgcugagcgugcugucucugccacccgcagacgagacccuguacgaggcuccugagcccaucuucaccagcaauaacucguguagcagcccgggcggcugccgccucuuccucagcaccauccccgugcucuggacccuccuggguuccuagucccagccccgcaggacgccgacccugccuggacggccccgccuggaccgccugaccucggcccuccggacccggcugcggcccccgccuccgagaccaaauagagacgcugcuucucccucgccuggugccgcccccgccgggcaggggccauccacccgccccaggaccagcccucagggaggggaaacggccgagagcccccccccggaggcccgaggggccgggguguggaugcggaccguggccaggccaucuccucuggggcgucggagaacccgggaaccucuuggcgauuuuuuuuuuuuuuuuuuuuuuuuuuuuuuuuuuuaguguauuuuucgugguuggaucaaaaagacuugaguuuuuaauuuaauuuauucccugccguuguagcggggcggggucccugugcccuggccugggggaggggaacgcggaacauggggucgggaacacagccgcuccccucugcucugcaccccacucgugggggaacacagccgcuccccucugcucugcaccccacucgugggggaacacagccgcuccccucugcucugcaccccacucgugggggaacacagccgcuccccucugcucugcaccccacucgugggggaacacagcugcagcccaccgcggaccccccuggugcuccagguugggugagucugagccggaagggguacguggugggcgccccucauuguggcuggggagaccucauaccccaucgcccacccccguccuccuggucauuuccucccagacacuguuuugccccagcgcccuucggaaucacagucccgccgugucuuagaaacugcuuuggccgaugcaaacagcccccuacccgucccccucgccucacacggucccucuccgaggccgagaagaccuucuguuccuguaaauacagccagcaagugcaaacugugauuuuauuuuccacguauuccugaggacggacuggaccgucuauguuuuuucagcccuucauagggggucuuuuauuuuggugggggggugggguggacuuuuagaguagaagcugcacuuggcaauaagcucgugucgucugucagagccccucucucaacucugugaccugauaauguuucuaagaaaaagaaaaaaaggacaaaagggagggaaccacuaccaaaaaaaaaaaaagaaacuccuccccgaagacacuuuaaugaaggaaacaacacauuuauacggauuucauauuucuacccgccuuuccugacucuguguuuuauauauauuauauauaaauauauauuguguacggccgccggccggcggcucgaggcacgcccggugguggggggugggcagagggcuuuuguagggggucggcggggcgggccgcguugccaggccuggagcuggcgaccgggccucccucuucccgucacaaucaacuuuggauucuguauuuuuuuauaauaaaaugagcauaaaccucaaacg

SEQ ID NO: 16318 - RNA, 9001 nt, Homo sapiens
cuucuaagcaaccuuuauuugcaaacucugagguuggacgcggugcccgaggcggacagugucacguuucucucccuccacuuuccccuggcuuuuggggugcuccagccucuccccccagcccacucccgcccaaacccaaaaugcagaggagacuucucucucucucucucccgccaggcuucgggguuccacggggcccaucccuggcaggccaggcgucgggugcuggugcucgcuccucuggggccagccuggggaggcagcauggcagcagugccugucagggacccaggcgggggcaaggucgcuuucugagcugacaacuucagguuccagcuggcagccagaccugggguuugguggggguggcccuggcacgggagagccaggcguauagugggagguccauggacaugccgcagaggacggggccuccgagggucacggccaggaggcucagcaccauggccgaggcugggcagcggugguggggacaggcggcagcucuaagccgggggcggcugucggggguggugggucccaugcaggagcccugcugcugguccagcguggaggaugggggacaggaggugcagucccucggggagccgccgcggcagguguagcaggaggcauggcagcuggagcagacccucagcgcgggcgccgccgugugcccaggcccagcggucaccagccuugugugguugaagaaccgcggggggcaguaggccaggcagagcugucccaggauguaggcggggccgucacacgcugcucggggacacgcacgcaaaggcccgucagcuugccacccgcagccuguuacucgccacccgcccgccuggggccacaugcacgcugcccacgguggccgccaccgccucccagcagugggcccugccccgccggcacucacccuggcacagccccucugugucccgcugcacacacgcgcugcuggucaccugggggccuguaggccgcgcugucauguccucggccgucccauagagcagcagcguguagcgguacaacgucccuggacaggggucgcgggugggcacaggaggaaaaggaggcucucggcagccugguccugguaguccccgggcucccuccccuucagcucccacgcggggcccuggacugguucacaucucucagggaauugcacaccuacugugcgccugucacuggacaccgacaucucccgggugacugcacaccuacugugcgccugucacugggcaccuacaucucccguguuaccgcacaccuacugugugccugucauugcacaccaucucccgggugacugcacgccuacugugugcauguucucuuggagaaggccacugggaaccccuuuugcagugcggucaccaaggcuagcuccagagccccuggggggagguuggagagccaagccccgcccaccacagccccgccccgcccucacccguguugaaauaguagcccuuguucucuaggcccaggguccacacgcccuguggguucucaucccagaaguggguggacaugaagacccaguuguuguagccuucagugcugacguccaagggucugggacagaagggugggugggggugggggugucaagagggauggcuuugugaagccggcagagccccaugaagugucugaccgcacgcgcugguggccgcguguccucugggugugggugagggugugacucggggucccaccaacuaggcugccgugugacuccuaugggccuggccccuccccgugaggacacuccggguagauggcagcguuuaccgacagggcaugaggccgcccccucuccucugcgggccgcucaccguauggccacgaguguggagcgcgugcccauggggcuggugagcgagaucuccaggucuccgcgccggcuguaggacagcgucagcugcgccugcacgugcuccagcgagcggauggaguuguggaggccggcgcaggccgauacguuuucccugauguagaucagcggcaggauggggcugagggggucgaggggugaggacccuccugcggccugcuggggggugggugggcggccagcaggcgaggucggggcucagaggucacgggguccagcccucguuuuacagauggguaaacugaggccucaggccugucccccacacccccagcggggauagcggaggggcgcgcaggggucucacguggggcggcucuggacccggacggcgcacuuccucugcggcugggugggcagccaggugcgggcgguguccaccagcagcccggcguccagcagcccguauccguagugauggcucacugcgcggaagggcagcagucacucgccccgugggccccggguccccgcccccgcccggccccgccgcaccuuggcgccccacgccguugguccuccaguccucggccugcaggugcgccggcuuggacgcgcggaccaccaggugcugcaugucucuccacgucaggaacgggcugcggggggcgggggcgggggcgggugagccgccgggccgcgccugggggcgagggcgguggaccgggccccgcagucaccuacuuggccuccagcgcuagggcgaucaugccggccgccaguggggcugaggccgaggugcccgugugcuggucugugcacccgugaugcagguccguggugaccugagggcagaggggggugggacucggggggccgugcacagugagaauacagcccuucuucaaaaaguaccaaggacugggcgggcgcaguggcucaggccugucaucccagcacuuugggaggcugaggcgggcguguugucugaggucaggaguucaagaccagccuggucaacauagugaaaccccaacucuacaaaaauacaaaaauuagccaggcaugguggcgggcaccuguaguuccagcuacucgggaggcugacacaggagaaucacuugaacccgacaggcagagguugcagugagcggagaucacacccacgccacugcacuccagccugggcaacagagccagacucuggauuaaaaaaaaaaaaguacuaacgacugaauucaaaaaguaccaagggcugggugcgguggcucacaccuguaaucccagcacuuugggaggccgagguggguggaucaccggaggucaggaguucgagaccagccuggucaacaccuugucucuacuaaaaauacaaaaaaauuacccggguaugguggcggggcaccuguaaucccagcuacuugggaggcugaggcaagacaaucacuugaaccuaggaggcagagguugcagugagccaagaucacaccguugcacuccagccugggcaacauggcaagacuccaucucaaaaaaauaaaaaaauaguaccaagaacugaagucaaaaaguaccaaggacuggccacacaguggcucacgccuguagucccaacacuuugggaggcugaggcgggcagauuguuugagcucaggaguuugagaccagcuuguggcaacauggugaaaccccgucucuacaggaaaaauacaagaauuagcugggugugguagugugcaccuguaaucccagcuacucaggaggcugaggcaggaggaucgcuugagccugggagguagagguugcagugagcuaagauugcaccacugcacuccaaccugggugacagagugagacucugucucaaaaaaauuuaaaaaaaaagguaccaaggacuccaaggacugaguucaagaaguaacaaggacuaugcucaaaaagaacuaagagccuggccaacauggugaaaccccgucucuacugaaaauacaaaaaaauuagccgggcaugguggcguggccugcuauucccggcacuuugggaggccgaggcugguggaucgcuugaccugaggaguuggagaccagccuggccaacauggugaaaugccaucucuacaaaauauacaaaagaaauuagcaggacaugguggcaugcuuguggucucagcugcucaagaggcugaggcacaagaaucgcuugagcccggcaggcguagguugcagugagcugagaucaugccacuucacucuguugcacccagccugggugacagagcgagacuccaucucaaaagaaaaaagaaagugcugggcacuguggcucacaccuguaaucccagcacuuugggaggccgaggugggcggaucacgaggucaggagaucgagaucauccuggcuaacauggugaaacccugucucuacugaaaauacaaaaaauuagccgggcaugguggcgggcaccuguagucccagcuacucaggaggcugaggaaggagaauggugugaacccgggaggcggagcuugcagugagcugagaucgcgccacugcacuccagccuggacgacagagccagacuccaucuucaaaaacaaacaaaugaaaagaaacccugggcugaagugauucucccacuuuggccucccaaagugagcuguugcgcccggcuggauuuguuuuuguuuuguuuuguuuuguuuuguuuugagacagggucucgcucuguggccuaaacuggagugcaguggugcaaucuuggcucacugcaaccuccaucucugggguucaagcgauucuccugccucagccuccugaguagcugggauuacaggcgcccgccaccaugccuggcuaauuuuuuuuuguauuuuuaguagagaugggguuuugccauguuggcuaggcugguccugaacucuugaccucaggugauccacccaccuuggucucccaaagugcugggauuacaggcgcgagccacugugcuuggccuggauuuggguuauugauugauugauugauugauuuuugagacggagucucacucugucgcccaggcuggagugcaguggcccgaucucggcucacugcaaacccugccucccggguucaugccauucuccugccucagccucccgaguagcugggacuacaggcgcccaccaccacgcccggcuaauuuuuuguauuuuuaguagagacgggguuucacucuguuagccaggauggucucgaucucccgaccucgugauccacccgccucggccucccaaagugcugggauuacaggcgucagccaccgugccuggccuuuuuuuuuuguaguuuuaguagagacaggguuucaccauguuagccaggauggucuugaucuccugaccuugugaucugccugccuuagccucccaaagugcugggauuacaggugugagccaccgugcucggccuggauuugcauuuucaaagcagcuuugggagggugcuaagucacagugguggggacaggaggaggccaggcugggauggcagggccuggggaggggacccuguuggggcggcugcacucacgaucugggggucgguggccacgccgcugcuguaggugguggugaggguggaggcgcaggcuucgcuguaccagggcacgcggcccugcuggguggugcugcccacggaaagcguguggaugcuguugguguagccgucgcaguugcaguugucguagugcaggccgccguugcccgaggcccagaugaagagcgugcccagcccgccgcggcccugggaaaccaggaggggcggggagggggcgucggccuggccugccaccccugcccuccucgggcugccacucaccuuggucacaccacgccggaaggccucgcgggugaggaugccggggccguccaccgugcggccgucguccucgggaccccagcuggcgcuguaaauguggaugugcugcggcugcaggcucagcgacugggccucgaugacaucggugaugguaccguccagcauccguacgccugcagagccagggcgggagggccgcugccaccggcccugcccuuccccacaccccagcccgccccgcgccacuccacaccacuccccagcccuaccugggcccucucucugcucccuggagugggaccauucguauuggcucagcaccccccaagcccuggagucuggggcccuagcaccacccagcagugagagggugggcucccgaguccuugggcccagcuccccgccagagucacccccuucccucucugucccggaauggugccgcugggggaccccggguaccuccgauucgggcguugaaagcgacccccacaccacagaagccauuguuggccaucgcggccaccuccccagcacagcgggucccgugccuggugccagggccaagaggggcuccugucacggccuccaucccccugccggguacuggggcuucccccgugugcugugggagcccugcucaccgguucucuuugcuggggguguagcggggcuggggguccgggucguagucauugaagucauagcuggccaggggguccugggggcagguggggauaugagggggccgggaggcgucccuaggguggugccagccucggcaccuggggcagcccucgcccacagccacccgcggucucacguaguuggcccagagguccgggugguccuucucgaugccaucguccagcacagagaccacgaugcccuggccugacagccccugacuccaggccugcaggaugcucaggucugguugggccucgcuguucugcagggggaggcgggguugugacccugugagggccuggaguugagggcgccagcggccccguccccgucuacccacccuggcugccugcucaccauguaccacugcuuggagaaccagggguccgugggcaccacgacagagcguuucacccgccgcugcagcgucugcugcuggaaccacugcaccugcagagcagagggugcaucaggccuguccccugcucgccccuggggccccucgugguucagggagugaggcagccccgugcccugggacccuguguuuguggggguugcucuccaggguccccaugugccuggggcucugucugcagucggaaggggucgaggcuuuuggaccaccuguccuugggcccacagacgcgucguugcugccgcgggugacugcagguccccggguccccaccccacucucucccccaucccuguucuagauccuucuaucucucuccugcaucacuuccuuauuuuuuuucuuuuuuugagacagagucuuguucugucgcccaggcuggggugcaguggcgcaaucuuggcucacugcaaccucugccuccuggguucaagcgauucuccuaccucagccucccaaguagcugggacuacaggcgcacaccaccaugcccggcuaauuuuuguacauuuaguagagaugggguuucgccauguugaucaggcuggucucgaacuccugagcuuaagugaucugccugccuuggccucccgaagugccgggauuacaggcaugaaccaccacgccaggccuggcuucucucuugcaaaccacaucaggaacuggccacugcucucccucccggugcuguaagcaggcagcuguccaguccuguucaaggcacuuccuggccuccgagggcuucccaggcuccaucccaaccccucagcuugacaucccaggcauuuucuagacagggcccagcccgaugggacccaggccccuuucugagcgccuggacacugcguccugagggccacugggugacuguaagccuccuacuuuuuuuuuuuuuuuuuuugagacggagucucgcucugucgcccaggcuggagugcaauggcgcgaucucggcucacugcaagcuccgccucccggguucacaccauucuccugccuaagccuccugaauagcugggacuacaggcgccugccaccaugcccggcuaauuuuuuuguauuuucaguagagacaggguuucaccguguucgcuaggaucucgucucgauuuccugaccuugugauccgaccgccuccgccucccaaagugcugggauuacaggcgugagccaccgcgccgggccaagccuccuacucuuuggaacccauuacggugucguaaaauccccuucccuccaucccaugaccuagacgguggggaagucacgccgucugucccuccuuaccagagccccuggggcccagaggagggagggggaggacaagaggugcccacuguguaccaggcccuggcaggcgccaugauuuccguaucugggucuuccugccuccucuugcuguauagacuuggggcccgggcgggucugagccacagaaagcacacagcuguucauaacaaccacgagaaccacagaagauggcugguggccccaggaggcagcugagaccccgggcaggggguuggccuccaggccaggcucaccuugggguuuuucuucaggugcaggcgguggccccagugcggggucagggacugcuggaccacgccccggugccgcaggugaaaguacugcccgucagggaagaucuggggauguggggaagcggccgcaccgaugggacccggcuccccugcugaagcccccgagggccgguaacagcccccuucuuuguccuuccccagcaggugcucucugggagucccagaagcugagcuuggcugaggcaggggugggcugggacucuugauauuuagaagaccuugugggcucccucccccuugucggggucuaggguuguucaguccccuccaagcccccacuucccgucuaucccggucccacccaccggccccagguugacgaagccgaauuugcgugccaggcgcucgaccucccgguuacccugggacaccuggacggcccagcugcugacauagaugggggcucggaccggggcccaccccacagcccgggggcggacaagggccagggccaagaccaggcgcagccacagcgcaaucggggcgggccgcauggaggcggggcgggagcggggccugcgcaaauccccucccucccgccaaaccgccgagugggcccaggcguccgacccgcccccg

SEQ ID NO: 16319 - RNA, 9001 nt, Homo sapiens
cgggggcgggucggacgccugggcccacucggcgguuuggcgggagggaggggauuugcgcaggccccgcucccgccccgccuccaugcggcccgccccgauugcgcuguggcugcgccuggucuuggcccuggcccuuguccgcccccgggcuguggggugggccccgguccgagcccccaucuaugucagcagcugggccguccaggugucccaggguaaccgggaggucgagcgccuggcacgcaaauucggcuucgucaaccuggggccggugggugggaccgggauagacgggaagugggggcuuggaggggacugaacaacccuagaccccgacaagggggagggagcccacaaggucuucuaaauaucaagagucccagcccaccccugccucagccaagcucagcuucugggacucccagagagcaccugcuggggaaggacaaagaagggggcuguuaccggcccucgggggcuucagcaggggagccgggucccaucggugcggccgcuuccccacauccccagaucuucccugacgggcaguacuuucaccugcggcaccggggcgugguccagcagucccugaccccgcacuggggccaccgccugcaccugaagaaaaaccccaaggugagccuggccuggaggccaacccccugcccggggucucagcugccuccuggggccaccagccaucuucugugguucucgugguuguuaugaacagcugugugcuuucuguggcucagacccgcccgggccccaagucuauacagcaagaggaggcaggaagacccagauacggaaaucauggcgccugccagggccugguacacagugggcaccucuuguccucccccucccuccucugggccccaggggcucugguaaggagggacagacggcgugacuuccccaccgucuaggucaugggauggagggaaggggauuuuacgacaccguaauggguuccaaagaguaggaggcuuggcccggcgcgguggcucacgccuguaaucccagcacuuugggaggcggaggcggucggaucacaaggucaggaaaucgagacgagauccuagcgaacacggugaaacccugucucuacugaaaauacaaaaaaauuagccgggcaugguggcaggcgccuguagucccagcuauucaggaggcuuaggcaggagaauggugugaacccgggaggcggagcuugcagugagccgagaucgcgccauugcacuccagccugggcgacagagcgagacuccgucucaaaaaaaaaaaaaaaaaaaguaggaggcuuacagucacccaguggcccucaggacgcaguguccaggcgcucagaaaggggccugggucccaucgggcugggcccugucuagaaaaugccugggaugucaagcugagggguugggauggagccugggaagcccucggaggccaggaagugccuugaacaggacuggacagcugccugcuuacagcaccgggagggagagcaguggccaguuccugaugugguuugcaagagagaagccaggccuggcguggugguucaugccuguaaucccggcacuucgggaggccaaggcaggcagaucacuuaagcucaggaguucgagaccagccugaucaacauggcgaaaccccaucucuacuaaauguacaaaaauuagccgggcaugguggugugcgccuguagucccagcuacuugggaggcugagguaggagaaucgcuugaacccaggaggcagagguugcagugagccaagauugcgccacugcaccccagccugggcgacagaacaagacucugucucaaaaaaagaaaaaaaauaaggaagugaugcaggagagagauagaaggaucuagaacagggaugggggagagagugggguggggacccggggaccugcagucacccgcggcagcaacgacgcgucugugggcccaaggacaggugguccaaaagccucgaccccuuccgacugcagacagagccccaggcacauggggacccuggagagcaacccccacaaacacagggucccagggcacggggcugccucacucccugaaccacgaggggccccaggggcgagcaggggacaggccugaugcacccucugcucugcaggugcagugguuccagcagcagacgcugcagcggcgggugaaacgcucugucguggugcccacggaccccugguucuccaagcagugguacauggugagcaggcagccaggguggguagacggggacggggccgcuggcgcccucaacuccaggcccucacagggucacaaccccgccucccccugcagaacagcgaggcccaaccagaccugagcauccugcaggccuggagucaggggcugucaggccagggcaucguggucucugugcuggacgauggcaucgagaaggaccacccggaccucugggccaacuacgugagaccgcggguggcugugggcgagggcugccccaggugccgaggcuggcaccacccuagggacgccucccggcccccucauauccccaccugcccccaggacccccuggccagcuaugacuucaaugacuacgacccggacccccagccccgcuacacccccagcaaagagaaccggugagcagggcucccacagcacacgggggaagccccaguacccggcagggggauggaggccgugacaggagccccucuuggcccuggcaccaggcacgggacccgcugugcuggggagguggccgcgauggccaacaauggcuucuguggugugggggucgcuuucaacgcccgaaucggagguacccggggucccccagcggcaccauuccgggacagagagggaagggggugacucuggcggggagcugggcccaaggacucgggagcccacccucucacugcuggguggugcuagggccccagacuccagggcuuggggggugcugagccaauacgaauggucccacuccagggagcagagagagggcccagguagggcuggggagugguguggaguggcgcggggcgggcugggguguggggaagggcagggccgguggcagcggcccucccgcccuggcucugcaggcguacggaugcuggacgguaccaucaccgaugucaucgaggcccagucgcugagccugcagccgcagcacauccacauuuacagcgccagcuggggucccgaggacgacggccgcacgguggacggccccggcauccucacccgcgaggccuuccggcguggugugaccaaggugaguggcagcccgaggagggcagggguggcaggccaggccgacgcccccuccccgccccuccugguuucccagggccgcggcgggcugggcacgcucuucaucugggccucgggcaacggcggccugcacuacgacaacugcaacugcgacggcuacaccaacagcauccacacgcuuuccgugggcagcaccacccagcagggccgcgugcccugguacagcgaagccugcgccuccacccucaccaccaccuacagcagcggcguggccaccgacccccagaucgugagugcagccgccccaacaggguccccuccccaggcccugccaucccagccuggccuccuccuguccccaccacugugacuuagcacccucccaaagcugcuuugaaaaugcaaauccaggccgagcacgguggcucacaccuguaaucccagcacuuugggaggcuaaggcaggcagaucacaaggucaggagaucaagaccauccuggcuaacauggugaaacccugucucuacuaaaacuacaaaaaaaaaaggccaggcacgguggcugacgccuguaaucccagcacuuugggaggccgaggcggguggaucacgaggucgggagaucgagaccauccuggcuaacagagugaaaccccgucucuacuaaaaauacaaaaaauuagccgggcgugguggugggcgccuguagucccagcuacucgggaggcugaggcaggagaauggcaugaacccgggaggcaggguuugcagugagccgagaucgggccacugcacuccagccugggcgacagagugagacuccgucucaaaaaucaaucaaucaaucaaucaauaacccaaauccaggccaagcacaguggcucgcgccuguaaucccagcacuuugggagaccaagguggguggaucaccugaggucaagaguucaggaccagccuagccaacauggcaaaaccccaucucuacuaaaaauacaaaaaaaaauuagccaggcaugguggcgggcgccuguaaucccagcuacucaggaggcugaggcaggagaaucgcuugaaccccagagauggagguugcagugagccaagauugcaccacugcacuccaguuuaggccacagagcgagacccugucucaaaacaaaacaaaacaaaacaaaacaaaaacaaauccagccgggcgcaacagcucacuuugggaggccaaagugggagaaucacuucagcccaggguuucuuuucauuuguuuguuuuugaagauggagucuggcucugucguccaggcuggagugcaguggcgcgaucucagcucacugcaagcuccgccucccggguucacaccauucuccuuccucagccuccugaguagcugggacuacaggugcccgccaccaugcccggcuaauuuuuuguauuuucaguagagacaggguuucaccauguuagccaggaugaucucgaucuccugaccucgugauccgcccaccucggccucccaaagugcugggauuacaggugugagccacagugcccagcacuuucuuuuuucuuuugagauggagucucgcucugucacccaggcugggugcaacagagugaaguggcaugaucucagcucacugcaaccuacgccugccgggcucaagcgauucuugugccucagccucuugagcagcugagaccacaagcaugccaccauguccugcuaauuucuuuuguauauuuuguagagauggcauuucaccauguuggccaggcuggucuccaacuccucaggucaagcgauccaccagccucggccucccaaagugccgggaauagcaggccacgccaccaugcccggcuaauuuuuuuguauuuucaguagagacgggguuucaccauguuggccaggcucuuaguucuuuuugagcauaguccuuguuacuucuugaacucaguccuuggaguccuugguaccuuuuuuuuuaaauuuuuuugagacagagucucacucugucacccagguuggagugcaguggugcaaucuuagcucacugcaaccucuaccucccaggcucaagcgauccuccugccucagccuccugaguagcugggauuacaggugcacacuaccacacccagcuaauucuuguauuuuuccuguagagacgggguuucaccauguugccacaagcuggucucaaacuccugagcucaaacaaucugcccgccucagccucccaaaguguugggacuacaggcgugagccacuguguggccaguccuugguacuuuuugacuucaguucuugguacuauuuuuuuauuuuuuugagauggagucuugccauguugcccaggcuggagugcaacggugugaucuuggcucacugcaaccucugccuccuagguucaagugauugucuugccucagccucccaaguagcugggauuacaggugccccgccaccauacccggguaauuuuuuuguauuuuuaguagagacaagguguugaccaggcuggucucgaacuccugaccuccggugauccacccaccucggccucccaaagugcugggauuacaggugugagccaccgcacccagcccuugguacuuuuugaauucagucguuaguacuuuuuuuuuuuuaauccagagucuggcucuguugcccaggcuggagugcaguggcgugggugugaucuccgcucacugcaaccucugccugucggguucaagugauucuccugugucagccucccgaguagcuggaacuacaggugcccgccaccaugccuggcuaauuuuuguauuuuuguagaguugggguuucacuauguugaccaggcuggucuugaacuccugaccucagacaacacgcccgccucagccucccaaagugcugggaugacaggccugagccacugcgcccgcccaguccuugguacuuuuugaagaagggcuguauucucacugugcacggccccccgagucccaccccccucugcccucaggucaccacggaccugcaucacgggugcacagaccagcacacgggcaccucggccucagccccacuggcggccggcaugaucgcccuagcgcuggaggccaaguaggugacugcggggcccgguccaccgcccucgcccccaggcgcggcccggcggcucacccgcccccgcccccgccccccgcagcccguuccugacguggagagacaugcagcaccuggugguccgcgcguccaagccggcgcaccugcaggccgaggacuggaggaccaacggcguggggcgccaaggugcggcggggccgggcgggggcggggacccggggcccacggggcgagugacugcugcccuuccgcgcagugagccaucacuacggauacgggcugcuggacgccgggcugcugguggacaccgcccgcaccuggcugcccacccagccgcagaggaagugcgccguccggguccagagccgccccacgugagaccccugcgcgccccuccgcuauccccgcugggggugugggggacaggccugaggccucaguuuacccaucuguaaaacgagggcuggaccccgugaccucugagccccgaccucgccugcuggccgcccacccaccccccagcaggccgcaggaggguccucaccccucgacccccucagccccauccugccgcugaucuacaucagggaaaacguaucggccugcgccggccuccacaacuccauccgcucgcuggagcacgugcaggcgcagcugacgcuguccuacagccggcgcggagaccuggagaucucgcucaccagccccaugggcacgcgcuccacacucguggccauacggugagcggcccgcagaggagagggggcggccucaugcccugucgguaaacgcugccaucuacccggaguguccucacggggaggggccaggcccauaggagucacacggcagccuaguuggugggaccccgagucacacccucacccacacccagaggacacgcggccaccagcgcgugcggucagacacuucauggggcucugccggcuucacaaagccaucccucuugacacccccacccccacccacccuucugucccagacccuuggacgucagcacugaaggcuacaacaacugggucuucauguccacccacuucugggaugagaacccacagggcguguggacccugggccuagagaacaagggcuacuauuucaacacgggugagggcggggcggggcuguggugggcggggcuuggcucuccaaccuccccccaggggcucuggagcuagccuuggugaccgcacugcaaaagggguucccaguggccuucuccaagagaacaugcacacaguaggcgugcagucacccgggagauggugugcaaugacaggcacacaguaggugugcgguaacacgggagauguaggugcccagugacaggcgcacaguaggugugcagucacccgggagaugucgguguccagugacaggcgcacaguaggugugcaauucccugagagaugugaaccaguccagggccccgcgugggagcugaaggggagggagcccggggacuaccaggaccaggcugccgagagccuccuuuuccuccugugcccacccgcgaccccuguccagggacguuguaccgcuacacgcugcugcucuaugggacggccgaggacaugacagcgcggccuacaggcccccaggugaccagcagcgcgugugugcagcgggacacagaggggcugugccagggugagugccggcggggcagggcccacugcugggaggcgguggcggccaccgugggcagcgugcauguggccccaggcgggcggguggcgaguaacaggcugcggguggcaagcugacgggccuuugcgugcguguccccgagcagcgugugacggccccgccuacauccugggacagcucugccuggccuacugccccccgcgguucuucaaccacacaaggcuggugaccgcugggccugggcacacggcggcgcccgcgcugagggucugcuccagcugccaugccuccugcuacaccugccgcggcggcuccccgagggacugcaccuccugucccccauccuccacgcuggaccagcagcagggcuccugcaugggacccaccacccccgacagccgcccccggcuuagagcugccgccuguccccaccaccgcugcccagccucggccauggugcugagccuccuggccgugacccucggaggccccguccucugcggcauguccauggaccucccacuauacgccuggcucucccgugccagggccacccccaccaaaccccaggucuggcugccagcuggaaccugaaguugucagcucagaaagcgaccuugcccccgccugggucccugacaggcacugcugccaugcugccuccccaggcuggccccagaggagcgagcaccagcacccgacgccuggccugccagggaugggccccguggaaccccgaagccuggcgggagagagagagagagaagucuccucugcauuuuggguuugggcgggagugggcuggggggagaggcuggagcaccccaaaagccaggggaaaguggagggagagaaacgugacacuguccgccucgggcaccgcguccaaccucagaguuugcaaauaaagguugcuuagaag

SEQ ID NO: 16320 - RNA, 13728 nt, Homo sapiens
ccccggggucuccccuccuggugcccaucccccacaccacgcugaagccgugugcucacauguagaaaagaggcuuuauuaagaaggcuuugaagucaaaaaauaaaacucuugauacaauuuuuuuaacccuuaaaucagcucagcaaauauauaaucaguaauuuagcuguguaagauuaaagguccauuacuuuauuuaaaauaaaauauauuuuaguucuuaaaauuuauuccauaaaguacauauuucccuauaaauucccuacauauacacaagagguaaaaaguaaaaguaaaaaaaaaaaaaaauuaaaaaaauuuuaaaaaugacaacagaaaccgcaguaaaaaggggauuaauaauuaacagaaaguuagaaauuugauuggaacgccccucgcccccgccccccugcccccuccggccgcgcacgguugauguacaaaagcauaaaugguuagccccaaaaagggaguaaaaaugucacccuccuccucuggaacgucugugcggccugagaccggccggcgagaaaagucaaaucagaaaacggcuucggacgaaaggaaaaaacgcugagcgcuggaaaagucguguuuuuuguuuugcuuuuuuaaagaucacccuggaggggaggggugucuaaaaauaagaaaacuaaaaaaagugcaagcggaccuuuucucuccgguuuauuguaaccugaccacucaauacugucguugaagggcugaggcgccgccgggcugcggggucuccgucuccacgccugaggcggcaguuaaagcucaucuguaaacacuggccgccgcccaccccccugcccccucggccuccgccccucgcccccuccccgucccucucccaccccgggucccgccccgucucccgcgcccaccccuggcccccgcagauggccccggccacguggugguccgcgcucuaggaaaagauaugaauggccuggguggccggcgugcggcaggcgggacacucgggcucgcucuugccgcagaugcggacggcgcaguccaugcagaagagguuguggccgcaggggaccagcgcagccaucaccucgcccucggcgcacaccacgcacucucgcgccagggccggggccgaggacgccgaagggggcuugcggcuguucucggaggcgccggaguccaggggggcgcaggcggcggccgcggggcugcugggcagcgagguggccguggagaaggcggcgccgccugggaaggauacggggcccugcgggggucgccaggacagcgcgcccaccggguccggggcgccacggcgagacagcgggagcuccaggcggaggccgccgggcucgggcagcgugggcgaguggcggggggucccggccccacugcugcgccgggcgccggcggcgggaggucccggggcuccguugaccguggagcagccgcugaaggcgggcaagggggcggcgcgcucaaaaggcgcccagaugguggccgcggcgggcacggucagguccagcgccaggaagucgaagucgaagccgaagucgcagucgucgggggcggccguccccaccggggcaccgggacccuccgcgccgaaggcgaagcccccguugccggagccgcuguaggggcuggcggggccuggguccggcacggaggggccgccgcggcugcccgcguagaaggccucgggggcgcugggggcgcccagggccguguccccgcggaggccggccguggccguggggggccgucgucccugguugggggucuuggcccagaggcuggcggccgccccgagcagguccaggcagacgucggugccguuggcguggaagucgcugucggggcccgcgucggugaaggcgccagugcgcagcgugaugugcgccucgaucuccucgcgcgcgcgguccacguucucgggcaucccagugaccgcgaacaccggcuccuugucgcgcccgggcgucacgauguaggugugcguccgcugcuggaugcgcuugaugguggcgcccuugggccccaccaccagccccaccacccgguagggcacgcgcaccuggaugguggucuguccgggaagguugggcgggcccugggcggcgccgggcagacccccggccuugcugcgcguggcgcggaugauggagaaguguucggccgccgacaggaucucacgcuuggccaucuccacguccuccuuccggccggucacgaugaagaccggcuccucgccccgcacuggggucuugauguagguguuugucuuggcccgcagggccuugaucuugcagccuguccgggagggaggggaaggacaaggugacccagagcccccugcgcagcucagccccgcugggcaugcaggcugcagggccagugagggagccccuaccucccagccugugcccaacaacacuuuauccucagacacgccacgucccuucuucccucagccucaguuuccccucugggcucgaguuuggccuaaaagcaagacggcaaggggacccuguuuuagguugaaaggugugcgccauaauuuauguuccccuggaaccgcagugugacggcuggggugugaauguuucccccaaguucacaagcuggacccuaauaugcggcguugacaguauuaauuuaauacguagggucggcugggcccguggcucacccauguaaucccagcacuuugggaggccgaggcagguggaucacuugaggucaggaguuccaaaccagccuggccaacauggugaaacccugucucuacuaaaaauacaagcaaucauccggguguagcggcaggcaccuguagucccagguacuugggaggcugaggcaggagaaucacuugaacccaggagacgaagguugcagugagccaagauugcaccacugcaccccagccuggacgacaaagcaagacuccaacuaaaaaaaaaaaaaaagcggggugcaguggcucaccccuguaaucccagcacuuugggaggccaaguuggguggaucacgaggucaggggcucaagaccagccuggccaacauggugaaacccugucucuacuaaaauacaaaaaauuagccaggcgugguggcaggcaucuguagucccagguacucgggaggcugaggcggaagaaucgcuugaaccugggaggcagagacugcagugagccgagaucgcacaccauugcacuccagccugggugacagagcgagacugucucaaaaaaaaaaaaaaaaaaaaaaaaaaaaaaaaaaaaaagccgcaauuagcaaggugugguggcgcacgccuguaaucccagccacuggggagggcugaggcagaaccgccugaacucaggagguggagggugcagugagccaacaucaugccacugcacuccagccuagccacagaccaagacuccauuucaaaaaaaaaaaaaaaaaaagagccacaguggcagggucaguggcucacacccguaauccuaguacuucgggaaucugaggcaggaggaucacuggagcccaggaguuugagaccagccugggcaacacagcaggaccccaucucuacuacaaacaacaacaaaaaauuagccagguguggugguacacaccuguagucuuagcuacucaggaggcugaagugggaggaucaccugagcccgggagguggaggcugcagugagcuaugaucacaccacugcacuucagccugggugacagagcaaagccuugucucaaaaaaagaaggaaaaaaaaaaaaaagacacacacacacagagaagcuggccuuguggagacacagacagagacugcagugaugucucuacaagccaaggacuggccauagcccccggaaacugaaggcgccccccgcccugcccacaccuugacuuggaacuuuuaucuuacagaaaugagagaggagacguuuccaugguuucaagcccccauugugucagcccagagagcaacuggagacccucugacaccaccucccggcccaacaggaggggaagccgaaauucagauuguggaaacugccuacaauuuucuuccggccaaaugacccucccuaggcuaccaagacccuggccuaaggggagccgaggucucggcccgacugcagacgcccgcacccugacuccagaugccuccgaggcauccaggugggcccugaggggccugcuguggcuuuguucuuguuggcugggcugggggucugaccuggugagggacaugagugucagugugggaggcagggcucuccucaccgauuguguaggcaaccgcugaccagguauggccuucuuggggucccagacaucccuaccccaccccuggggccuuaaugguuuuuuuuuuuuucuuuuccuuuuuugagauuaucucacucuuguuacccaggcuggagugcaguggugugaucauagcucacugcagccuucaacuccugggcucaagugauccucccaccucagccuccagagcuggcaccaccaugcccagcuuaauuaguuauugagacggaguuuugcucuuguugcccaggcuggagugcagugguaccaucucggcucacugcaaccucugccuccuagguucaaacaauucuccugccucagcuuccugaguagcugggauuacaggcgcccaccaccacacccagcuaauuuuuuuuauuuuuaguacagaugggauugcaccauguuggccaggcuggucuugaacuccugaccucaggugauccaccugccuuggccucccaaagugcugggauuacaggcgugagccaccacgcccggccuauuuuuauuuuuaguagagaugggaucucacuauauugcccaggcugguuucaaauucuugggcucaagcaguccuccugccucggccucccaaagugcugggaugacaggugugggccacugcgcccggcccgugaaggaguuuugagccacugcucacaaccccucaggcucuggggaagcagagggagcugcagggauguuucaauacagucagaagguggcucugaggggaaaacaguguugcuaacucucccacagugcaagagaugaaaugagcaggaucagcacuuuugacggggaagaagucagaaacugccugggccaggaagauggaaggcgugggaccuggaggcugguggucccaggggcucgguagggaggacccugggagggguggcgggggugcacccacucggaggaggacagcaguuuucccgccccagcugcacugccaccacaccugucccucccagucgcagcauucuguucaccuccauugcacccaguccccuccauucuucuguacaguccggugucccccuccuccaggaagcccacccugacugcaucggguugggccugcucuucugagucucuccuaacaugccugacucucugagcugccucccugaggcuggaggauggggcuggggauucccucggcacuugggggaccuugcuaugccuguuucuucacugugaaaggggaagguaacaggccuggcuucacaggcccggcuucacaggcccucagagggccaugaccaggccguuggcuccuggcagccacccuggcaggucucacugcagcccacaguguuugcuuuagauagauccuccuugaggaagggaaacugaggcacagggaguggagacccagcaaggcuggggaaggaggugccacccacagauggaggcuccgcuggcccugcccacaggcaggaagugagccuguuccccaucacgccgacccggcagagggcagagcccgccagcguugccagggugcagcaugggguccucccuugcugaucugggagccgccccggguccccagagggucacacgugggagaggcugccccgacguggccaccgcugagcucacaggcuguggucacagaaagucuggucugggugagaugacaaauuugggagauggagguggcaaggaagggggcgugugacugucugagcagaaaccaggauggugcugggagccacgcgugcgucggggcaggggagggaacuggcgccucccccuccccuuacuccauccugcccuaacccagacgguggcgcuggguggagaccucacagcuagaaggccucuaggaccucaaagacggagcuggagcucaauucauuggugcugcgucugcuuugacacgugcuggcccccaaaacuccacccacaucaagacgccaaggggccaaggaaucggggcuccaggagugaucccagcccaccccugccccacuggaaaugacacagcgaggcuagagggacaggaagccugaagggcgggcucugggggacaccgaagguuggcaggcacugaaaugcagauucgugggccauguccccagaauuccaacucggagggcuugagaugccugggaaucggggugaccaccccagagucuggcccugaccugucccacacccccaacccacagcagccaagucucccccuaccagggccccacgcagcacacacaccagcgggcaucacucauccagcccguccaggguccuggcugcaaugaccgugcacuacgacuuaccaaugaaaccacaaguccuggugugggagccgaggccaccagcccaggcuggauggguuugccauggcaggaaggggaaugugaaccccagggagccgcugaggcaacagcaaggacaggauucuagaagcaggacggggcgagaacaaggccucacagccaacacucaguccaacacgcagccgcccccagccaggcagccgggugacgcgggacagcagcaucccagaccugggccacuauggaagccagcgggagcugaggggucugguggggaggagggaagcugguucagcugucaaacagggaugucaaaacccccucccaggccaggaacaguggcucacacccguacguaguuccggcacuuugggaggccaaggcaggaggaucacuugaggccaggaguucgagaccagccugggcaacauagcaagauccugucucuauaaagggugucaccugucgcccaggcuggagugcagucacagcucacugcagccuugaccuccugggcucaagccauccucucaccucagccucccgaguagcugggacuacaguuaugcaccaccacccccggcuaauuguuuaaagcuuuucugcagagacagggucuuauuauguugcccaggcuggucuggaacucuugggcucaggugauccucccaucucagccucccaaagugcuaggauuacaggugugagccaccauauccggccucuacaaaaaauuuuuaaaaauuagccagguguggccgggcacgguggcucacaccuguaaucccagcacuuugggaggccaaaauggguggaucacgaggucaggagaucaagaccauccuagcuaacacggugaaaccccgucucuacuaaaaauacaaaaaauuagccgggugugguggugggcgccuguagucccagcuacuugggaggcugaggcagaagaauggcgugaaccugggagauggagguugcagugagcugagaucgcgccacugcacucuagccugggcgacagagugagacuccgucucaaaaaaaaaaaaaaauuagccagguguggaccgggcacaguggaucacgaggucaggaguucgagaccagacugaccaacauggugaaaccccaucuccacuaaaaauacaaaaauuagccgggcgugguggcgggcgccuguaaucccaguuacucgggaggcugaggcaggagaaucgcuugaacccgggaggcagagcuugcagugagccgagauugcaccacugcacuccagccugggcgacagagugagacuccgccucaaaagaaaagaaaagaaaagaaaauuagcuggguguguuggugcgcaccuguggucccagcuacuugggaggcagaggugggaggaucgucugagcccaggagguugaggcugcagugagcuacaaucacaccacugcacucaggacagagcaacagaaccagacccugucucaaaaacaacaaaacaaaacaacaacaacaagaaaccgcuaggcguggugacucacaccuguaaucccagcacuuugggagguggaggcaggcggaugaccugaggucaggaguucgagaccggccuggccaacauggcgaaaccccgucucuacuaaaaauacaaaaaugagccuggcguggugguggcagauaccuguaaucccagcuacucgggaggcugaggugaaagaacugcuugaaccugggagguggaggcugcagugagccgagacugagccacuguacuccagccugggcgacaagagcaagacccugucucaaaaugaaaagaaaaaaaccucucggggaaugaagggaacauguacacuguacuaacgccagaacucucaguugggucugcaguguggagguuuccuagcagagccuuucuuccuagggcucugcaguguauggacaggaaaaccauggcaugguccccaccaacaccccagcacuguccccagcugucgggaaaaccuggggccugcggggaugggaggagaagaggagccucuggggcugcagccaggaacaagggacaggaggggagacagugagccaggggucgcccccagcugaggggaacaaccuaaaaucacuagccuuagccugugccgacagcagagagagcgagcccugagcagcuuccaguccaggcccugccuucaacaucacucacucauucauucauucauuagccacagaacaccuucuguguacaggcccuggcaagacacugaagacccaaccaugaccaagcaccugcccugguuccugucccugggaacaugcagggggagaggcugccacggagcacagauucacccagggugccuggcaagcggggugagaaaggaggguacauguuggggucucagcaggagcagggccggagguccccuagagcaccuuugcuggccggcuggagggagacgccugugcuuuugggucuccacuuugccugucucccagacagggcugccuccccucacccccagcccucaagcuuuggaaucugaaauuuucuuugcugacccaccagagaaacuggguuugaaucccagcccaugauuuuuguuuuguuuuggagacagggucuugcuuuguugccuagacuggagagcggugacaagaucauagcucacugcagccucgaccgcccaggcucaaguaauccuccugccucagccuccagaguagcuggggcugcaggagugugccaccaugccuaauuuuuguauuuuuuuuuuuguagagacaggguuucgccauguuggccgggcuggucucgauuccuaggcucgagggauccuccugccucagccucucugagugcugcuauccccucaguuuuuaccuauucuuuaccucuugcagccucugccuccccaucugugaccugggagcugcaggaccuuuccuggggcacauuaugggccucagugagauggggcaggucaagucuggcauaggcuuagcacacaguagacccucaauaaagaucuagccaauggccaggcgcaguggcucacaccuguagucccagcacucugggaggcugagguggguggaucaccugaggucaggagugugagaccagccuggccaacauggcgaaaccccgucucuacugaaaauacaaaaaccagcugggcauaguggcacgugccuguaaucccacauacuaggggggcugaggcaggaggaucgcuugaaccugggagguggagcuugcagugaaccgggaucgugccauugcacuccagccugggcaacagagcgagacuccaucccaaaaaaaaaaaaaaaaaaagauauagcaaaugaaugaacuggagccuccagcagaugggugggaacucagaggguuugaaugaccacagucugcccagaaagcacucggacccccucuaggaucaagagaacugaagcucagagaacagcacguagcuacuggggagagggcuggugccaggccugugugacucuugucuagguggggaggccggacaggugcacccuuccuggccuccagggaagggguaaccuuggagcuuggguuugacagagaagcaugagaaguucagagagccccaggguggagaggaaggugaguaaaggggcagggccggggcacaaaggacauugaaagguaugcuugagaacggggugggugggagaagcugggagccacagaugguucuacaguguggaagaaguacagacuaccgaagcuguggaagacguaaggacuacugaagcugccaaccuguccuggcauccacaguugcaucccuggcaacgcgcacuccacuuaugggguggccacugugugugaccuggagcugggauuaaaaccagcaacuuggguccaggcauaguggcucacaccuguaggaaccccagcacuuuggguggcugaggaucgcuugaggccaggaguucaagaccagccugagcaacagagcaagacccugucucuacaagaaaaacuuuauaauaaaaacaaauaaauaaaacuggccgugcgcaguggcucacgccuguaaucucagcacuuugggagguggaggugggcggaucacuugaggucgggaguucgagaccagccuggacaacauggugaaaccccgucucuacuaaaaauacaaaaaucagcugagcgugguggcucacacuuguaaucccagcuacucaggaggcugaggcaggagaacugcuugaaaccagaaggcggaguuugcagugagcccagaucacgucacugcacuccagccugggcgacagagcgaaacuccgucucauaaauaaauaaauaaaaccagcaucuugccccagaauccucuacccuaauggaggugagacguccgcacaucacagagaggggccgucaucugcgcagggccacggcggccugcaggacaagcaaucagggcccacucuacccccgacccccacuguaccccagggccugccuugcugacggccaccagcaagagcccaguaagugggugcagaacgcacaggccagaggugggggcugagccuggugcccacagacuccauuucccauggaccugccccuagagaauucccacccugaggccacaggucuagaagcucucagccugacgcugauuccugccagcuccccauguggccauagccucgcucaaaggcccuugggugccaggacaagcgcguucacaaagaacacagccacagccuccaccaccuggaggcucaggcucgugccuuuggucacuugguccccaggccucggcuuggacgccugucuccacaggcucccagacacuccgcacagggcagcugucccguucuaggcccuggguaugggacauggaggccggguggaaggccucaauggggaggcaguaacaggaugguagggcgcccuccugccagggggucccaccaagggcagccagcaggacugagacagaacccagucccuccccacccaccacuccagagcaugcuuccuggggccagcaccaugccugacccuccguggguccccacaugagcuggacaaaugaacgaccaaaagacaggaggcuguggugccccacccaccuggaccgagggaaagggcggaggggagggcgcccugguggucccccgccugaggccagggccauagaugaccuugcaaucccagccccccacaccuuucucuggccuggauucccgagggccccggggaggcagggacccccagcccaaguguccugcggccccaccaccagccccgccaaggccccaccccaaguucuagaaccuggcugaucacuggcggucagcggggacccaggagcggggagggguggcgggaaggcaggagaaaguugagggaggcaggcgggcggguggcuaacgggguggugggugugagcugggccaggcacugcccaccacccgcccgcccgccccgcagcucgggggccaaugagcagcggccggccugaugucacccugcaaaucucagccucgcucucuaacaaagagaacaauggggcggccagagggaagcuccgacgaugccaccgcuggaccccacacccggggccugccgcccgccggccugcccagcaggcugcaccccagaaguggcuuugacagccgguccuuccccaggccccgaaaucccugacucggggccagagaguggagcagggacccucuccugcccggucccguccccaccccagucagggccccaggcuggagacugagacgugcgcucuuuguacugucagccuucucucccgguccugcaggcggccccccuaagccaccccuaaaccugcgcuugccccgccccgccgccugugcuggguguggggcgccccccgcccggccggagccccgggcccucgagccccucucuggggugccccugcgggcggccgagggccugggcugcggcgcggcuccccggagccuuuccgggcuggaggcggcccagacaaaggcggcggcggggccggagcgcgcaggggaggagcgcgggcugcgcccaacuuucucccgcggcggcugcaggacaaaggcgcaaaggcagcggccgaggccggagcccacgcggggcguguccggugcggggcguccggcgcgggcugggcugggcucgggcgacccccuuccccggggcggacggugcggggacccccaggacagcaacccccgacgagggccacucacccuggcgacccacgaucucggcgacgugcucggagcugggcaccgggacgcacucggucauguugacgcuuuucuugcggcugccgaucacgcucaucuggucggccagcagcgucgggggccccagggccgcgggguggggcgcgaagcccgcgaacacgucggggggcgacggccggggcggcggcggcggcgggggacucgcguugggguccagcagcggcagcgacccgggggccacggcgggggccagggucgggggcgcgccggccucagguccgucggggggcacaggcuccggagccgccccgccguccgcgccccccgccgccgcugcgccguccccggccgcccccuccucguccgugucgccagcgccccccagcccgagcgccgacagcugguccagcgccaggcggagcgcggcggccgcgucgucggguucgggcggcggccggggcgcgggcgcggccuccugggcgcccucgggcgggggcgcagguccggguccgggguccucccccgccgcccccacgccgccgccgccgccgcccccgcccccgccgccgucgggcuggccgagcgagcugggcauggcgggagcuagcgcuggggcccgcgcuccugccgcccgcgccgccgccgccgcccgcgccgcccuccgccucugcgagcugggccgccggccgccugcauccagcggcgggggcgggcacggggggccgggcgggcggggcggcggcggcgcggggcugcucggggccgggccgggccgggccgggcggcggcagcgacucuggcugcggcucggcggcggcggcgacggcggcggcggcuccucggcggccgaggcggcggcggcggcgcgggacgcuccuucc

SEQ ID NO: 16321 - RNA, 13728 nt, Homo sapiens
ggaaggagcgucccgcgccgccgccgccgccucggccgccgaggagccgccgccgccgucgccgccgccgccgagccgcagccagagucgcugccgccgcccggcccggcccggcccggccccgagcagccccgcgccgccgccgccccgcccgcccggccccccgugcccgcccccgccgcuggaugcaggcggccggcggcccagcucgcagaggcggagggcggcgcgggcggcggcggcggcgcgggcggcaggagcgcgggccccagcgcuagcucccgccaugcccagcucgcucggccagcccgacggcggcgggggcgggggcggcggcggcggcggcgugggggcggcgggggaggaccccggacccggaccugcgcccccgcccgagggcgcccaggaggccgcgcccgcgccccggccgccgcccgaacccgacgacgcggccgccgcgcuccgccuggcgcuggaccagcugucggcgcucgggcuggggggcgcuggcgacacggacgaggagggggcggccggggacggcgcagcggcggcggggggcgcggacggcggggcggcuccggagccugugccccccgacggaccugaggccggcgcgcccccgacccuggcccccgccguggcccccgggucgcugccgcugcuggaccccaacgcgagucccccgccgccgccgccgccccggccgucgccccccgacguguucgcgggcuucgcgccccaccccgcggcccuggggcccccgacgcugcuggccgaccagaugagcgugaucggcagccgcaagaaaagcgucaacaugaccgagugcgucccggugcccagcuccgagcacgucgccgagaucgugggucgccagggugaguggcccucgucggggguugcuguccuggggguccccgcaccguccgccccggggaagggggucgcccgagcccagcccagcccgcgccggacgccccgcaccggacacgccccgcgugggcuccggccucggccgcugccuuugcgccuuuguccugcagccgccgcgggagaaaguugggcgcagcccgcgcuccuccccugcgcgcuccggccccgccgccgccuuugucugggccgccuccagcccggaaaggcuccggggagccgcgccgcagcccaggcccucggccgcccgcaggggcaccccagagaggggcucgagggcccggggcuccggccgggcggggggcgccccacacccagcacaggcggcggggcggggcaagcgcagguuuagggguggcuuaggggggccgccugcaggaccgggagagaaggcugacaguacaaagagcgcacgucucagucuccagccuggggcccugacugggguggggacgggaccgggcaggagagggucccugcuccacucucuggccccgagucagggauuucggggccuggggaaggaccggcugucaaagccacuucuggggugcagccugcugggcaggccggcgggcggcaggccccgggugugggguccagcgguggcaucgucggagcuucccucuggccgccccauuguucucuuuguuagagagcgaggcugagauuugcagggugacaucaggccggccgcugcucauuggcccccgagcugcggggcgggcgggcggguggugggcagugccuggcccagcucacacccaccaccccguuagccacccgcccgccugccucccucaacuuucuccugccuucccgccaccccuccccgcuccuggguccccgcugaccgccagugaucagccagguucuagaacuugggguggggccuuggcggggcuggugguggggccgcaggacacuugggcugggggucccugccuccccggggcccucgggaauccaggccagagaaagguguggggggcugggauugcaaggucaucuauggcccuggccucaggcgggggaccaccagggcgcccuccccuccgcccuuucccucgguccagguggguggggcaccacagccuccugucuuuuggucguucauuuguccagcucauguggggacccacggagggucaggcauggugcuggccccaggaagcaugcucuggagugguggguggggagggacuggguucugucucaguccugcuggcugcccuuggugggacccccuggcaggagggcgcccuaccauccuguuacugccuccccauugaggccuuccacccggccuccaugucccauacccagggccuagaacgggacagcugcccugugcggagugucugggagccuguggagacaggcguccaagccgaggccuggggaccaagugaccaaaggcacgagccugagccuccaggugguggaggcuguggcuguguucuuugugaacgcgcuuguccuggcacccaagggccuuugagcgaggcuauggccacauggggagcuggcaggaaucagcgucaggcugagagcuucuagaccuguggccucagggugggaauucucuaggggcagguccaugggaaauggagucugugggcaccaggcucagcccccaccucuggccugugcguucugcacccacuuacugggcucuugcugguggccgucagcaaggcaggcccugggguacagugggggucggggguagagugggcccugauugcuuguccugcaggccgccguggcccugcgcagaugacggccccucucugugaugugcggacgucucaccuccauuaggguagaggauucuggggcaagaugcugguuuuauuuauuuauuuaugagacggaguuucgcucugucgcccaggcuggagugcagugacgugaucugggcucacugcaaacuccgccuucugguuucaagcaguucuccugccucagccuccugaguagcugggauuacaagugugagccaccacgcucagcugauuuuuguauuuuuaguagagacgggguuucaccauguuguccaggcuggucucgaacucccgaccucaagugauccgcccaccuccaccucccaaagugcugagauuacaggcgugagccacugcgcacggccaguuuuauuuauuuguuuuuauuauaaaguuuuucuuguagagacagggucuugcucuguugcucaggcuggucuugaacuccuggccucaagcgauccucagccacccaaagugcugggguuccuacaggugugagccacuaugccuggacccaaguugcugguuuuaaucccagcuccaggucacacacaguggccaccccauaaguggagugcgcguugccagggaugcaacuguggaugccaggacagguuggcagcuucaguaguccuuacgucuuccacagcuucgguagucuguacuucuuccacacuguagaaccaucuguggcucccagcuucucccacccaccccguucucaagcauaccuuucaauguccuuugugccccggcccugccccuuuacucaccuuccucuccacccuggggcucucugaacuucucaugcuucucugucaaacccaagcuccaagguuaccccuucccuggaggccaggaagggugcaccuguccggccuccccaccuagacaagagucacacaggccuggcaccagcccucuccccaguagcuacgugcuguucucugagcuucaguucucuugauccuagaggggguccgagugcuuucugggcagacuguggucauucaaacccucugaguucccacccaucugcuggaggcuccaguucauucauuugcuauaucuuuuuuuuuuuuuuuuuuugggauggagucucgcucuguugcccaggcuggagugcaauggcacgaucccgguucacugcaagcuccaccucccagguucaagcgauccuccugccucagccccccuaguaugugggauuacaggcacgugccacuaugcccagcugguuuuuguauuuucaguagagacgggguuucgccauguuggccaggcuggucucacacuccugaccucaggugauccacccaccucagccucccagagugcugggacuacaggugugagccacugcgccuggccauuggcuagaucuuuauugagggucuacugugugcuaagccuaugccagacuugaccugccccaucucacugaggcccauaaugugccccaggaaagguccugcagcucccaggucacagauggggaggcagaggcugcaagagguaaagaauagguaaaaacugaggggauagcagcacucagagaggcugaggcaggaggaucccucgagccuaggaaucgagaccagcccggccaacauggcgaaacccugucucuacaaaaaaaaaaauacaaaaauuaggcaugguggcacacuccugcagccccagcuacucuggaggcugaggcaggaggauuacuugagccugggcggucgaggcugcagugagcuaugaucuugucaccgcucuccagucuaggcaacaaagcaagacccugucuccaaaacaaaacaaaaaucaugggcugggauucaaacccaguuucucuggugggucagcaaagaaaauuucagauuccaaagcuugagggcugggggugaggggaggcagcccugucugggagacaggcaaaguggagacccaaaagcacaggcgucucccuccagccggccagcaaaggugcucuaggggaccuccggcccugcuccugcugagaccccaacauguacccuccuuucucaccccgcuugccaggcacccugggugaaucugugcuccguggcagccucucccccugcauguucccagggacaggaaccagggcaggugcuuggucaugguugggucuucagugucuugccagggccuguacacagaagguguucuguggcuaaugaaugaaugaaugagugagugauguugaaggcagggccuggacuggaagcugcucagggcucgcucucucugcugucggcacaggcuaaggcuagugauuuuagguuguuccccucagcugggggcgaccccuggcucacugucuccccuccugucccuuguuccuggcugcagccccagaggcuccucuucuccucccauccccgcaggccccagguuuucccgacagcuggggacagugcugggguguugguggggaccaugccaugguuuuccuguccauacacugcagagcccuaggaagaaaggcucugcuaggaaaccuccacacugcagacccaacugagaguucuggcguuaguacaguguacauguucccuucauuccccgagagguuuuuuucuuuucauuuugagacagggucuugcucuugucgcccaggcuggaguacaguggcucagucucggcucacugcagccuccaccucccagguucaagcaguucuuucaccucagccucccgaguagcugggauuacagguaucugccaccaccacgccaggcucauuuuuguauuuuuaguagagacgggguuucgccauguuggccaggccggucucgaacuccugaccucaggucauccgccugccuccaccucccaaagugcugggauuacaggugugagucaccacgccuagcgguuucuuguuguuguuguuuuguuuuguuguuuuugagacagggucugguucuguugcucuguccugagugcaguggugugauuguagcucacugcagccucaaccuccugggcucagacgauccucccaccucugccucccaaguagcugggaccacaggugcgcaccaacacacccagcuaauuuucuuuucuuuucuuuucuuuugaggcggagucucacucugucgcccaggcuggagugcaguggugcaaucucggcucacugcaagcucugccucccggguucaagcgauucuccugccucagccucccgaguaacugggauuacaggcgcccgccaccacgcccggcuaauuuuuguauuuuuaguggagaugggguuucaccauguuggucagucuggucucgaacuccugaccucgugauccacugugcccgguccacaccuggcuaauuuuuuuuuuuuuuugagacggagucucacucugucgcccaggcuagagugcaguggcgcgaucucagcucacugcaaccuccaucucccagguucacgccauucuucugccucagccucccaaguagcugggacuacaggcgcccaccaccacacccggcuaauuuuuuguauuuuuaguagagacgggguuucaccguguuagcuaggauggucuugaucuccugaccucgugauccacccauuuuggccucccaaagugcugggauuacaggugugagccaccgugcccggccacaccuggcuaauuuuuaaaaauuuuuuguagaggccggauaugguggcucacaccuguaauccuagcacuuugggaggcugagaugggaggaucaccugagcccaagaguuccagaccagccugggcaacauaauaagacccugucucugcagaaaagcuuuaaacaauuagccgggggugguggugcauaacuguagucccagcuacucgggaggcugaggugagaggauggcuugagcccaggaggucaaggcugcagugagcugugacugcacuccagccugggcgacaggugacacccuuuauagagacaggaucuugcuauguugcccaggcuggucucgaacuccuggccucaagugauccuccugccuuggccucccaaagugccggaacuacguacgggugugagccacuguuccuggccugggaggggguuuugacaucccuguuugacagcugaaccagcuucccuccuccccaccagaccccucagcucccgcuggcuuccauaguggcccaggucugggaugcugcugucccgcgucacccggcugccuggcugggggcggcugcguguuggacugaguguuggcugugaggccuuguucucgccccguccugcuucuagaauccuguccuugcuguugccucagcggcucccugggguucacauuccccuuccugccauggcaaacccauccagccugggcugguggccucggcucccacaccaggacuugugguuucauugguaagucguagugcacggucauugcagccaggacccuggacgggcuggaugagugaugcccgcuggugugugugcugcguggggcccugguagggggagacuuggcugcuguggguugggggugugggacaggucagggccagacucugggguggucaccccgauucccaggcaucucaagcccuccgaguuggaauucuggggacauggcccacgaaucugcauuucagugccugccaaccuucggugucccccagagcccgcccuucaggcuuccugucccucuagccucgcugugucauuuccaguggggcaggggugggcugggaucacuccuggagccccgauuccuuggccccuuggcgucuugauguggguggaguuuugggggccagcacgugucaaagcagacgcagcaccaaugaauugagcuccagcuccgucuuugagguccuagaggccuucuagcugugaggucuccacccagcgccaccgucuggguuagggcaggauggaguaaggggagggggaggcgccaguucccuccccugccccgacgcacgcguggcucccagcaccauccugguuucugcucagacagucacacgcccccuuccuugccaccuccaucucccaaauuugucaucucacccagaccagacuuucugugaccacagccugugagcucagcgguggccacgucggggcagccucucccacgugugacccucuggggacccggggcggcucccagaucagcaagggaggaccccaugcugcacccuggcaacgcuggcgggcucugcccucugccgggucggcgugauggggaacaggcucacuuccugccugugggcagggccagcggagccuccaucuguggguggcaccuccuuccccagccuugcugggucuccacucccugugccucaguuucccuuccucaaggaggaucuaucuaaagcaaacacugugggcugcagugagaccugccaggguggcugccaggagccaacggccuggucauggcccucugagggccugugaagccgggccugugaagccaggccuguuaccuuccccuuucacagugaagaaacaggcauagcaaggucccccaagugccgagggaauccccagccccauccuccagccucagggaggcagcucagagagucaggcauguuaggagagacucagaagagcaggcccaacccgaugcagucagggugggcuuccuggaggagggggacaccggacuguacagaagaauggaggggacugggugcaauggaggugaacagaaugcugcgacugggagggacaggugugguggcagugcagcuggggcgggaaaacugcuguccuccuccgagugggugcacccccgccaccccucccaggguccucccuaccgagccccugggaccaccagccuccaggucccacgccuuccaucuuccuggcccaggcaguuucugacuucuuccccgucaaaagugcugauccugcucauuucaucucuugcacugugggagaguuagcaacacuguuuuccccucagagccaccuucugacuguauugaaacaucccugcagcucccucugcuuccccagagccugagggguugugagcaguggcucaaaacuccuucacgggccgggcgcaguggcccacaccugucaucccagcacuuugggaggccgaggcaggaggacugcuugagcccaagaauuugaaaccagccugggcaauauagugagaucccaucucuacuaaaaauaaaaauaggccgggcgugguggcucacgccuguaaucccagcacuuugggaggccaaggcagguggaucaccugaggucaggaguucaagaccagccuggccaacauggugcaaucccaucuguacuaaaaauaaaaaaaauuagcugggugugguggugggcgccuguaaucccagcuacucaggaagcugaggcaggagaauuguuugaaccuaggaggcagagguugcagugagccgagaugguaccacugcacuccagccugggcaacaagagcaaaacuccgucucaauaacuaauuaagcugggcaugguggugccagcucuggaggcugaggugggaggaucacuugagcccaggaguugaaggcugcagugagcuaugaucacaccacugcacuccagccuggguaacaagagugagauaaucucaaaaaaggaaaagaaaaaaaaaaaaaccauuaaggccccaggggugggguagggaugucugggaccccaagaaggccauaccuggucagcgguugccuacacaaucggugaggagagcccugccucccacacugacacucaugucccucaccaggucagacccccagcccagccaacaagaacaaagccacagcaggccccucagggcccaccuggaugccucggaggcaucuggagucagggugcgggcgucugcagucgggccgagaccucggcuccccuuaggccagggucuugguagccuagggagggucauuuggccggaagaaaauuguaggcaguuuccacaaucugaauuucggcuuccccuccuguugggccgggagguggugucagagggucuccaguugcucucugggcugacacaaugggggcuugaaaccauggaaacgucuccucucucauuucuguaagauaaaaguuccaagucaaggugugggcagggcggggggcgccuucaguuuccgggggcuauggccaguccuuggcuuguagagacaucacugcagucucugucugugucuccacaaggccagcuucucugugugugugugucuuuuuuuuuuuuuuccuucuuuuuuugagacaaggcuuugcucugucacccaggcugaagugcaguggugugaucauagcucacugcagccuccaccucccgggcucaggugauccucccacuucagccuccugaguagcuaagacuacagguguguaccaccacaccuggcuaauuuuuuguuguuguuuguaguagagaugggguccugcuguguugcccaggcuggucucaaacuccugggcuccagugauccuccugccucagauucccgaaguacuaggauuacgggugugagccacugacccugccacuguggcucuuuuuuuuuuuuuuuuuuugaaauggagucuuggucuguggcuaggcuggagugcaguggcaugauguuggcucacugcacccuccaccuccugaguucaggcgguucugccucagcccuccccaguggcugggauuacaggcgugcgccaccacaccuugcuaauugcggcuuuuuuuuuuuuuuuuuuuuuuuuuuuuuuuuuuuuuugagacagucucgcucugucacccaggcuggagugcaauggugugcgaucucggcucacugcagucucugccucccagguucaagcgauucuuccgccucagccucccgaguaccugggacuacagaugccugccaccacgccuggcuaauuuuuuguauuuuaguagagacaggguuucaccauguuggccaggcuggucuugagccccugaccucgugauccacccaacuuggccucccaaagugcugggauuacaggggugagccacugcaccccgcuuuuuuuuuuuuuuuaguuggagucuugcuuugucguccaggcuggggugcaguggugcaaucuuggcucacugcaaccuucgucuccuggguucaagugauucuccugccucagccucccaaguaccugggacuacaggugccugccgcuacacccggaugauugcuuguauuuuuaguagagacaggguuucaccauguuggccaggcugguuuggaacuccugaccucaagugauccaccugccucggccucccaaagugcugggauuacaugggugagccacgggcccagccgacccuacguauuaaauuaauacugucaacgccgcauauuaggguccagcuugugaacuugggggaaacauucacaccccagccgucacacugcgguuccaggggaacauaaauuauggcgcacaccuuucaaccuaaaacaggguccccuugccgucuugcuuuuaggccaaacucgagcccagaggggaaacugaggcugagggaagaagggacguggcgugucugaggauaaaguguuguugggcacaggcugggagguaggggcucccucacuggcccugcagccugcaugcccagcggggcugagcugcgcagggggcucugggucaccuuguccuuccccucccucccggacaggcugcaagaucaaggcccugcgggccaagacaaacaccuacaucaagaccccagugcggggcgaggagccggucuucaucgugaccggccggaaggaggacguggagauggccaagcgugagauccugucggcggccgaacacuucuccaucauccgcgccacgcgcagcaaggccgggggucugcccggcgccgcccagggcccgcccaaccuucccggacagaccaccauccaggugcgcgugcccuaccgggugguggggcuggugguggggcccaagggcgccaccaucaagcgcauccagcagcggacgcacaccuacaucgugacgcccgggcgcgacaaggagccgguguucgcggucacugggaugcccgagaacguggaccgcgcgcgcgaggagaucgaggcgcacaucacgcugcgcacuggcgccuucaccgacgcgggccccgacagcgacuuccacgccaacggcaccgacgucugccuggaccugcucggggcggccgccagccucugggccaagacccccaaccagggacgacggccccccacggccacggccggccuccgcggggacacggcccugggcgcccccagcgcccccgaggccuucuacgcgggcagccgcggcggccccuccgugccggacccaggccccgccagccccuacagcggcuccggcaacgggggcuucgccuucggcgcggagggucccggugccccgguggggacggccgcccccgacgacugcgacuucggcuucgacuucgacuuccuggcgcuggaccugaccgugcccgccgcggccaccaucugggcgccuuuugagcgcgccgcccccuugcccgccuucagcggcugcuccacggucaacggagccccgggaccucccgccgccggcgcccggcgcagcaguggggccgggaccccccgccacucgcccacgcugcccgagcccggcggccuccgccuggagcucccgcugucucgccguggcgccccggacccggugggcgcgcuguccuggcgacccccgcagggccccguauccuucccaggcggcgccgccuucuccacggccaccucgcugcccagcagccccgcggccgccgccugcgccccccuggacuccggcgccuccgagaacagccgcaagcccccuucggcguccucggccccggcccuggcgcgagagugcguggugugcgccgagggcgaggugauggcugcgcugguccccugcggccacaaccucuucugcauggacugcgccguccgcaucugcggcaagagcgagcccgagugucccgccugccgcacgccggccacccaggccauucauaucuuuuccuagagcgcggaccaccacguggccggggccaucugcgggggccaggggugggcgcgggagacggggcgggacccggggugggagagggacggggagggggcgaggggcggaggccgagggggcaggggggugggcggcggccaguguuuacagaugagcuuuaacugccgccucaggcguggagacggagaccccgcagcccggcggcgccucagcccuucaacgacaguauugaguggucagguuacaauaaaccggagagaaaagguccgcuugcacuuuuuuuaguuuucuuauuuuuagacaccccuccccuccagggugaucuuuaaaaaagcaaaacaaaaaacacgacuuuuccagcgcucagcguuuuuuccuuucguccgaagccguuuucugauuugacuuuucucgccggccggucucaggccgcacagacguuccagaggaggagggugacauuuuuacucccuuuuuggggcuaaccauuuaugcuuuuguacaucaaccgugcgcggccggagggggcaggggggcgggggcgaggggcguuccaaucaaauuucuaacuuucuguuaauuauuaauccccuuuuuacugcgguuucuguugucauuuuuaaaauuuuuuuaauuuuuuuuuuuuuuuacuuuuacuuuuuaccucuuguguauauguagggaauuuauagggaaauauguacuuuauggaauaaauuuuaagaacuaaaauauauuuuauuuuaaauaaaguaauggaccuuuaaucuuacacagcuaaauuacugauuauauauuugcugagcugauuuaaggguuaaaaaaauuguaucaagaguuuuauuuuuugacuucaaagccuucuuaauaaagccucuuuucuacaugugagcacacggcuucagcguggugugggggaugggcaccaggaggggagaccccgggg

SEQ ID NO: 16322 - RNA, 11249 nt, Homo sapiens
caggccgagcgcgggcgucggcggcggcgcgcgccgggccuccuccuccuccuccuccgccucccgcacucgagcagccgccgccggccggacggacgccgcucccgccgccuccgcuccgcccgccgcgccgcgcgcccuugcucggcaugucggcggccguggcgugcguggauuacuucgccgccgacgugcucauggccaucucuucgggcgccguggugcaccgcgggcggcccggccccgagggcgcgggccccgccgccggccuggaugugcgcgcggcgcgccgcgaggccgccucacccgggaccccggggccacccccgccgccccccgccgcuucuggcccgggccccggcgccgccgcggcgccccaccugcuggccgccagcauccuggccgaccugcgcggcggacccggagccgccccggggggcgccucgcccgccuccuccuccucagccgccucguccccguccucgggccgcgcccccggcgccgcgcccuccgccgccgccaagagccaccgcugucccuucccggacugcgccaaagccuacuacaaguccucgcaccuaaagucgcaccugcggacgcacacaggugagugcagccgcgaucccggcccuugcgggggcggccgccugagaccccucccccgccaggaccccgaaacugcguggcgcguggggggcggggaggggggcgcgcccgggccgccgccgcgccggccggcagggcggggccucgguggguggggcgcgcgcggggggcguggcggccacgcggucgggcggcgagcggauggccgccccggcggcaguggcgggggcuccgggggcccagcgaggucugcgggcgggauugagacuccugggcagaccaccucucucccuuucugggccuuguuccguuuuuuuuuuuuucuuuugcguucuggucugggcggugggcaccgugguuggagcauccggcucugggguucuggguucucccccucccccagccucaguuuccuuaucugugaaaauggaggaggaaccgcgucgccgccgccgggguggccgcgcggauucuccccagaggucggcagagcaccuggcguggggccaggauggggggagcccggcacguuuucucugcguucucuguauuuuaacgagggggagggcgaggcuaggagcgcggguuggggccugagucugggcgggggaacuucauaguauuggaggacccucgaggggcucggguccacacugcuguauuucccuggcguguuuguucaccccuaccuggcgggcgauucgggaaggugcgcguaguuggagcgcuucggcuacaccaacgccccuccuagcgcaguccccggggcggcgaggggaaccgggagccuggugggccuggcuguauuuuuucacuccguccccuccuaggguuccacuuucuggacugggaguuuggacugggcaacaggggacggugggccuugauggccggcccugguuugggcauuagaggugcuugucccuuccggggaggguggggggcugggggaaagcugugcggcugcccuugggcuuggcauucuggccuugccaccaaacagaagaccucuacccgaucugggucucaauuuucucauuucuaucaagagugcgaugcugccucuauuucauagccauagcgguggccgcuuugggcagcuggacacuccaaggaggcuugguccgugggcucggauuguagggacacguggagcagccgaagggaagugggccguccagagugguggggcugagaugagcaggggccgcgaaugccuugcggaagaauugaggguccaucuuugggguauggggagccgcgcugggacgccugaggguggagagcaggagggcgggugggggcggugguguguagccugccggccgcccccucucuguucugcacucuuuucaccccucgcucagucccuguccuggucccaggggccuggaggcucugcccaccuugagacacagacgggaaccgagggcgucaagacaggacuuggguggggucugcguuuucugcgaggagccacacauccucggcggaggggucccaggguguuaccucuuuuugagggcaaugggguccguguaucuccgcggggagggacauugggggucugugaagauggcgaggcagcguugggaacagaaagggaggugccucuccgggcggugggcagggguccaggagugcccuggcuuuuuggggguaaguugggcgaucugaacagacggggcugaagugggagccuguugggaaagcgacucccaccugucuacccaggucauucuuuucuugccagauggcguggccugagagcuccauuuggguuuucugaguuucuggguuaaguggacgggauggccaccucccugaguggcacccaagaggcgcuuccauaggcccccggguauuggggcagcggucccuaagccagcagggaggggagggauggguuuggaguccugggaaggcaguauuguuaucccgggauugcaguaagaaacaggccugggggugcccagucgggcauccccagggguggaugcaguugugcugauggcgcgccaccgucuacccuguguggugggggagggcagggcggaucuccuggcacccucccccaccccuugagccugcugacgucccauuccaaagcccccuuuacaguaacgauuuggggacugggagggcagucccaggcccaggcaccuuggauucgguuuccaaaggguuuuggauacuuguggcuuuccaggcuccucuuccgggccuccccagcccccaggaccaccaaggggucuguguaaacggccucuuuuaguggaagguggucugguuuuucagcccccggaggagggagggaauggcugccguuaagcugguuuugggggacaggaaggccaugcguuuuuuugggagggagccccauugcagggcugucccugaauggaguggaggccgggaaagauccgcagacgaacccgagucaccgguggcugcagggcugucccgggggccauugagaacgaguuccacccccacccaccccugccuggagugcuucucuguaaagggaacaccagucguggccuggccccauuuuuacagauaaaccaacugaggcacacuggaggagccccaccugugauuucggccacauuuggcccugggagcagggaggccaggggagcagugggauguucuucaugggggcagcaggcggcaggacugcaccucccguccccugggucuggcccacagccccuauccuagcccggccagcucucggcucucucuccccugcguggggcggggaaggacuuuggaagcugugggugauguugacgccguugcuaugguuacggagagugagcgagccagcgaguuggggcgggggcgggaggagaggcuggcugucggcucccugcucuccaaacccccugcauccccggagggccccccccccgcccccggcaugccagugcccggcacaccgucagccugcaccuccagaggguuugccgacacccuccccaggagaggggcucagaccuggaaggguucuucucacccagggcuucucuccuccgcacuuaccgagacauuuggggccugaucguuuucuggggaggggcuguccugggcacugcaggggguuaugcaguguccccagccucuacgcacuccauggcaggagcacccccuccccagucgugacaaucacaaauguccccagaccuugucaggugccccccagggggcugcagggucacccccaguuguaucccacucugaaguccccugccgcaggccagcacccagcaucccaguccccgcgccccaggacuuagggaacuguguccgugguggcggggggcggggugggggguggcaacagggaugcuagugaugacggaaagcgcuuccuggaggaggcagccugaggcccacugggcuggguggggcagggaaugggagaggaagggcgugcuggcucuggggucugcuguggagguagggacuugagguggggagggggcaccucggcaaggugaaucccugcacuuaaucccgaggguggggacgcugggggcggcagugaggcaggcugggcuuugcagaggcaaauccauuuauggagaagggauuaggaucagagagggguugaggagggcaggacgagaugugggagggaucgaggcgugcuggucuacgcacuggguuggagggagacuccucaggacgaggugugcagaggagugucugagugccugccagguuucugaucccuugcugaagagggccccaggaggacagguggguggggaaacugaggcccagagggggaagcagccaugccccacuucauucucuccuccacccccaggcagaacuaugcgcuccuguaggguugggauggcagugcuggugggcagagcuugggagaacuggcagcuuaucuggggagggucggaguggggcagugccaggccauagggggugggggguagggggccagggacugcccucccccacccaccgccucuccagccugcagagugcagagagcagcuggaacugccugcaggugccccagcuagugggauggggagggcucccccaggguuguggggggcgauaaccacccccacccaggcucucugauaaaagcagcccagaucgguggggaggaggcacaugauaccagcagggugagcugugggggcggggggcaccacccuggcuuagaccauuucuggaacagagguuacacaggcaccaggguccuugaggggguuguccccugccgacccccagguacccagagucuggugcaggagguccuggccuggguugggccucaggugggccuccuuuuauguagaagggaguagugauaguuuggcggcgggguggggaggacaggaguauucaagaugcugagcaaacauuaucugcccuugcucuuguuggaaccagagcuugauccccuaggccugcauucuccuuuuccacagauaugcauuaagcaccugcuguauaccaggccugugcugggcauugccggggacccagccgucaaugaagugccugccuucugcucccacuggagugcaggggugcagauauuacacccacaagaugcaugcguuuuuggaagccugguacaaagacagagaagcugaccaagggugcuuggggggcaccaggccacugugaggggcacugcugcucagagaagcuccgggcaggaucagccaucaguuuugacccuaggccagggcggaacucaggaaagccaagcgcagucugggugcccaggcgggagcugcuggacuacugcacuaguccaggagugagcugggaggggcaggguggggccuggacggaucccgaaggugaugggauuuggcuggcagguggcacguggggagguacgggauugacacaaggguggguaugccugccugcguguuuggcgggaacagcaggggguuuggaaaggggaagucuacuggaggaguggggaugggggaggaaggaagcuuuggcuuugggaagucaggggagcuaggggcagaguggguguggggguugcuauggcccaguaguauucgagaccccacccccaggcuggcagggccucaccaccaguguucccccuuuucugcagcggcucccagaagcagcugccuauagguucuauagaaccugcucaaggaucaccuucaggagcuccucccuucccuggguggguaagaggccuccccagccccagccuuuccuggcucuccugggaugcuugcuuugcggcuggggcuggucuuccccaccugugcccuccccuacagacccgaccccaccuguuagguggacgugagugccccggcaggcagccggccacagccccccuccccaccccaaggccccccagacaagcucaggaggugaggcuucccugucggaaccagggcccuuggcacagucccgcaguccugucuccaggccccuccugugccggcucagacggggccgggccagguuuccaggacuuccuggacuccauuuuucugagccugccuguuuccgaggcuguccugagcucacccgggcccagccugagucagagggucaaguccaccgcggccccgcccacacugcccucccgcguuguccccacccaccgcauccucagggcgcugcgucucggccagguagcgcggagcagcuggguggcugugcaccugggggcccggcuggcuaggagcagcgcgcucugggcccccacaaguucaccccacccuccucccugcgaguggauugugugcgaggcagggccuggcauuucgcagaggcgcuucgcccagcgcagcguggguggguagcccgugcacccccugccccgccacccacgugcgcaugugcgcgccucagucuccaagcgcggggcggggcuggcaggcacccaggccggagaggcgacccuggcccgggcccccuggccccggcgggagugggaccacgugagcggggccggcuggggcugcggauguccccgccgccgccgccgagcuacgugcggcagcuguguucccagcggcugcgcgccccugccccggucgccccccccaccccggcaaccugcuccuccuugcaaaguggaacugggggagagggaguggagaccagccccgccgcccugaaaggggaagugaaccaacugacuguccggcacccagccgugggauguucccccuucccuccugccgccuccccgccugugccuugcaagauggcgacacggcggcauguucccuggaggggcgcgagccccaaucccguggucugcuccagccgcgcucccacagccagaccccguccccagacugaggcccuugggagcugucagggcccagugguugagaugggaguggggucccuuccagggcugcucugcgccucuugcuuggguuguagacggcccccagcuggggcggacccgcgaccccagcugcauccuggguugcuugggggagacuugggguguggagcaggcagccccagggauuugaggcuacuguuggucuuggugacagcuggucucucccccucuccagcugccuggauucacaaccucuuggggaggggggcugcuggucucugucugcagucuuguuuugcugagggugucgggguguggcagggaggaaggaugagaugagaagggaagguuuuuucuuccagcucuucuugggucacgggugaucgcuggugccccucagugggcagaccccuccacccucccgugccccuccucagcugggcuccccagggcagccccugaucuuagagcagagaugucacucggucacccugagcauggccgugccccucccgccgucucuguaccccucaccauggucccugcuguggguccuucuaggccccuggcuggcugcaguucuucauggaccggugggagugcucccagggccagagcaaccuccagugcugggcgugggcugcccaguuuguaacccaccgggugacuacccuccuggcccugcuguggcuuccuugagaauaggcuuuggggccacucaggggaguugguucugacgucucuuuugcuacucagggcuccaaccagugccacgaggggcaugcacauccggucuccauccacacaacccacccuggggugucacgggaauaacgucccggaaugccaggguccaggguaccuggugcagggcccgaaagggugggagcuucggggaugcagggcccuuuguccugcuucggucccuggguggagguggacugaccugccccuccccagucguuggagaccccuaucugcuggggagacgcugacaucacgaugccacaugcugugggcgugagaccccggcuaaaggaaggggucggguggcacaguucuagagcaaagacccacaccgccuggaggcgcacaggcaggcccagauggugacggcugguuaggggcaggaugggcgaggcccggccuuggcggugggaggggacuguggaggaaguggccgggugguggcccgccccugcccagcgccaucugucccguggggguggggcgaguccagcccgccgggccccgccccuucccgggagaccccgcccccuccccucccugugagcuuuccugccugucuuccaucuaaccacaccccgagaucggggcccagacugacugugccugcggguuccucccaugcccccuugcucguggaggggccaggaggguuagggagguugccaugauuguacccccuuaacccagccuuugcaucccagguggucauuuggaaaaggaggggaucaugcacagauggaggccccugcaugccccuggguggggggcagggacagccugaaggccgagcaugccuucugagcgugccugugccugggacagacacugggaggccuuugcuaaucccugccagggucccgccuggggccagaggcugcgagggccuggggagcuucagccuugggggucugcggcgguuacuuacgguuaacagauucugggcucgccggagaguccuuucuaagagcugguaggaaauaagaggauuauuuauuagggucucguguugggccaccggggggcggguaaggguuguauucuuugugcuucuccauguuuugaacucacaccagagcucagccucuaaaacggcacgggacaaaugcccgccacccuuugggaucugcuggaacgugucugucaucuccccccgcccccgcugacccgcugucugucucugucucuccguccaggggaacgcccuuuugcuugugacuggcagggcugcgacaagaaguucgcccgcuccgacgagcuggcccgccaccaccggacgcacacgggcgagaagcgcuucuccugcccucugugcuccaagcgcuucacccgcagugaccaccuggccaagcacgcccgccgccaccccggcuuccacccggaccugcuccggcgcccuggugcccgcaguaccucccccagcgacucgcugcccugcagccuggccgggagcccugcgcccagccccgcgcccagcccagcccccgcaggccuguagggcccucgugcagcccacccugaccgccaggaugcuucugccauccagggguguagugaggacccacggggagccugggccccuuccagccgugggcaaacccugaagacaccccugccccccuccagagagugaggagggggccugagacuggaccugggucugccugaccucagagguggcucucaggaugggugacgggggcuugugucuguaaauagccaugauacuaacuuucuucccaucugugcaacggggcccccccagggcagcuaggagguccuccccucuccucuccaccacccccugcugccccccucccggggugggguuuggggggguggaguggacuucugggagccggcccggggaaagcacccccugccccaucccugcagauugggaugaaguguucagacagccauagaggagucggggguugacacggccccugccucuccccaccccacccccaccccaccgaaagccaugggaguaguucagggaaaugggggugcagcccagccaccccccauucggguacucaaucucagguguccacaaguucugcccacgguaggggcugccuggccccccagaccucggggguagagccaggaguggggcagcguuaggaugcccggaggggcuccagguguugcuucugagaccugggauggggagggaggggaccucuggguucuuccaaagaacauuugacucaguggggucgggagggaauccuggcuuauuuauuuuccucuguccucgggugugggggcccuagcucgcccucucugggugggugggugagagaggcugcaggggaggcuggcaccgggcuugggccuccagucccugccuugcugacuuuggccguugcgguaucacgugacaaucaacucucccuuaacgacgacugcggcuguugggcugcgcugcccucccuggccugcagguggggccguggagcccaugcccgccgggguugcaggcucuuccgggccugggcugcagccuggcccggcccugcuucccuggccuccccuccuucuccugggugcuuggaagagguggguccuggcccgugguugaggucuugccucguggacuggaagcagagggcuggcugugcagccuccugggguagcucguuuuuuuugcaccggguagaauauuuuuucaggcacggauuccuuuuuuucugggcccccaugggugguccggcauccucagggggugugaguguguguggggggucucugagcugaacuugggugggguggggacuuguuccucgggggccaccuuuguguccuugucagcggucguccugcuguggccuggguugcauuuccucuugggggggguauugaggacccccagccuggaaugagaaggguccccgguuccaugucagacccagaaagguggauccccccacuguuggcugcaggagguuuuugguacccccuuuuguuccagaaccguccugccucucgcuuggggacaggggggcuuuggauggcacuggugugcaccuggacccagccccggccuggcaggauccagggaugggugccugggauccuggggggagggaggcaggggacgcccuucuggagcugggcucggaggguccugccccauccagcccucggcucucuguguucucugucccuagccucaaacccucuucuggcagcgcuagugagaugccuuagucugugggggugggugggggacuggggccccguuuuccuuugugagucuugguuggccccagcccuggcaggggccugucuggagcagggguagguagggcuguggguuccagaacucuauaacugggccccucuccaguguccaggggcuuggagagaccugcgcccaccccuccacucucccaggagucgcugaucacugggaccugguuccagccguuugcaggggaggcggcuccgagaggcgugugcuuuccguggguggcgccccucccccgcccugccuggccucauccuuguauuuaauuaauuaaacaagccccuuuuuaaacccuac

SEQ ID NO: 16323 - RNA, 8550 nt, Homo sapiens
acuuccggggcgguggugagaacgaggcucacuuccguccguggggggagcugcggcgguggcggugcaggaggccgggcaggggugcggagggaccgacggacgcacgggcgggcggccgggagccauggagcgcggcccuggggcccgggggcgcgggccgggguggugagugccgggcaggggcgggggcgggcgcggccgcgcggggucccgggccgggccucgagggccugacagcccgguuggacguccccgagaccccugcagucccagggcuuccgcggguccugcccgaggagcccagagcaggggcgcggaccgcggaugagcgucugugauugggaaagcccuguccccauccauucagcccuccggcguggguugcgcucccacccuccugcggacgcggcccuugccuucggggagcacccguccgagccgcggauuccgcucuuuugccccgaaacugcccccaguccgacaaacgcuucggccucucgccccccaaggcagcucccaggggcccucccgagcccugcuucccaaccagcucccagucgcuguuucccuugucaggcuucuuccugccacccugacuccugggcgggcuucccggccuccgcucgcguccguucuccgggaugcagcccuucuccuauguuguccaucgcuugcucgggacuucuucgcggccccgccauuucucccaggaugaagugcaaacucucgggggcgcgaccucacccgucccaggcucucucuuaggacccuucugcucacuucuuccucccagggucugcucuagccaggagccugcucugucaccucggauuuugcuccugcuugucccucugucccaucccccugucaccuggcccguuugucugcccucugauauggccgcgccuccccccaggcggguuucccacccugacugguugagugaggugcagucaccgucucccauauguaggucaucuuccaguauuuuggcugcucgguugcuugcugguccucagaacaccucuagcuugcagaggguugcccaguuaagugcgugggaacggaauuggugggauucagggugucaagggugugugcccagugagugaggcgucuggguuugcacuccccaguccacgcccauuagugacacuagggagguuccagguaccuguggcuggagaggagaggagacuagacuuucccuucccugucaaagcuggcggaccuuggggauucuuuuccuccugugcuuccuccuuaauucugugcugccuaccaccugcccauuccuuuagugaguggcaggucaugguccugcucucauagaguuucugguuuggagguggggggagaucuggccaaacgugugaaaaauacaagcuguggaaagagcguguaagggguccugucccagcuuugaggacucugagagcguuggcagugaggugcaaagggugguuggguugggcaaggcugucuagugagguuggggaagggaguuccuggcagaggagcagaggcaggaaggggcaauuuggcuugucuugagggagccaggaguggcagggugugagaugagugagucuggagaggucggccugagccggaaugcggaccuggcaggcuguggggagggcuuugaucucuauccagggaauaaugggaggcccccaggacaccccaagagggaagcggcuccauugcauuugugucgugaaagauuguuuggcugcugggggagaauguccuggagcaggugaucagcaaggagggaggcuguugcuguggcucuggugaaaggugauggaggcagggaccgggcgguggcugaugggagacaggcagagccaccgggcuggugauggaccggcucagauccaguggguggaaggaggugucaaggauaacaucuuuguuucuggccuggauaguggggcccuggccaccucggugugccccuucgucuccggggucuccaggggccugcugcuguccacugggcucucaggacccagcugcaugaugccaccuaaacugcagggcccuccaaguccccagcaccagcggggcagcaccgguagggccuggaccucuuugagaauauguugaaaagcugacaucaaccucgacgcuguggauguugggccugaucauucuuuggggugggucuguccugggcacugcagggugcuaagcagccuccacccaguccccaguggugacacccaaaacuguguccagacauugacaggugucuccaggagggagacucgccuccaucugagaagcagaaccagccugacaguccaccucccggcugaaaagugcuugcaugugcgauuugccuuccgccugggagucugggggcacugggaugccauccuugccccacccuggcuuucagagcucucuccucuccuccucgugugcccaugaguccggcucacaggaacgugggucucacaucagguccugagggagcagguguguuucugggccugaggcugcuccuugguagugaggguguccccacgagccgugucuguggcgccugcagcugccugcauguccaucuguguccacaucugccuuugagccucaucuuccuggccccacgguuuucucaugcugugacccaaaagccaagcauuccaggguguucugcugaaauugaguugugagcgugucucucuccucgcuccagucugaaggagaagcguggucgguagauagacgucucagaccuucguguuuucuucacgucugucuguuggcagguccuuacacuauugugguugcuuuagcaacuuagcuguugucgacuuaauguguuucaugacguucugcagcaaggaagaagguccgaguuuccacucucaaucaggcaccuucguuccccuccccccucacuugacuuccugugggguguguggugucugcacuuauagaugagaaugcugaggccucaggagggcaagggacucgcccacggucacggaacccuaagucagggguggagaaggacccccugacgccagcccaccuccccugccccucagcaggccuggcuccagcacagagaagagccauuguugcugcucugggggcccuaggagccugggauguauccugccuuuguuucuagagccuuuguuuguuguauuuccucugucuccagacaucgcaggccggugggacccggcgccugugcacgcucacguagcggggccuguucgggucccucgugggucccuucaguucgagcucuguccuugccucagcggcccgucacccauaggguggcagagaugggccgggggagggagugggcagcagugcggaccgaguccuggcgcaugggguuucccuggugcuggagccgggcguuucgggggugugggcggggcuggggucauauccccugcaugccccgcaugccauggcuguacucacauggcaagagguggugaucgccagcucagggaagguggggguuccuucauccuguggagagggggcugaauugggguccccugagcuguagggugcagugccugacaggccguggggagggccgaggggauggggacugacaggccccgggcccaugccgcccccuggcacggguggaugccccgccucccgggggugcccagcuggacuguggcacccccaaaggaccccacaugucacuguucccccgcagggcuucccacggcacgacauggagaccugugguugcgaggcucccuggggcucggcuuggaccgcgauggggcugggcccuggccuccuaacggggcugcugucuggggcgguagcugggggggcgcucuccccccugcccgcgacucggagcacccccaccccuccccugccgggccaggccgggcggcguuguuggcgggggccccgguggaggcccggccugggcggcgcccgccaugaaugggcugucgcugagugagcucugcugccucuucugcugcccgcccugccccggccgcaucgcugccaagcucgccuuccugccgccggaggccaccuacucccuggugccugagcccgagccggggccugguggggccggggccgcccccuuggggacccugagagccuccucgggcgcacccgggcgcuggaagcugcaccugacggagcgugccgacuuccaguacagccagcgcgagcuggacaccaucgaggucuuccccaccaagagcgcccgcggcaaccgcgucuccugcauguauguucgcugcgugccuggugccaggugagcagcuguggccgcgccugggcugggucacccuguucuuggggcucccguuucugccugcggugcuuggugugguugguggugcccccgagggcccgagccugccgugaagggccauccagccagcaagggugguaucccccgucaggccggccucgucccucuggcaauuuucucucgcagacaaggacaccaggcucagggaggccauccccagcuggcaugggugggcaggcugggcgacuccaacaacccagcgccuggugguugccugcugggcaagagcuggggcacaggggcugcccuggccugcggguacauccaccuucucgccaggugggguucugaccagaucugaguccagagggcgagccuuuaccuucuggcugggcuaggugggggccugggggaacuggaggaagcaguccauggcagggccagccuggccaccugcuccuggcaccaccuggggcagcucccgugcugggaagcagacaggccuugcagcacagccuuggggcuugggcaggguggugggccaggaggggcugcaugagugugagcagagauuggccgcauuugcuuguugggggcaggggugggguccaguugugccccaacagugagggcaccauucugugaggugaggggagauagcccugccagcagcagcaugggcuccccugggaagguccugaaaggugggccugugcgcuccauccccggggguccagguucuuccaggaggaagggcagugaagccugcaguaucugagcacacacugcgagucugcccugagagaggaugcgaccgauggucccagugucccgcuucacagaugggaauccugaggcucccuggcuggccucugcagcccaggcugccugucccccugccagcuguccuguccucuccccauggggaacccucggagauggagcugugcugucguagccuccccucuccauucacuggcuucuggcccccuugggaggggaguaaaugaggcacugggcauggcuggccaccggggugggcugucacuacgcauccuccugcccugcagcugggcgcugggagcgaggaugugaacggcccuucucggccugucccagguacacgguccucuucucgcacggcaaugccguggaccugggccagaugagcagcuucuacauuggccugggcucccgccuccacugcaacaucuucuccuacgacuacuccggcuacggugccagcucgggcaggccuuccgagaggaaccucuaugccgacaucgacgccgccuggcaggcccugcgcaccaggugagggcgacccugggggcagcucagccugggcacacccaagaggggaccaggcggggggccggggggcgggcuucccugggaggaaggugggcggcccugcaggaggggagccacaguggaugcacagggccagagagccggacaggcgagcuugggugugcaggugccgccuccacauggcugagguguggccaggcgguccucccacacccuggccuguggagccagguucccugggaaccccuggccugaggaugggaaggggcugagcuugucacagggguguggaugccacccggcgggagggagugggugguggucugggggucugugcacguguggcugggagcccaucggccgaggcagcacuuggggccaagugaggcgaggcugcugcauccagguccggaggacuggcccaugaggcccuguggcugcggagcuuggccauccuggggcagggccuacaggguaaggugcagacccgcagcacacauccgaggucugggccagccucgauuccagauccagcccuccuagucauccacguccccagcccugcgcuugccugggcccuucaccgguguuugagcaccgcccgggccagugcugcuuuggacgaggagacccgggugggccucugguggcuuuuccugcucaccauccacugggccugucucguccuggcccugcccagcccacuggucugaccugcucccacagggaccaggcacagcucugagaagucagaggcccuagggagguggggucgucguugccuuggugauaugcaggcagucccugcagugggccugggagcugguccccuggcaccacccuggcucugggggccucccagcagugugggacgcugacaccaaucaccacuucaugcgacuuccucggccccuccugucucuacugccugggccacuggcagagucacaccugccauggccagcucugagcucugucugcucggccaucuguccugcugccacuuuguccugcaggaaccuaggcccagagcugugagggggaggccagagcgugcccagggccuccaccggggauguguccuguucguuugaguggugacauccagguggcagcucggggcuccugccuguagcagguggcagggcugggcuggcucagcacacuacugaccauggcugccagggagcaggccagggaggccgaggcagagcuggagccacaggcaccagccaggcagcauccuuuggggcaugggugaguggcgagcuguggagugcugccaggaggcugggauuccaggccagggacggggacagcccugcugguggagaugccaggcagaggggacgcacaccugcccaugcuccugccuugcaagagggcgucugccugggaucagagccuagagcgugugggaggagaguuguggggucccggcaugggcaggguggcaggugggucccgugugcuugggacugggcacgaggaggccuuguaacuggugcuggaucagcugggucaggggccgcacaccaaugaccugggggugagggugccccugggugggagcugguggugcugagguggccgaggacuuguccacucccaagggaaggugcuggugggagggggugccaccuccgcagccaccacccucgaugcugaccuggguugcacuggcaucucauugggcguggggacuccgagaguccaaaauuggguggagacauuuggggacacagcugccugaauuccucauggccaagggggugggcaagggcugcagggaggaauaguguccgcuguccuggccagugcaccaggaacgguuuucuaacccuggcaggaaggugugaagcauucaggaugugggggccacacaguucccagugugcaccuaggggugaccaggaggaggagaggcgccagggccucccuuacccccgccccaggggcacuccguaggcaggaucccugcagauccuagcuaggaaacgccagugaacggcagcgcagggaacggggcggggccgcuggcuucgcccaccgccacgguguugggggcuggggguggcccucgggacugguguggagccugagccugacccacugacuuggcugaguggggagacuggagggucgcauccggagcugggcccggggacgcccgcuggugggaagggugcgcgcgcgucggaggccgcggcugacccugcuccggcgccgccagguacggcaucagcccggacagcaucauccuguacgggcagagcaucggcacggugcccaccguggaccuggccucgcgcuacgagugugccgcgguggugcugcacucgccgcucaccucgggcaugcgcgucgccuuccccgacaccaagaagaccuacugcuucgacgccuucccuaagugagcggcccgggcggggacgggggcggggcggggcccgggccgggcgcgaagucucaccggcuccacgacccucccgcagcaucgagaagguguccaagaucacgucucccgugcucaucauccacggcacggaggacgaggugaucgacuucucgcacgggcuggcgcucuacgagcgcugccccaaggcgguggagccgcuguggguggagggcgccgggcacaacgacaucgagcucuacagccaguaccuggagcgccugcgucgcuucaucucccaggagcugcccagccagcgcgccuagcggcggccccaaccggccggaccucagcaauaaggcggcccccggaccucaccccgcgccggcccccacccaggggcugcauguggaccccccgggcggcccaggggaccccgccccgacccaggggcuguggacgauguacaggcaacagagcuacgcacuccuuuccuuuuggaagcaagaagaaaauacgugaaaacggaaauuaaagauuuaaaauuuuagggcug

SEQ ID NO: 16324 - RNA, 2944 nt, Homo sapiens
ccauuggcgcaugcguagggcgcggccuuggggcggggcccacccaguggcggagucuucugaggggcgggucgugggcggggccuggaggcggagccggcgccgucaguagucggcugaggacggaggcggggcugggccugggauggggcggggccugcgcugguggggcgggcgggggaggagacacggccaagcgcccgagugggggccguugguuggugcgcggcugaaggguguggcgcgagcagcgucguugguuggccggcggcgggccgggacgggcauggcccugcugcugugccuggugugccugacggcggcgcuggcccacggcugucugcacugccacagcaacuucuccaagaaguucuccuucuaccgccaccaugugaacuucaaguccuggugggugggcgacauccccgugucaggggcgcugcucaccgacuggagcgacgacacgaugaaggagcugcaccuggccauccccgccaagaucagugagugccggagcccagcccagucccgacuaccccgccagcgagaccccggggcaggccggucaccuggcuucuccuccugcccgcagcccgggagaagcuggaccaaguggcgacagcaguguaccagaugauggaucagcuguaccaggggaagauguacuuccccgguaaggggcgcgaaaccgaggcggggcccccccaccccgggacaccccgcccaccgccugagccugaccuucuccugccucgacgacucaggguauuuccccaacgagcugcgaaacaucuuccgggagcaggugcaccucauccagaacgccaucaucgaaagugagcaaauaaggcuucagaggagggagguguugcccagagccucggagacccacggggcuuggcugaggcuggagugaugugaacagggcaccuggcaccaggcagcuggggaggagggcagcucuccagggagggacccagccuagcaccugaaggaucaaugccaucaccccgcggggaccuccccuaaguagcccccagaggcgcugggaguguugccaccgcccuccccugaaguuugcuccaucucacgcugggggucaaccuggggaccccuucccuccgggccauggacacacauacaugaaaaccaggugagccugggccccagugccgagggacaggcccugaggcuuuggaggguugggaggaggcaggacuggggacaaggcugggccugguaagauggcgcuguccugcccucccacaggccgcaucgacugucagcaccgcugugguaagcaaggcuccguccaggcugaggggcgugccgguggcagcucggggcccuggaggcugaggggagcccuggcggcucuuguacguguuucaggcaucuuccaguacgagaccaucuccugcaacaacugcacagacucgcacgucgccugcuuuggcuauaacugcgaguagggcucaggcaucacacccacccgugccagggcccuacugucccuggggucccaggcucuccuuggagggggcuccccgccuuccaccuggcugucaucggguagggcggggccguggguucaggggcgcaccacuuccaagccugugucccacagguccucggcgcaguggaagucagcuguccagggccuccugaacuacaugugaguggggucuuuggguggcagcaagcucaccugggccugggagggaacacuggccacggccacucggccuccugaguccaaacccacugucuuuguagaaauaacuggcacaaguaaguccccuccucaaaccaacacaggcaguguguguaugugagcaccucgugggugaguauguguggggcacaggcuggcucccucagcucccacguccuagaggggcucccgaggagguggaaccucaacccagcucugcgcaggaggcggcugcaguccuuuucucccucaaaggucuccgacccucagcuggaggcgggcaucuuuccuaaaggguccccauagggucugguuccaccccaucccaggucuguggucagagccugggaggguucccuacgaugguuaggggugccccauggaggggcugacugccccacauugccuuucagacaggacacgagcaugagguaaggccgcccugaccuggacuucagggggaggggguaaagggagagaggaggggggcuaggggguccucuagaucagugggggcacugcagguggggcucucccuauaccugggacaccugcuggaugucaccucugcaaccacacccauguggugguuucaugaacagaccacgcuccucugccuucuccuggccugggacacacagagccaccccggccuugugagugacccagagaagggaggccucgggagaaggggugcucguaagccaacaccagcgugccgcggccugcacacccugcugacaucccaggcacgagggugucguggauguggccacacauaggaccacacgucccagcugggaggagaggccuggggcccccagggagggaggcagggggugggggacauggagagcugaggcagccucgucuccccgcagccugguaucgccagccuuaaggugucuggagcccccacacuuggccaaccugaccuuggaagaugcugcugagugucucaagcagcacugacagcagcugggccugccccagggcaacgugggggcggagacucagcuggacagccccugccugucacucuggagcugggcugcugcugccucaggacccccucuccgaccccggacagagcugagcuggccagggccaggagggcgggagggagggaaugggggugggcugugcgcagcaucagcgccugggcagguccgcagagcugcgggaugugauuaaagucccugauguuucucuuugcagaagaguucuugu

SEQ ID NO: 16325 - RNA, 3948 nt, Homo sapiens
cgacccuccaggcccgcccagcgcggggccucaggaugcacaaggccggacgcucacgggaggagggaggggagcgacgccgccgccccacccucggcccgcggccugucgcaagcgccucucuccuacguccgcugucccccagggaacccccgguccgcgucggccgccgcccucaaccgccucuacuccucaccagagcccaaggccgcguuaucuccuccucguuucgccaccuccacgacuucguuuggcgaacggcgggcaaagaaagcacuuccggggcaaaugagacgggcccucuggugugcgcaugccuggcccgcccagcggcgugagucagagggucccgaggcgcgaaggaaaaggcuggagggggagaggcugaaagcgcggccuggaaggcaaacugcgcgugcgcacaacgcucucaacgaacccucgguccgcugcggccgcacggggccaacuuucgcgagggagcggcugacacucuccgggcgacguuaucgcucccuccgccugcgccuggccgcucuagaaaggggugccagccaucgcuggggugccuugauucuguuccaccuugguccgguuuauuucaguuuaaugguuauguaacaacgguccgucucuccuaccaaccgguaccccgcccacgccagcagccacgggucgccagcgccacgcagcggaggcgggcggcauggcuggcccaaggugcgcaggcgcacuagcccugggggugcuuccgugucugcgcccugagacauuuuuggcgccggccccagccugagcggggacggcggccgggagggcgcggcccggguucccguuccccgcggagccaugcgguacaacgagaaggagcugcaggcucugucccggcagccggccgagauggcggccgagcugggcaugaggggccccaagaagggcagcggugagcgggacccgggagaccgagacagugccaggggcgggaggccggggccggggucugggcgggggugccggaggccggaguccgggucggggcgccggggacgggaggccgggguccgggcgggggcugccugcgccccugagugcgcgcugugcccgcagugcugaagcggcggcuggugaagcugguggugaauuuccucuucuacuuucggacagacgaggccgagguaggggcgucccgggcgcgcgggcgggucccaggcugggccccucggaggccgggugcucacugccccgucccggcgcccgugucuccuccagcccgucggagcccugcugcuggagcgcugcagagucguccgggaagagcccggcaccuucuccaucagugaguggggcuagggaagccagcggcgcuucccgcagcccggggcacccgcagcgccgcacuuuccccuccccgggcgcccaaggucuccucuguguccccagccuggcgccacccuccucaaacacaagagugcauuguccacgggcagcucaaggucaaguucuccuggcgggcaccacccuucccaccugccgaguccacuuaagcuugggucccucccagacucugcucuuuguucccugugggcccaggcuguacuuacagggcaggugggccagccccacccaaagcguuuccccagcugccaagaguagcaugggucuagcauuguuauauggccccgggcuggaaaucccagguggggguaggaggagugagagggggguguucuccugggucuuaagagauucccuucugcggggaaagauggagucccugcuaguuugcccagaguggcugucaaaauuccacaggccagguggcuuaaauaucagaaacauucucuacaguucuggaggccagaaauccuagaugaagguguggguggggccgaauccuucugaggccgaggggaaucucccaguuccuagugguggccaguauccuccagguuccuuggcuuguggaagcgucaccuuguccuccuugcaucacgucugugcccacauuuccccuucuacacagacgccaagcagaauuuagggcccacccugacaaccccuuuuuacuucacuuuauuauuuuauuugcuuauuuuuugagacagggucuugguaugucgcccaggcuggagugcaguggugcaaucucggcucccuguaacuucccccucucggguucaagugauucuccugccucagccucccgaguagcugguacuacaggcacgcgccaccaugcccagcuaauuuuuguauuuuuaguagagacgggguuucgccauauuggccaggcugcucucgaacuccugaccucaggugauccucccaccucggccucccaaagugcugggauuacggucuugagccaccguacccggcccucuuuauuuuugagacaggaucuuuuguuuccgaggcuggagugcaguggcgugaucacagcucacugcagccucaacccccuuggcucaagcaguccucccacuucugacuccggaguggcugggccuacaaggccccaccaccacaccuggcuaauuuuuguuuuuguagagauggggauuuugccaugucacccaggcuggucucgaacuccugagcucaagcaauccucccaccuuggccucucaaagcgcugggauuauaggcaugagccaccgcaccuggcgacaaccucauuuugacuaguuuauaugcaaagacccuguuuauauacagggccauacucauggguucuggggggucaggacaugaacacaucuuugugggggccagagaagggacaguuuaugggcaauggcaagaggaagcugcuuguggcuguggguaggaccgaccacagguguuccauccccaggcuucauugaggacccugagaggaaguaucacuuugagugcagcagcgaggagcagugucaggaguggauggaggcucugcgucgggccagguggggccaggcgguggugggcacugcuggggugggcacagcagccaugcagagcgggcauuugaccccgugccacccuuuuccccagcuacgaguucaugcggagaagccucaucuucuacaggaacgaaauccggaaggugacgggcaaggugugugcagggcugcagagggccgggguggggcugcagguggcagaggcaguccuccagcccuggcucauggccacccguccuccccacaggacccccuggaacaguucggcauauccgaggaggccagguuccagcugaguggcuugcaggcgugagcgcagggcacgguggucagcgugcagcgggacgggacuggcccugcccagccaugaaucgcuuggccaugccuggaucuguuuuguuuugguuuuugguuuuugggucaggguuucacuguguugcccaggcuagagugcaguggugccacagcucacugugaccuugaccuucuggacucaagugauccuccugccucagcuucccaaguagcggggaucacaggcaugagccgccacacccggccaucacaccuggauuuucagugggagguuuuugguuuggagacauccaaagccugaagccaggugggugugggcaggggcugcauuuuaugaaacugcccagcaagcugcgcucccuggggccccaggauccaccuaacuggccuggcaccuggugccacgugcugcugccgccaggauaugcgccuucccacaggugcccugccugaguugugugcauccaggggccuggugagcccccaggcugguggcauggccccccugccccgugcugaaugaauguacagagccagacaaagcugugaauggccuaggggcugagucccacaccagcugugaauucuccugcagacaggagggcccuggcugugcaccuggggaagugguugcccuggggccagggugcuuguucuguucaaauaaagguaccucuuuuccacacug

SEQ ID NO: 16326 - RNA, 2627 nt, Homo sapiens
gaugcgggaccugccucucaccagccuggcccuagugcugucugcccugggggcucugcuggggacugaggcccucagagcagaggagccagcugugggcaccaguggccucaucuuccgagaagacuuggacuggccuccaggcagcccacaagagccucugugccugguggcacugggcggggacagcaauggcagcagcuccccccugcggguggugggggcucuaagcgccuaugagcaggccuuccugggggccgugcagagggcccgcuggggcccccgagaccuggccaccuucggggucugcaacaccggugacaggcaggcugccuugcccucucuacggcggcugggggccuggcugcgggacccuggggggcagcgccuggugguccuacaccuggaggaagguauguggggcccagccccaagcuuggcaccgccgucuuccuucaggugggccggguccuccuagggaagaucaggggcuggcagagcccccacccugggcagggaggcuguggucuuguuccuaggacuggguugcggguccguggccuggaaggugggcaccacacucuguccuguccccgaagcccagcucuuagacuugccccugccucggugccagggagagagcugcugccuucuccccaccccugaagacgacgcagggcucggggccaguggaacccuucuucccacagccccagccuguucucagggccgcuggccuaagauacucccugcggggaaggggcuucaucgggcaccccaacccagagaccccagggcggcagccccacccacagccucagacgcagccccugccugccccugccgucaccgcucccuggcugcaggaaggcagcuaagaggggcacccuugucccccgcuugagguccccugcacaguggccagagcggcagggacagaucccaaagauucccgggggguguggccuucaauggcucaggcguccccugcugucccggcugcagugaccugggagccaacacccucgcugagguuccaggagcccccgccuggaggagcuggccccccagagcuggcgcugcuggugcuguacccugggccuggcccugaggucacugugacgagggcugggcugccgggugcccagguaccagggaguugcauggggcagugcccgggccguggcggggggcauggauuuguugcagggucugcaguacugagaacagcguagaaccaguggcgaugggaggaaggggaccgguagagcggggcuggguaagccuccauccagccgggcugagcccuggucuccgcagagccucugccccucccgagacacccgcuaccugguguuagcgguggaccgcccugcgggggccuggcgcggcuccgggcuggccuugacccugcagccccgcggagaggguagguccgcguggagagggacggggagccgggucgacugcccccgggcccccagccccugagccagccgcgugcccacccaccgcagacucccggcugaguaccgcccggcugcaggcacugcuguucggcgacgaccaccgcugcuucacacggaugaccccggcccugcuccugcugccgcgguccgagcccgcgccgcugccugcgcacggccagcuggacaccgugcccuucccgccgcccaggugcgcgcaggcaccgggacacggggcaggagcgggcgggggcggcguggccucguggccgcucucaacuccuccaauugcggguuccaggccauccgcggaacucgaggagucgccacccagcgcagaccccuuccuggagacgcucacgcgccuggugcgggcgcugcggguccccccggcccgggccuccgcgccgcgccuggcccuggauccggacgcgcuggccggcuucccgcagggccuagucaaccugucggaccccgcggcgcuggagcgccuacucgacggcgaggagccgcugcugcugcugcugaggcccacugcggccaccaccggggauccugcgccccugcacgaccccacgucggcgccgugggccacggcccuggcgcgccgcguggcugcugaacugcaagcggcggcugccgagcugcgaagccucccgggucugccuccggccacagccccgcugcuggcgcgccugcucgcgcucugcccagguggccccggcggccucggcgauccccugcgagcgcugcugcuccugaaggcgcugcagggccugcgcguggaguggcgcgggcgggauccgcgcgggccgggucgggcacagcgcagcgcgggggccaccgccgccgacgggccgugcgcgcugcgcgagcucagcguagaccuccgcgccgagcgcuccguacucauccccgagaccuaccaggccaacaauugccagggcgugugcggcuggccucaguccgaccgcaacccgcgcuacggcaaccacguggugcugcugcugaagaugcagguccguggggccgcccuggcgcgcccacccugcugcgugcccaccgccuacgcgggcaagcugcucaucagccugucggaggagcgcaucagcgcgcaccacgugcccaacaugguggccaccgaguguggcugccggugac

SEQ ID NO: 16327 - RNA, 4003 nt, Homo sapiens
caggugcaucggguguaaucacuuuauuggcuuuuggagagcaauggaggggauuaauaccucaucuuuccaaguuaaaagacuaagacuguuuccaaaagacuccaaauaagaaacuucuccucaaaguacaaggauaaucugaaucaucuuaaaccagcaauaaaaaaguaaaauauaaauuuuuauuuagaauuaaagcaaauacuucaguaucacaaacacaauauuaaacuucaagaaauacaccgcuaauucggagugagcguuuauuugcacgauuacaacaugcggacaaacccaggcgagaugagcgagucuacgguuccuacccacccggcugacaagggguggccccaggggccggaugcccagccccgaggcggcccuacuccuccuccucucccgaagacucucucucgaacguguaggccaugaagcaagcgucgggucucuuggggacaaggggaugccccggucucacaaucucaaagcccaaaaagcugaagguucggagcaaggcggcugcgggggagaagccgucagaaccccugccgaccagaaccccccgcccgcaccccccacccccgcagggagaccgugccugcgggcugagaaugaaggggcggcgcaggcacccccacgcacccuacugcaggcgauacgggucaccuaccucuguccucgcgguucuuguggaagcaaaugaagacauggucggcucgcagcugcuccucagcgaacuccaggagaacugcaaagcugcagcgagugucagcgucucggcuggcccgacccaccugccuaccuccugggccuuagcagcuacccugaggcccgcucuacuccagggucccccuggggcccagaucguccucuggguggggccguccugacaccacaguguugagcagcaccgcugcacccacccacgugcaugccccaugacagaaaagcucugacacugccuggcaucccuuggaggguagaaucccaggguacgaauuuggagugcacuuuuuaaaaagggaccccaggccgggagcgguagcucacgccuguaaucccagcacuuugggaggccgaggugggcggaucacgaggucaggaguucaagaccagccuggccaacauagcgaaaccucgucucuacuaaaaacacaaaaauuagcugggcaucgguggcgggcgccuguaagcccagcuacucgggaggcugaggcaggagaaucgcuugaacccggaaggcagagguugcagugagccaagaucaugccacugcacuccagccugggcaacaaaagcaagacuccaucucaaaaaaaaaaaaaaggggggacccuguccccaccaacaaagcgaugguggcccccauaugugcugccugaaggcagugcccucccucaucugucccugcaccccuugggcagcaacccgcaccuggucccugcuccccugggugagcacuccccgccuguccuugccccucaccuggucccugcuccccugggugagcacucccugccuguccuugccccucaccuguccuugcuccccucgggcagcgcgccgcccgggaucucgauguagaggcugccgccacucagcacuguucgccaguuaaugcguuuggcgucugugagccuggacuggacguugagaauccucgucuugucguuggacguuaguuccucuguuacauucagccgaucauccuguccagggggugcagcccaauucagaacccugacucaccccacaggacuccaagaacccggcagcgcuaaagcuugggccuaggccguguugagcucaggcaacgccugggcugcaggagacugugcgccggcucugaugaaacucaggguucccacgauuacauucaaucacagguacgggcagcaaggugcacaagaaaguaccuguggccccagagcagccccagcaggcccggccccauacucacggaguagaauaaguuagcugaaagauugugaucccucugacuauucccucgcccaccugggaucuucaggggugggugaggggcaucaggagcaccaccgaggccccggacccggguuacuacagcaguggagggagacccuggaacugaagaugaugcaggucacgaggcagcgccaggcuccgggcggagaccccuccagggcguccgggcggccuucagcacauccccaccccugccucggccaaaagaccccgccccgcccaggcaggggcccacccggucccacacccccgaggcuucccgaaggcagcuccaacgccugccccaagcaccuacaagggcagcagucacugagccccgacuccucgggcggcgccgcccaggacagcccaaccuucccagggcggggggccccuuccccucacgcagccccgccggggcagagccucaccccccggccaccaagacagccagcgcuuccccuuuucaguucugucgcggcuuccccuuuccacccugcacuacggccaaaaucugggacucuugcuuguccccgcgaagaccgggcgggccuagccugaccucauggaggacgcgccccgcuccggcucccggccgcccgcccccccgcccccgcuccaggcccgggcccucccgguugcgucauccaggcagacgcggccucgcgccccgggggagauuuucacaaucgcgcagccggcagcgccagcagccauuugcugcgcaggguaaacaggccccaaaguugccuccauuuugcacggcccccaaaccgcggcaccgccagcaccgcggcccaaccucccgauccggggcugagcgacgcccaccucgggggacgcagucgggaaagcucgaccgagaccccgcgggcucccccacaaccgcagcuggcacccgcgcccccggaagcgggacgcgucuucccgggaagcggcgggggucuucccagggcgcugccgggcugucggagugcgccacccccagcuccccggcggcccccgcggagaagcccugggugccgucuacgugcgcggccucgcccggcgcgucccgggccauccagaccgacucgcucaggggcgaaaaacggggcccacgagguccgucgcgugcaggggccacaucgaggcaacagggacccgcgggagcucguccaccgcaaagcgcuccccgcucccgcagcgcacgcucgacggccgggaccgaaaagugcagauucaccagccccgcgggcccugccuguccgcggaccagccccccaaggccgaccccgcccccaaccagauugccccaucgugcgccucccaaauccgacccgaccgcacacccuuccuccaaaccgaauucccagucugcgccccgcaaauccaacccucgaccagaagccucuccccuccuccgaagccgagucccaucccgcgaaccccgcaaaagacacacgccucccccgacuccccguccugcgcccaaauccgaccuccgacccaugccccucccgcaaaucaggcgccccggacggugccccccaaauccaacuccgcacccuugccccccaaacccgacucccccgagagcacugcuaaggccgggggggaccuccaggcccgcccugcgccuaccucguccccggcgcgauucuggccuugacaaaggggcggaucucgcgcgccggggaccuaucuggcgccccgaggacggccccccgcaggccugcgcggccggcgcuucuggaagcuucggacgggggcggggcacuuaccucucacugcugcugccgccgcggcugugcaggcuuaggagcggcauggugcggcuggcguggaugguggcgcuggguuuauccccuuccuucucucuggcgaagcaguggcuauugaggauccgcugcagggaggauuucaccauccggccgcugggguccgaaaccaggaaaaccuccgcugcgucucuccgcgccgccgccgcugcucgccguucgcaaaauggcgccucugccgccgcccgccuuua

SEQ ID NO: 16328 - RNA, 2135 nt, Homo sapiens
agaggcuuuagaaauuuauuacaaggcccucauaguagaaauaaaaauauagauaucuaugcuucccaucucgcucucagugguucgaauaacaagugcaaguaacaaaauagauugucucuauaauucgcaaacugggaguucauggguacagagcaacuucagccccagcucccaagucccaaaguguggucuugucgagggugcagacaaggaccaaccaaguucaaccaagucucucguaugcagacgccagcuccagucucaaggaggguggggcuugcagucagucucacuccacccccgaguggacagucuggacccuccgugauggggaaggcggcagcgugccccgccacuccggcuucugcuccaucccaaggccucagcuucggggguccugucuccugcuggccuggguccccccuucuccaucggaucggcggccgccagcuccuggaucuccgcccugggggcggccgcucacuccccuucuccuccuccucuuccucuucagucuccaacgacucugcccccgaugguccucguggguuggguuguuuuggggggguugugcugggggggaggggguucaaauauuuauuguauuuuuuguuuguggcagcaacucaacagauucugcugcugggaagggccucagcguuccugaagagagauguaggggacccacugguuguugccccggcuuucuucgcaguagcuggccaccuccaccaagccguggcucuuccaggcguccgugugaggguucuguaggagggaaaagaagggguuuaguggagccucccucucccggggccccuguguggggaaaacagucaggcucaaaauagcuuccugggugaggaggccccagcccggcugcccacgggacaugccaaacguggcugagcgcugagcugugcaggaccagucagcccgacuuuguugacaaacaccggcccaggugcccgggcguggcggggcagggcagaggcccgacucaccgugaccaggagacaaugcaggucucgggccucgguggugcccugggucucggccggcucucccaggagcugcgccaggcgcugcaugcccgacacccgcacgauguugaugucguugucacagcagaaggacuggaugagcgugaaguggauuugcagggcgaugucauccuccuccuccucgucaauggccaagaggcagaggaccacgcugucugggucccugagggggccaaaggguagggaugggucagccggggacaggggaggggccaccgugcagggggaguuugcaaaaaaggagcgugcaagagcaaaagagaaacugcaagggugcaggggauugccucugcaagcuggugacgguggggggaggggagggcacacgguucaaaguaugggguagggggagacaggcccacggcgggagggguguuugcagacgauacaucaggauacggcagcccccgauccacaaaacggcagagaagcucugcauccacagcggggggcacuuggggaagucccagcuccaugcaagacaagcgugcggaaagcguccagagcggaggggaggucccgucccacccgcgcccagcccgggaagggggucugacucacacauucaucaacuuggccgacucguacacccccacugugaggcgauccuggcgcugagcggccaccaaaagcuccuccaccgcggcggucaccgucugcauccugagaccaggaaagagggaucagugacgggcggaccaccgggugcuacguuccgcucccggcccggcccaacccgacccaucccgucccggcugaccucaggcggcggcagccccggcuacuuacuucugcgccgcguugucgcacgccacgagcucuuccagcgucauguugcaauuauaauccacaguggaugcggcuccacggcaguccccagggagaaauugcaaaauccgagccagagagcccaaaaccuucccacagagcuagagcgcucguccaagaccuucgggaagcagcgaaauccuuccagaaaaggcggaaaaauauauugcaaaguccuuggcgaggauaauccaggaaguugcggaaaccaacgguaguccgacgcuucggcgaucugag

SEQ ID NO: 16329 - RNA, 12314 nt, Homo sapiens
ccucucuaagccccauauaaucagggccaagggaguaggaauccacuuccugggaggccuaggaaggcuucuugaagggcaggauauugcagcuggggcuuugagggaugcauaggaguuuguuaacaaggcccuacccaugaaugcccagaugugcuuaucucugcccacacccacugugccuagcacagccagccucaguuuauggugagaaagcucacacccuucccacccacagcaucuauucuauuuccugauccccagaaccuaugaacgggaagcccugaagaaaaaguuuaugcgaguacaugaugcggaguccuccgaugaagacggcuaugacugggguccggccacugaccugugaccucucgaaggcugccagcugguccguccuccuucucccucccuggggcugggacucaguuucccauacagaacccacaaccuuaccucccuccgccuggucuuuaauaaacagaguauuuucacagcaccggcuucuaguggcuuccaggaaggacaagguccucggucccguagacccugauccgagacuuugccaaaugcauaagcuuuuacuguuuuuauauuaggaaaucauacaggaccaagaaccgcugggguccuggccagccagggcaggcccaggauggggcuccggggccauggaggcgaaggcacaguggcaggcaagggaugagguggucacagguacacgggcugcuccuggccuguaaggaggcgauauguggcagcuggcaucgucuugauaugcaccuggggaguggaggcggaacggggcucagggcaggccugggcucgugggggacgugggggcgccccuggccaccacccaccacccgcacaccucgccauaggccucggugagcagcucgaugaugcgggcguguggcguggccaccacacucugcccauugaucucaaugaugcgguggccgacgcggaugcccccacgcucggcgaugccaccacggaggaggcugcagaucugggggagaaaagagggggacgggaaagaggugggggcugcucaggggccgugcucagggccgcccuacccccccaccccggggccaggggccggggccucacgaugccguccuccacgcagaagcccagcugcucgcgggcguggggccgguggaugauggcgguggugacgggagggcaguggacgaugcugagugucaccgacgucugcgacuucgucuccuguggggcgggggccguuggccucacucagcugccggacagccuggcagguuguagcccccucugggccucaguuuacccucucauaaaccagagaccuggaguccaggggcucaauucuggaagacccccucagaugugauagagaacagacucgggcccggugggcauggggucgaagcugucugacccgagccauaucgcuuccuuauggccaaaagccaagccgacagccgggcucuccaggcaggcugcaaacaucuguaagaggcugcacggacuguggccucauuccucugacgggggcaggucccucccuaucucugggccucaguuuccccaucugagcaacaaagguugagacucaaaaacauggccaggugcaguggcucacaccuguaaucccagcacugugggaggccgaggcagguggaucacuugaggccaggagcucaagaccagccuggccaaccaacauagugagacuccaucucuacaaaaaauaaaacaauaaacugggcgugguggugcacaccuguggucccagcuacucgggaggcugaggaaggagauuugcuugagcccagaaggucaaggcugcaaugagccaggugcaccgcugcacuccagccugggcaagagugagaccuugucucaaacaaacaaacccccccagaaauuagcuguuucuuguuagagagagagaguggcccagcccuggagcugggccacccgcauuuccauccuggcucugguacuagggaggugcccuggacaaguggccucccuucuccaggccucaguuuccccaagggcacaccagugggcaggacuuaaaaguucgacuuugucccuccuggcugggcuggagagaccuggccagggaggagaccucucugggacucagcuccccuuccugggagugugggggcccugccacaccaggaaacucacgcggacagcggccuggcacgcagccaggggcagccccaccaggcuggucccguugauggcggucaggcgguccccgaugcugagggcccccgagcgcucagcaggccccccgugcagcagguuggcgaugacggcugugggcagcagggagccccagcccgacuccaccagggccacgcccaggcccuccccucgccgcuucucgaggugcaccugggacacacagggggcgcggaggcugcucagcagggcccggugcaggugcacggguguggggggcaccaggugggggcugcccagcaccucacucaccucccggcaguugucacuguuggagaagugguccagguccccauuauggagguggcaggcgccugggcucgggugcacgcccaccuggcuggggucaauaccgcuuucccguaggaacuggcuguaggcggcggcgaaggccuggccaauggccugggcgaugagcugggccugcggggaggaguggcgcgucccuggggugucccacccaccuccuccagguccccaaaguccccaggguccucagagcugagcccuccuguccccaccuggggugagagucccaggacacagccuucugcccuggggcuuugggggagguggagagacagccgcaucuuggggaaucuacggggagaaggaaggggaggggcagcccugggcuggggggacgaugagggaggcagcucccugcgcaugggcugugggaaaagcuaucaaagacccagccagggggccuggggccucauggguggcagggacagcccaggagcgggcaagguuucggggagucggccgagagucuuggagucuuauaggaggcuggacgcgguggcucacgccuguaauugcagcacuuugggaggcugagguggguggaucgcuugagcccaggaguuugagaccguguucaccugggcaacagagcgagaccgugucucuauaaaaaauacaaaaauuagccaggcauggugauaccccgguggucccagcuacuagagaggcugaagugggaggaucgcuugagccuggaagguugaggcugcagugaacuaugauugcgccacugcacuccagccugggugacagaaggagaccuugucccaaaaaaagaauuuaaaaauaagcuuaugggagggagguuaaaugcacggcccacugagggaggcgacaguugcagugaggagggccucaggaggguggccccgcgcccuggcugcucacguccuccgcguagaauacguggcagagcaucuuguagaggcggcggccgugguccuggggugccggccuccgugccagccgccgccgcgccaucagcaccagcacgcagccgaugucggcuguguaggagaugguaugcagggcgugguccaucauggccuccuggggcgggagaggcagccuggguggguuggggggccgugccaggcucgaucaccccacccgcaucccuggggcgggucccugccccguaccugggaguccgcugucaagaccuugauccucuugguggagacgaacagguccaccuccgucaugggcugggucuccccaucgggggccuguggguggcggcgugggagguggaggcccccacagacccagccugcagcccacccgccugcccgcccggccccggccgcccccucaccuugacgcgguccauggccucccgggccugggccaugcgcgugcuggugggcggguuccguuccgacaccagcuggguggaccccagguaccuggccccaaauaugacaccguccaggaggucuucauggucacagggaccaggcacugagggcgacagcgaagagggucggcccccaggggcccacucccacaggcucugccccagggcuacgcucuccgagauggccgggagacacaguguucuagcugguggcuuagcacucuccagccaggaagcacagcccacuguucuagaaccauccaagcagccuggcccucacaggucuagaaccuucuguccaucccucaaggacucgcaggugggaaaccagugaguccaggccauggcuggauucaaagccagaucuagcacccacagauaccuucaccccguguccccagaauuccaugaucaggccggaaccagacagucccacuccugcuuuuuugagacacggucucgcucugucgcccaggcuggagcucgguggugugaucucagcucacugcaaccuccgcuuccuggguucaaacgauucuccugccucagucucaugaguagcugggauuacaggcgcccaccaccacgccuggcuaguuuuuguauuuuuaguagagacgggguuucgccacguuggccaggcuggucucaaacucccgaccucaagugauccacccgccuuggccuccuaaaguacugggaugacaggcgugagccacgacgcuccaccccccacuccaauuucgaaaccuccacaacauucuagaaccacaguggaccccugcuucuugguucuggaauucccuccaucaaucuagaacuggccagcucugcccacuguucuagaaccgucugcagucagcccaggauagcaggcagcucuguucccggguuguagaaccacucagaacagagacagacccugcugccugucuaaaauucccauacucuccagaaccccagcugguucugacccuugauuccagaacucucugacaggucucauagcaauucugucaggaguuuuagaaucuuauuaucacucuagaaucagacuucucugcuccgugauuccagaacaucuuaaucacaaucgcgucaggcagcucuuccugugguucuagaaucuccuucaguaguucacaccuuuggcuacaccagggauucuaagaauuaccugaccagucaaggaacaaacaauucuguuccaggagaauucuagacaguuccagaauacucccaacccagcccagaacuacauaaagcuuuacuccuggcugggugcgguggcucacgucuguaaccccagcacuuuaggaggccgggggggggggguggaucaccugaggucaggaguucgagaccugccuggccaacauggcgaaaccccgucucuacuaaaaauacaaaauuagcugggcgugguggcgcgugccuauaaucccagcuacuugaaagcugaggcgggagaaucacuugaacccaggagguggagguugcagugagccgagagagaucgcaccacugcacaccagccugggugacagagcaagauuccaucuccaaaaacaaaaaggaaaaaaaaaaaaaagcuuuacucucaugguucuagaauucccugagcuacccagagccagacagcucugccaguggcccuagaacauucuaaccaguaacuacggcucuuugguuuagaaccacggguguagggccccguucuggacaccacuaagugaaauucacccuacaccacagucgguucugcccacuauccuucaggaucuaagcauucuggaacaagagcuccacucugggguucuagagagauacgucauucacugugguagccaccaggcacauguaucuaucacagacuugaaauguggcucgacugaauagagauguaaauagaaaauacacacuagauauugaagauuugguaugaaaaaaaguaauuuaaggucaggcauggugguucacgccuguaaucccagcacuuugggaggcagaggcgggcggaucaccugaggucaggaguuugagaccagccuggccaacauggugaaaccccgucucuacuaaaaauaccaaaauuagcugggcaugguggcaggcgccuguaaucccagcuacucgggaggcuaaggaaggagaaucacuugaacccaggaggcagagguugcagugagccaagauugcgccauugcacuccagccugggcaacaaggugagacugugucucaaaaaaauaaaaaaguaaauuaaaaauauugauuguauguugaaauaauauuuuaaauauguuagcuuaauuaaaauguuauuaaaguuaauuucuuagccagguaugguggcguaugccuauaguuccaguuacucaggaggcugaggcgagagaaucgcuugaagcugggaggcggagguugcggugagcugagaucgugccacugcacugcagccugggcgacagagcgagacuccgucucaguuuaaaaaaaaaaaaaguuauuucaccuguuuuuaauuuuuuaacguggauaacuacaaaauuuuaaaucacauauggcucacguuguauuucuauuguaguuccaucuagaacuuucugauuacacuauaauuggacagcucugcccaggguuauagaacacuagauaacuauucccuccaugguucuagaauucuccagucugaguagaaccagaugccucuguucaccaauucugagcauucucaucagcccagauuccuuuacccuagaaacagacaaaaugccaagcccuggaacucccuaggugucacagcucugcucgauucuagaaccuucuuagagcuauagguucaaaccaguuuuucucucugcaaccacagaacuguuuuuuuuuuucuuuuuuuugagacauggucucacugucacccaggcuggagugcaguggcacaaucuuagcucacugcagccucaagugauccucccaccucagccucccaaguagcugggauuauagacccaugccacgugccuggcuaauuuuggggggggauuuuauuuuuguggagacaggguuuugcuguguggcccaggcuggucucgaacuccugggcucaagcgauccucccacaucagccuuucaaaguguugggauuacagaugugagccacccuucccggccagaacuuacuaucugaccuauauccuuagcgaaguguagaacagaggcuggccgcgguggcucacaccuguaaucccagcauuuugggaggccgaggcggguggaucacaaggucaggaguuugagaccagccugaccaagacggugaaacgccgucucuacuaaaaauauaaaaauuagcugggcacgguggcggacgcuuguaaucucagcuacucaggaggcugaagcaggagaaucacuugaauccgggcggcagagguugaagugagcugagauugcaccacugaaaaaaaaagucuagaacauuccagagggccagaaauuguucuucccaugcuuuuagggcagggcuuggcaaacauuuucuguaaagggccaaagaguaaauauuuucagccuuguaggucacaagguaucugcugcagcuacucaccucugccauucgaacaucagagcagccauggacaacacaugaauaaccaagcaugauguguaccaauaaaacuuuauuuauguacacugaaauuuguuuuucuuuuuuuagagacagagucucacucuauugcccaggcuggagugcaauggcgugaucucagcucaccgcaaccuccgccucccggguucaugugauucuccugccucagccuccugaguagcugggauuacaggcgugcacuaccaugcccggcuaauuuuuguauguuuaguagagacgggguuucaccaauguuggccaggcuggucucgaacuccugaccuagugaucugcccaccuuggccucccaaagugcugggauuauaggcgugagccaccgcgcccagcuuaugcacacugaaauuugaauugcauuuuuuuauuuuugagacagagucucgcucuguugccuaggcuguagugcaguggcguggggugaucucagcucaccgcagucucgaccuccugggcucaagaacuucucccgccucaaccuccugaguagcugggacuacaggcaugcaccgccacaccuggcuaacuuuaaacauuuuuuguagagauggggucuugcuacguugcccaggcuggucuccaacucccggcucaagcgauccuccugccucagccucccaaagagcugggauuacacgugugagccaccauauccagccuagcauaucauuuucacaugucaagaaauaguauucuuuggccaggcgugguggcucacgcuuguaauccuagcacuuuaggaggccaaggcgggcggaucacaaggucaggaguucaacaccagccuggccaacacagugaaaccccaucucuacuaaaaauacaaaaauuagcugggcgugguggcgagcaccuguaaucccagcuacuugggaggcugaggcaggagaaucacuugaacccgggaggcggaaguugcagugagccgggaucacgccacugcacuccaagccugggugacagacucugucucaaaaagaaagaaagaaauaguauucuucuuucaaugaaaaaaaaagucaauuaaaaaugcaaaggacacccgggcaugguggcucacgccuguaaucucaguacucugggaggcugaggcaggcagaucgcuugagcucaggaguuugaaaccagcuugggcaacauggugaaaccccaucucuacccaaauaaauacgaaauaaaauuagcugggcgugguggcacgcaccuguagucucagcuauuugggaaacugaggugggaggaucgcuugaaccugggagauggagguugcagugagcugagaucaagccacugcacuccagccuggauaacagaagucaucaaaaaaaguaaagaagccccaaacgcaaaaaccaucuuuaacucgagaccuacgugagcaggcagugaguugggucuggcccgacgacgaugauuugccaagcccgguucuagaacccagugcugccaauggccggagcugccccacaguccccuucucacucuaccccguucucaaggcuggcucuccucucccuggccagccggaaucugcucgaaaccacccucagaggcucccgagaaccucguccuuacuggcaagcuguugccaggcuggugagccugauucuggcugucuaggggccuucagugccugaggcuagggugggcgggacacucacccuccuggggggcaggguaggaagccagggucucggggcucuggaagaagauagaggaggggcaggacugagucucccugcuugguuccaggcaguccaggaugccuggagggcggggcgggcacuaccugggcaccagcggguggcucuucaggugugacuagaggcaccgucuccagccaggguuccggggaacugcuugagcuccugcugcccuccugcucagcagaggcccccuccacccauucuggggagucagaauccucaucuggguccucagggggcugcaacagucggggggcaggcucuagaggcucuucaggaccagucugggaaggcgggcauuccucgcagugcaagaggcccagcaggucaucccggccagcuucggcagacaggagcccgugggcaucagcaaucuccugggaggccaggccauggccuguggcaauguguaggggacagggggcuccaccuggggaugggcccaccagaucgccuggcagagcuucaaacugcugcaccagcuccugaaggcuugacucaucaaguuccauccgacugaggcugccggggccuccuggcauagggucccacuggcugucaggggugagguccuccgaaggcacaagaaugucccugggccccuccaaguccauggcuggaggccccgaaggggaucgggaaauuguggggaaguccaugccuggacuccaggcuuaggccggcaucuucaggcagcugaaagagagagagucagcacugagguuucgcccgggugcaguggcucaugccuguaaucccagaauuuugggaggcccagaagggcugacugaacccaggaguucaagaucagccugggcaacagagcaagacccucucucuacaaaaaauacaaaaaauuaaggccgggcacaguggcucacgccuguaauucccagcacuuugugaggccgaggcgggcagaucauggggucaggaguuugagaccagccugacuaacauggugaaauuccgucucuacuaaaaauacaaaaaauuagccaggugugguggcaggcaccuguaaucccagcuacgcaagaggcugaggcaggagaaucgccugaacccgggaggcggagguugcagugagcugagaucgcgccauugcacuccaaggugggcgacagacgagacuaucuccaaaaaaaaaaaaaaaaacuagcuagggguggugguguaggcuguagucccagcuacuugggaggcugaggugggaggaucaccugaaccaggggaggcagaggcugcagugagccuugauugugccacugcacuccagccugggugacagagugaggcccugucuuaaaaaaaacaaacaaacccgaaaaacaaaaaacuugagguuucccggcugccuauccggugcuaggcucuagcuggguacuguucauacagggcacauaauuuaauacccacuaacccuugcaaggaaguuaggauucccauuuuacagaugaagaaacugagccacagaauggggaggugugaggcaguggcuucccgagccccugugucaucccagaccucucucaacuaauggagucuguucacuccagcccugguucuuccagguccuccucccucaagacgcggaacccaggcuggagacccagaccucacacccugacucuaccgacuggucagaggcaguuccccaagaccccagacccaagaccccagucccaugaccucaacccccaauaccuccauccagaacuuuagacccaggacccuggacuuaauaccagagacccaagacgccauaaggcggaccccagucuccaaaccuccaaugcuaccccaagaucgacuccagacucagaccccgacuucaggacccagccccaagcccagacccuaguccccccucagaccgaagaccucaagcgccgacucagacugcgcucugcaccucgaggacacucacuucccaaaucgaggccgccucagccccgcgcagccuccaggaccccgcuccccacggacggccccgacguagcccgggccgcguccccagaaggcgcagcucggggauucccggucccggcgcccgcuccucuauccgcgcagagcccuggcccauugagcaugcgcggccucgcgaggccugcugggaaauguaguucucccacccagccucgccacgcgggggcgcugggacaacugcagauguuggaggggaguucgaaucccaggcuucccggcccgcagacugccccggcuggccccaggaccuguuuguucuccugcaaaauaggguuaauaaucacugccuggcucugggggcuguguucauuauuccaaaggauggcagauggggagaagugggguugggaaauauuaaagaagugugagaggugguuuccuugggaccuugaggcaccggaagcgucguggagacccuguuaaagacggacuuucgguuuggcucacaguagggagacacauaggugcaccauggauuuggggucggccugggaacuuuaccucccugagaacucaguuuccucauuauaagcuggggaaaaaauaguaccuaccucucaauugugaggauuaaauuagaucaagcggguuaaggauuuagcaguaguagagcuggaaaagaauauauaaaauauauauuauuaauuuauauauuauauauaaaacauacuauauauuauauguauuauauauguuauauauaauuuuaaaaauauaauguuauaaaaauuaacagugauuagacuccagcccuacuggaguauauuagacucauuguuaaucuucuuuuuuuaacuuuaaagcuuugaauaauuacucauuggauggaaucaggaacauauaaagugugauauuuuuaguaaauguuauguaauugaagaagggcaagaagucaaugaaauaucccuugaacgccuccuccuauaguaacuguguaugucuacaaaagucugaagaaaucaccauagauuaugaaagcuugggagaccgcauuucccagacaccuccacggggccuacacuuccacggggccuaca

SEQ ID NO: 16330 - RNA, 16133 nt, Homo sapiens
uauugguguuggugccgcggccacuggcccagccgaugggucgggacacacgcucgcgcucgcgguccgcgggucgccggggccgaaggcggcagagucagagcgggagccgaagucggagcaggagccaugggcggcgaaaccgacggcgccgggaggacgagggacggcgcagacggaggcggcggagccgggagcgcagguggggucgcugcgggagcagcgcuggggauccggcuccuaccucaggagcgcccgaccgaggguuggagaucccggggaaccgggaaacccccgacuuacucggggagggcuuccuagagaaggggacaauugaccaccgguuggaauuaaccuggcagcggaaggaaggcgagaggcguuccaggcaggggaccgggcgguuggagggacagcccggagccgggugagcgaggcggcggggagguaacgagagaucagaucauaucauaucgagcccugugugcucagcacauuagaucuuggcuauuagucggagggaaauggagagucuugagaggaguuuggguaggggagugacguggacugacuuaacucugcauacuuucuggcuuugagguggagaagggauggagcgggguaggcaggagcggcaucagaguaggacggcacaauuguccagacaguagaugauggcagucucgaugggagggaggcuguagucaaccacagcgggcaaagugcguagauuucagagggauucuggaaguagaggagacaacauuugcuaauggaggugggcugugggagggaaaaagacucggugucagcuggcaggacucacagcugauuccuagugccugaaucucagcuuccccaugguccuuuucuucuggagauggggcacuuggucggauuugccuugagccggcuccaguacagagaaaccaaaauggggacagggacugauucccagaccggggccccagugcuggcucagccccuucguggcugacacucaggccagucuugccccgcucugggccaaguucacucaucgguuguugguuuuuuuguuuguuuguuuuugagacggagucuugcucugucgcccaggcuggggugcaguggcacgaucucggcuguuaccucugccuccuggguucaagcgauucuucagccucagccuccccgguagcugggguuacaggugcuuguugccacacccagcuaauuuuugaauuuuuucguagagcugggauuucuccauauuggccaggcaggucuugaacuccuggccucaagugaucugcccgccucggccucccaaagugcugggauuacaggcgugagccaccgcgccugcccauaagucuuguuaaugucaucuuuguguuuuuucgccuaccauuuucugguauuggaauuauucacaauaauuugccacucuagauauguaauuagaauuaauguucacgaaaauucaguugaacuuguggccaauauuuaagggcucugcaaugauugguuucaacauaguuuagauuuuuuugacaugagcuuaauggguagagcauuuaacaaaauauuuggcaguucucuguguacaaagaccccuaaacgugacugagcgcaguggcucacaucuguaaucccaacacuuugggaggcugagacaggaggcuugccugagcccaggaguucaagaccagccugggcaacauagcaagaccccucuguacaaaaaaauguaaagaguuaccugggcgugguggugugugccuguaguccccgcuacucaggaggcugaggcgagaggauggcuugagcccaggaggucaaggcugcagugagcucugaucaugcacuccagccugugugacagagggagacucugucucuaauaaauaaaaauauagaccuugucucuaguagacucugugucuaguagaccuugucucuaauaaauaaaauuaaaggccccugaaccaccccugagguugugcaucuuccauucccugcgcucuacucuguuaacuccuguccauccugugggacuaguucaaauaccacuuccaucuaggaagcccucccuugacagccuaaauguguucggguccccugguucguacccuuauaauuccugcgccaccagccccagccaccucccugcccgcgccuccucccucucccccacacucugucucagccauacagccuccuuguuguucuuagaauguggcaggucagugccugccucuaggcccucgcucuugcucugccucgagcacucucccuccgaauccacccaucgcugccuccccacucccuccagaccuuggcucagugucagcuccugagagagccccucucugaccucggcccugcagccccagccccugugcucggcauugcuacucuuuguggcuucugccucugccuaguguugcgugguguguuuauuuguugaugucuuccuuguuggggcccaccagagggugagcccaggaaggcagaagccaucgguauuugggucacugcuguguccccagaaccuagaacagugccugcucccccacgggcacccaguaagcaucuguggagcagaugacagcugcaggcacugagcaggcauccaugguccucuccgcaggucagauucagaggaagagcgguggcagcgcucagggaugcgaagccggagccccccgcggcccaaguggcacucaagagauggguccucucagucggacucaggagaggagcagucacggggccagugggcucgccggcgacggcgcgcacgcucguggucuccuagcuccucagcauccagcuccgcgucuccagggcgaucccagagcccccgggcggccgcggcugcccugagccagcagcagagccugcaggagcggcugcggcugcgggaggagcggaagcagcaggaggagcugaugaaggccuucgagacgcccgaggagaagcgcgcacggcggcuggccaagaaggaggccaaggagcgcaagaagcgggagaagaugggcuggggugaggaguacaugggcuacaccaacaccgacaaccccuucggagacaacaaccugcugggcaccuucaucuggaauaaggugggccccgccgggugguggccucugucccuguagcauuuccacuguuucuggagaccccaacacuugagacacucccagccugcccuugaucgugcaagaguugguuuuacacacacacgcauaagcaagcuucugccgcuaucagcuuucuuuuuugacacagggucucgcucugucgcccaggcuggagugaaguggugugaucucggcucacugcaagcuccaccucccggguucaugccauucuccugccucagccuccugaguagcuggggcuacaggcgcccgcuaccacgcccggcuaauuuuuuguauuuuuaguagagacaggguuucaccauguuagccaggauggucucgaucuccugaccuugugauccacccgccuuggccucccaaagugcugggauuacaggcgugagccaccacgcccggccagcuuucuuuuuugacucagggucucgcucugucacccaggcuggagugcaguggcgugaucguggcuaacugcagccuugaccuccuggccucaagcgauccuccuaccucagcguuuugacuugcugggacuacaggcaccaccaccaugcccggcuaauuuuuuauuuuuuuguaaagauggagucucacuauguuggccaggcuggucucgaacuccuaagcucaagugauuuucccaccucggccucccagaguucugggauuacaggcaugagccacugcgcccagcccaccgucauuuucuugccauuaacugugucucuugcgguguaagcuucagccauucuuugccccgaacaccagcccaaccugaaaccuaucuagagagccagcucuuggcaucauguacccaggacaggguuccacaguuccaggcgcucugucgucugagcugguucuuucguucugcgccugccauuuagccaccagucacaccaguggcauaagacaacagaacuuaucaucucuucguucuggaguccagaaguccaaaaucaaggcgugggcaggugugggcaggaccccacucccucugggggccgaggggaggccccuccugccucucccagcuccagucauggccggugauuccugggcccucccuggcuugcagccgcagaacccggccuguuccuguguuguguggcggucugccuucccgucucugucuccauacggccuucugcucugugugucuguguguaaauguuccucuucccaugaggacaccaggcauuggaugagggcccgccaccuccaggaugaccucaucuuaccuacgucugcaagaccucaucacuuuuuuuuuuuuuuuuuuuuugagauggagucucacucuguugcccagacuagaaugcaaaggcgcaaucucggcucacugcaaccuccgcuuccuggguucaagugauuccccugccccagccucccaaguagcuggaauuacaggcgggugccaccacacucagcuaauuuuuguauuuuuaguagacagaguuuaaccauguuggucaggcuggucucgaacuccugaccucaagugaucugcccgccuuggccucccaauaugcugggauuacaggugucagccaccauaccuggccaagaccucauuucacauggggucaugauuacagcugcagggguucagacggggaugugccugugggggacacagcucaucugaagcagcauccacuuguggaggggguggagcaggcaacgugugggcugggccgacugcaccugcucgccgguugcgcaguugggagcuguggggucuccagguggcuucugcccgaugucgucugagaacacaacgagcuccuuccgccucggggcccucacacugccgcgccccugccuggacaugcucugccccuuccccggcuguucucuuccgucaggccucaacugacacauccccucuugagagaccccuuccuggccccuugcuccccagaccccccagaguucuuuauugaggcacacacugcugccuggcacuucaucgccaccaugugcugugcaccugcggugugcugggcaccaccgugagcucugggcgggcagccauggaggaggaagauguggucaucguugacgccuguggaagcggccccaggcuggguuggauagaccacagaguggcccgggugucugggggugguccccagccaggcagccugugucccuggaggcaaguucugggcggcagggguuccuggaacccccucauggcgacggggcaccgggagccugaggaagguggucgggaagugggggcuccgcgccaggcucucagacagcugcuggaagaagccagcuuugagggucuccaggcugggacaagcccaucaguggccaccccugugccccgcugugugggcggggccccaugaccccacagguuugcuuucagagcugcugcugcccccacucacuguuccugcccugucccacgugcagugggggacccugacuugcugagggcguggccuucacguccgaagcacucagacucccggguaaagcgagucagcaggccccgagcaaggcucuucuguugggggcugggguggccccgagcaaggcccuccuguugggaguuggggcggccccgagugaggcccuccuguugagaguugggguagccccuucuuacccuuugcauacaucucacucccagugggggcuccaugucugcacugaauuggaugcacuggguuucaggaguguuaaggaggggguggaagacgugcagugcuggcaggucaccucucucugcaaaacaagggcccuggucaaucucuuggacgaaggagcugaggaggggggcgagggggcgggucugugcucagggcaggugugccuggugcuuccaggcccuggagaagaaggggaucagccaccuggaggagaaggagcugaaggagcggaacaagaggauccaggaggacaaccggcuggagcugcagaagguaggcacccugccagcccacugggcagggcccucccuuuccagggccuggaggcccgcccccuuuggcaggacuugaggggcuuaagugggaaguccugggggcuggcuucagguaaggcuggauccaggggcucagaccauggccccaggaaacuguuucccuccaccucucggcucugcuggccucgggccuucacucccacaugcucccuucaggguggccgagagggccccagcugaucugagcugcugagucucgggcaggagggcccucucccuucccaaggucuguccaccagcccaggcaucuccggaccaaucccugugcccagggcagcugggugaaggcugggcccccaucaucacagccccuccccccgcagcccugcagaccgcacgguccccgcugcccucagccuccugugccugcaggugaagcagcugcggcuggagcgggagcgggagaaggccaugcgcgagcaggagcuggagaugcugcagcgcgagaaggaggcagagcacuucaagacaugggaggagcaggaggacaacuuccaccuccagcaggccaagcugcggugcgcuggggccucccccucccuccgacccagacuuggagccagggccgggcacuggcugucacucuggaagccacugcucucccacccuucagggucccacacggcacuuccugggaccuucccuuccugaccccuucccgggcggcaaggcuucugucuccugcccuccccugcugggcagggugcagaggagacgggcccaggugaacggcaccccacgcaugcuggacgccaguccugcacugacugcaguugucccucccacacuccacccaggaggguggcacccccauccgccugguuuacagacaagcugaggcuccggggugucccugcuugccuugggccccguggcgggugacaucaggcuccucccagcucgggccucccuggugacggguucccuuggguuggaccagggcccgccugcaacgcguaccccccugcaggcccagaacagaaacccggcucucugccccgaguggucugccugggggaggaggugguugcaaggcagugacuacucuggucccccagccugccucugcuucagcuccuccacucuuccccaucacagcccacauagaagccgccauccugggcacaucccagaggcccuccaggaagccccucccaccuggcccaccuccggguccacgcugcuugcacuuugucugcacugcuggccugcgcccuuuggcugacccggcucacucuaccuuaugccuccuccuccuccuccuccaggaagccuucccugaccacccccaacgggucaggccccuccucggcucccacugguguggucaccccaagggcagggucuuuagcauggagggcacagcccaggcucugaugccaccuuccccugcuccccacaguuccaagauccgcauccgggacgggcgggccaagcccaucgaccugcuggccaaguacaucagcgcugaggaugacgaucuggccguggagaugcaugagcccuacacguuccucaacggccucaccguggccgacauggaggaccugcuggaggauauccagguacccagccccacccgaugcuccucugaccugcacccucacccccaccccagccacacccguguccugaccccugcccccugcccccaggucuacauggagcuggagcagggcaagaacgccgacuucuggcgggacaugaccaccaucaccgaggacgagaucuccaagcuccgcaagcuggaggccucgggcaaggggccagguaacggcgggcaugggccugggcuccaggggagcugcgggggcuacaguguucacccagaagccucagacuugcuguggggccuggugcucucugcaggccucgguuuccccaacuggggccuccccuucugggccgagccaccagggggcagcagcgggcaguaggcccugggagggaugaguggggcgggccucugucuggggugcagggccagcagcguccagacccagcgucccguuaacgcugacucggcggugccggccuuaugggagccacggggcuuuccgcucagguuucagugcucucaguggcucugccuguuugacagcaagucucgcuccaccuggccugaaggccgugcagcccagcuucagggcgcuaccugucccgugcgucaguucgugccccuccaaccugaugggcuuuuaaaaucacguuuccccccccuccgugugguugcacacacauggucaccggggaugcucuaaagcgucuacccugagcacugcggacaugcgggcugggccguucccuaggguggggccguccuggacacugcugggugcugagcaacgucccuggccuccacccagggucaggagcaccccuaguccugacaaccgcagauguccccagacguugcccagaguccccugggggcagaauugcccuagaugagaccccccccccccccggucuaaaagccaaccacagcagcccugcccccuccccgccaaaauccacgccccagcggcugcuguaacagugccuggcucucaugggccacgcaucccugucgauagacccgguccuuccccugcccucccucucaggccuugggugccaucaugguggccgaggaucccaggaggcugggucagugucauuugcagcccucagcguggucuguggcagguccuuccuaggaaagagccuguggcuuuccucuuuuucaguggagcuuuguguuccccggagguggaguucacucagccauccugucccuccaguggucuccuccguggggcacauucucccguaaccucagagaggcagggcaguucuccagcaucagagguguguccguuaagggucuuggugugcuccugcugguggcagcggggcugggcaaagacuucugggugcaguacauuuuccuucagaagccgcagacccuacccaccggcugcaggaagccugggaggcguuuccagcguugcccuaggccccgcccucuccuguaagacugggaggcguuuccagcguugcccugggcccggccucuccuauaagccugggaggcguuuccagcgugccccacugcccuaggccccggccucucccaucccuuccauggccuucugccuccaccacgucgcucagcccuccuuuccccucacgcguuacaguuggggaccccagguggcuuuggugucuuccgagggaguuuguuucugauucuccuuucaacaugguuuccaggaguagggaaccgaggggucuugacuuugcugucccccuggagacccacagagccccuguccuggaucuucuuaaauuaauugggguuuuccuuuuacuuuucauuuuucagagacaaggucucgcucugucgcccaggcgagaguugaguggcgcgaucaaggcucacuguagccucgacuuccuggguucaggugauccucccaccucagccucccuagaagcugggacuacaggcgcucaccaucacacccagcuauuuuauuuuuugagaaggagucucacucugucaccaggcuggagugcaguggugcgaucucugcucacugugaccucugccucccagauucaagcgauucuccugccucagcugcccaaguagcugggauuacagacgcgcgccaucacgcccagcuaauuuuuguauuuuuaaggagacaggguuucaccauguuggccaggauggucucaaucucuugaccucaugauccucccaccucagccucccaaagugcugggauuacagaagugagccacugugcccagccacuucugaaaauuuuuuguagagauggggucucacuguguugcccaggcuagucuugaacuccuggccucaagcaauccuccugccucaccuccagaagggcuaggauuaaaggcaugagugacugcaugcuuuuucuuuuuaauuuuuacaaaauuaaaguuuuuuuauuauuucuguagguuauuggggaacaggugguguuugguuacaugaauaaguuuuuuuguuuuuugagacggugucuugcucucuugccaggcuggagugcagugguguguucucaggucacugcaaccucugccuccuggguucaagcaauuccccugccucagccucccaaguagcugggauuacaggcaccuaccaccacaccuggcuaauuuuuuguauuuuaguagagacaggguuucacgauguuggccaagauggucuugaucuccugaccucgugauccacccaccucagccuccaaaagugcugggauuacaggcgugagccaucgugcccggccguuuacaugaauaaguucuuuaguggugacuugugagauuuuggugcaccuagcuuuuucuaggaaguucuaacccuacaggagguugugcaguagaaaacgggugucaucccagcucagcuucauuagccucccacccuguguagggccuggccuuucccccacgcagccccagggcccuuggccugcacccccagccucuagcagcugcugggacccccuaaacccccgggcccccuugugggcauucgggaggcauccagacaugcagcagcauguccagacccggcuuucuauagacgcugaccuggcggcaccuggccuggcuuccugggagccucgcggcugggcucuucugcuuggguuucaguguucgugguagccccgccugucugggcacggccgcgcugugcuuggcuggggcugccacggauuccagugccacuuagcgcccagcaaaggggcugcagcucugggugccgauuccagggucccaggugauuggcuggaggggacucggguccgucuagacucuauccaguccccugugguguaggugugggccucuugacccucuguccgccagcggggacuggagaaggcaggucucgagcagggugccugcacuggucacccccgcccagugugucaccagcagcuaugcaccaagcucccugugggcccagcauggcacagggaacagcagcagccagccccauugcccgccucgggaagcugccaucgcuggauggucagggagggcuuccuggcggaagggauguucucacugagcauggaggaugcgaggaauucaggaagcgaaugggacagagaaggauggguagcuggcaggaagcacagugcgugcaaaggcccagagguggcagggguucggcaugggcagcaaggggcaggguugcgaggugaggccagacccagcgggguggguggaaguggccugagagcagcacugaggccgccgggaugccacgugguguggggcagagcacgcggagucaggcuaggcuccagccucccagcaccccacucccgcccucagcagccuccccgucuaucgaggagggacuugagccucgggccccugggccagugguagaugccagacagacuccauguaggauggggggcggcgguggggagcuguuuguccuggggcgggcccaggacuuccccaggggccagcaggguggccuucuuugcuaggcuucacagagggaaacuaaggcccagaaagggcaggccacuugcccacagucacacagcccaggcuggcagagaagaucugaauuccagagagccuggcuaccgagcacaccccccaacccccucauggacugcccaaggccagggcagaguugggccagguuggugggccgggcccacaacuaggguucccagacccacauaucagacucaccuggggaggggcauucucagggccaguccuggccucccccacgcugggggccugggccuccaggucaaggccucagcaacugcaucuuaacguggcucccaaccuccgcccacccccuccccuccgcuguggccaggguggggacaaccugagaccagggagguggcgggacuggaugggaccccugugggggaagaggaggggagggggacccccccauggcaggggaggaggcccugaugggguggaggagcacguaggaaauguggaaccgcccccccaugcccccaccccgcugcaggugagcgccgcgagggggucaacgccuccgucagcucugaugugcagucgguguucaaggggaagacauacaaccagcugcaggucaucuuccagggcaucgagggcaaaauccgcgcugguggccccaaccuggacaugggcuacugggagagccuccugcagcagcuucgugcccacauggcacgggcccggugagcacuaggugcggguaccaggguuggugccguccgggugggauggguuucgcccccuccugaguccuggguggggugggucucgccuccuccugggaccaugugggguggagaggggcaggaaagugccgacuggccggggccagccugugagugacgaaggggggccggggggcgcguagucccgugcccuagcgggaaggccccaggaugcuccagugcccucaccuggagucagcccuguuggucucacagggcuccccaggagcuuccgcccuuuaacgaguaccuggcgcgcuccagcagccauggcaucacaggaagcccccaggcggccugccuguccccacugccuugcgcccaggccugcgcccucccagcgcugcugccucccggccucuggcuguguacagauuucuggaguguuuuuggcaccgcuguguaaauacaugucuccucugcuaauuuguaaaugucucuaaauuuaucaugcuuguuggcugguguccugcugggccccuucuccuggccagccccagccacaagacacugagacugcagcgugagacagagacccaccucucccugccaugggaugguucaccaggguaccugcguccucucguccucucucccauaagccuugacccugaacugaccaagccugggcaaaggucccagccagagccguggcugcucgccaccuucucaggguccuugcagcaauaaggggcgugagaaucucgguggggguggggcgcggagccccuucgccuccaugcgggugaccccggcucugcgucccaggcugcgugagcgccaccaggacgugcugcggcagaagcuguacaaacugaagcaggagcagggcguggagagcgagccgcuguuccccauccucaagcaggagccccagucccccagccgcagguaggcccggccggcaccccggggacgccgaugcagacgcggagcaggauggaggggccgugggcagccuccgcgccuccaacgcucucuccucccagccuggagccugaggacgcggcgcccaccccgcccgggcccuccucggagggcggccccgcggaggccgagguggacggcgcgaccccgacagagggcgacggcgacggggacggugagggcgagggcgagggcgaggcggugcucauggaggaggaccugauccagcagagccuggacgacuacgacgccggcagguacagcccgcggcugcucacggcgcacgagcugccacuggacgcgcacgugcuggaaccggaugaggaccugcagcgccugcagcucucgcgccagcagcuccaggucacggguaagggcggggcuggaggccaggggguggggccaguggggcgagcugggggcggggcuucuccagccucauuucccggccgaagccgcuggcgucaguggggagcugcuugcugcuucucccccgggucucugagcgugcauuccgucaccugcacgcgcacuggggcguuccuucauucauccugggcuugcuggcccacuggccuuggggccacaggugguggaagcuuuuaccggccgcuguccgagcacucccugggcagccuccguccuaagacagaggagaaaauacuggcuucagaaaaccccugggccaggacccccucgggggucaugcguggggcuggaucccgcagccaggcccuaaccaccagguucuccugucgcucggcggggaagcgcgcugcgcuugguccccacccaggaggacgauagacaugaagaccaagguccggggcucggggcggauggugugggucuccgggucgcccaggcccuguccccuccccaugugccuuagcucgccccagccuguuuuccuuuugcgggaggcaccagcggccgccccugccagagaggcuaggagggaggccaggacccagggggaggccgaggcccgggugaacgccgucccgcccgcaggagacgccagcgagagcgccgaggacaucuucuuccggcgggccaaggagggcaugggccaggacgaggcgcaguucagcguggagaugccacucaccggcaaggccuaccugugggccgacaaguaccggccacgcaagccgcgcuucuucaaccgcgugcacacgggcuucgaguggaacaaguacaaccagacgcacuacgacuuugacaacccaccgcccaagaucgugcagggauacaaguucaacaucuucuaccccgaccucaucgacaagcgcuccacgcccgaguacuuccuggaggccugcgccgacaacaaggauuucgccauccugcgcuuccacgcggggccgcccuacgaggacaucgcuuucaagaucgucaaccgcgagugggaauacucgcaccgccacggcuuccgcugccaguuugccaacggcaucuuccagcugugguuucacuucaagcgcuaccgcuaucggcggugacggcccuggggaacggcaggcagguguccucgggggcacaguaaaggggcuucggugaagcugguggucacuccggggccgcugucugggcugcagggccgcggguucacgucccaccucaggccgcaucuuucuuucgccaggccucaguuuccuccuauauaaaaggggggucaccauugagccugccauggugagcugaggagacacugggacaggcuggccuaggguccugaugcaacggagggggcgcuaggggcaucuuucgagcacgaggguggccagcagccgccagcugaccucaccguccaggcggacacucuccaccgccccucagccaggcuggguggggcccacagggccugccccaaguggcggccacacaggguguuguggagaugggccagaggggccugggcuuggcggugccaggcucgugagaagcaggaaacucaaggccagcccugccacaucacggggcacccacugggcgugaggcagagcccgcggcuguggggcagcuccagcccugcccacaggccacccucgcccgcacaggcagcacugaggccgggacccugcuggcgcccgauccgccacugcagaagagacccucuguggacacccacacucugcagggacuggcccccaacucaccccgugcuggcuggugggguccauuuccccgcagcggguauggaggaugcgucgaggucccugucucugucaaggucgugggaaccaaaagucacugagccguccuccccccaccucugagcacagggccuggagggcaggggcuccccgaaggcuggggguuggagaagggugaggggcuucccccagggauccccccaccuggccugcucacggggccuuggagcaugagaccagugaccccgaguuuugcccauaucaggacaguggcuccuucucacuccccuuucucaggccaggagggccgagggccacacgggugccacagcccaggucggaguggcccagccggcaggcuuguucuucagcauccgacgggaacaucuccaacagaagcaaaacggaaagugccucccggacccccagagggccacccaaccucaccagucaccagccccagaccacccacagccccucccagacaccccgccucaucuggaaauaguuccguuuguuucucuaaaaagacuuguaggugggaaaaaaaaucuuuuguucucauggaauuggccuauuggcaagaucgcauguuuuuuuaaua

SEQ ID NO: 16331 - RNA, 6192 nt, Homo sapiens
cuuaaaacacaaauuuuacuuguuuuuauuuaaaaaguccggauccagcagugagaaggagccacccccaccagggucccucggcuggaggagagcaggaugggcaaagccggcccccacccaucugggguacaggcaugcgggggacaccccagguaaguccccacaaggcagcuuccuguguggccuauggcacagccccccguagugaguaauuugggggguccugccgugugcuggggguggguuucgucugcccuguguccuggggguggcccggagagccaguguagcgcguggcuguccuccgaggaggggcacccucggcugugagguucuucuggguguaucgcgcagcgagugcuuuuuccggguucagggggcuggggagauugaaagcuaaagggaugcugcagaaauuuaauuuuaggggggcuggagcccccaaggugcaggaugggaccaggccccaaaggguggacccccagccucucguccacggggugggguguggcagggccgcgcccacagcuucuccucugcaucgugggcccgcccacuccucacaggugcucgcugaaacgagagaggagggcccgggaugaggcccucaucaucucuggcccccaccccggcccuggggaaccccagagaccauggcccaucagcugcuccaacagaugccaggguugggggacaggcguugaaccuaucuaacccgggcgcugggauccacccugagaagcuuuagggaaguucuggugcccccgagugggucccgccggcccgggguucuccauggccauccuagcacuggugcaucaggggcgaccgcagguaggccccuccgggaggugaucucuaguaagcugcggagucccacccagcagcccucgcggaccuggggaaccccagggcgggcacauccgggccuugaaccccggccccgccccgccucgcccggcacacaccuggcgaccugggccaggauuuccuugaugcggacgaugagcuucucgugcugggcggggucgcgcucgauggcuccgugaagccgggccauguagaaguccagagugcccagcgugggcguuucgcccgugccugggggacaggcgggaaggucaggcgagggugccggggagucgcggggcgggggcuccaggggcagcgguagggggugacucagggcgggucgcgcgggcgcucagagguccggacaccgccagcgcaggagcggcgcagggugggcuaagguaagccggggcaggaggauggcgaggacggggacaggguggggacgcggggcuagagcggcgggcguccaggguccgcugaggacagucacggacggagggaacgaggucggggagguggggaugacaccggggggcuggggucgcgugggacgugacuggggugguggagggggcucaggcgucagcggggcguggggagggaugggugacgggggcguggggagguggggugaaugggaacguggcguggcgagcggggaggcugggucagugcucaggcuggucgggggcuggcgagggagaggggccagcgacgguggggccgguagggagcggugggggcgcgaagggugggggcacaaaggggcugcgggaggaagcgaguaagcggggacgcgucgggagaggucguggccgggaggcgcggucggugggggcgaggucagggagccggccgaguaacggggcgcggagcggagcucggguguggucugggaagaaccagacggagcuaugggguaggggugcgggggucggggaggaggcggagcugggggugaugagggcggggcgauaggcggggccgggugacuggggaagaggggacggggcgaugggcggcgccgggcgacaggggaaggggggaagggaggagggggggggaggcgggcggggccgggugaccggggcgggacugggagaugggcguggcccgcacccggcaccggcagugaggcgaagcuggcggugagcgccuggcgcacggccuggagcugcugcugcagcgccagcguccuccgcuccuccagcgccagcuccugcuccagacgcucgcgcgcgcugcucaugcucugcgugugccucugcaguaccgcguucugcuccucgaaggccacauucaucuuccgcaagcgccgaagcuccgccucacgcgcugcgccggggggagcggggucaaagccugcgccuccccuuuccccuaccuccgggcuuuugcccgggacgugccccugcccagguuucccucacugcgcccucugccuccugcuccacaucagccucuggagcgacagcgugcgccuggacgcucauagggaaccucccgauccgccuccugcagucuuggggcccuccuggcccacgccccccucuaccacccaguuucacggaguucgcaucaggagcgcaguuaccgcucaccuuuguuuugguccaagaacucuucagugaagaugggaacaucgaagguggagaagccaucgcaguccccacccuaagacgaagggacaagguggcaauuuacuggugguaggaggcagccacgcucucugggugugccccaagccuaggagggucuccugggacaccccggugggaguacaaucaacagcgaucccacggugcaguggcaccgccccugcuugcacacaucugggcgagcacuggcucugacucaggguucuagaagccuccagaccuuucucccccaggugcuuugagaggaagaaggucgcuuaccuuguguccauucaggagaguguucaugagcccagagcucgagucuucuggcgggggaggggaagggcagggucagccucccaggccuccagggaccacgcccugcacccuaggucagcgcugcucagccggcuccagcuccccacuugagugccccgcgucugggcaucccccaucgcuguaccgagugagcccccuucacuccugucuggcuauguaucuuucccccgcccaacccacgggacugugccccacggagggaggcccugccugggcugaggucgcaccccacagagcaggaccccaacugcucgcaccggccccucccaccuuucauuuuucuuuuucuuuuuuuuuuuuuuuugagacggagucucgcccugucgcccuggcuagagugcaauggcgcaaucuuggcucacugcaaccuccaccucccggguucaagcaauucuccugccucagccucccgaguagcugggauuacaggcacccgccaccacgcccagguaauuuuuguauuuuuaguagagggggaggguuucacuauguuggccaggcuggucugaccucaggugauacacccgccucggccucccaaagugcugggaugacaggcgugagccaccgcgcccgaccccucccaccuuucuugaucuucuucuccuggaucuucuccgugcacaucuuauaggcuucagacugcugguacgcccgcagcuccuucauguacugcugcuucucucucucggccucauccagguaccgcuggggggcagcaccagaaggcuugaagcaggggaagccuccaacgccaggauccagucuuuaucacucugcuuucacagcacccuccccucuccugaaccuucuauagcucccuauucccuccaggcagacagaaccggcuccucagccuguugcucagggaccuccgagcucccaccucacuucccaugccccggacucuuccccaccuccagcccugacaaaccacucccggacgccagagucaugggcaggaacccaaccuccagcguaugcggaugccuggacucccucccgcacccguuucucucuuugaaaucucacuuacagggaugcaaagcagugauggcuuuuguuacauuuccgugauguuuuugcaauuuuuaaacuaacaggauaugaaaaucggguuucgcaaaaaauccaggccccauccugacuucuuagacauaucuuuguuggucauccaguuuucaaucugucuugccucuugcuagccgcgcccccaaaagcuggucaugggcuggccacgguggcuaacgccuuuaauaucaauacuuugggaggcugaggugggcggaucauuugaggucaagaguucgagaccagccuggccaacauggcgaaaccccauuucuacuaaaaauacaaaaauuagcagggcaugguagcacgcgccuguaaucccagcuaccugagaggcugagacaggagaauugcuugaagccgggaggcggagguugcagugagcugagaucacgccacugcacuccagccugggcaacagagcaagacuccaucucacaaaaaaaaaaaaaaaaaaaguugguuaugggugggcauuucuccaggaagaaggaaaaacccugcacguggaauccuuugggggucggggcuacugggggguaguccguggaccccgccagcccugcucggcgccccgccccgcccaccugcuuuuccguuggcugcagcuugcuccacucggcgcccagcaucuuggugaucucgggaaagggcagauccggguggcgcgugcggaucugcucgcgccgcucguucaggaagcgcacguagcccgugaccggugccuugggcccauucggcagaaucuucuuccgcuucuugcccuugggccagccgcguuucuucaccggcugcagaaccgggcugcgucguugggaggggggccuggcguacuggggcagggcucagaggggcaugggcggggccuaacgcguaugggcggggaugggggcggggccuagcugggaggaagaacccggaaaagauggagguagggcccggucagcagucgggacacgguggguuagagggaucccuggccaggggugaggggaucugaggaacuaugggccgagguuugaguacaggguuggcguugacuucgguugugggcguggccucugcuuggugggcgugguuuucugcuggagaacgggcccacaggaccaaggggagggugccgcccccaaggaguggaagugggcgggaccuuagagugggcagagcuggcauugugcggugggcggggccuggacuuagaguggcagaggaccugucaggggcguggcagcuggcacggggcggggucucagcuuccagaggaaaaugggcugugggcggagccacaagcaauucaaauccagccuggggcggggcuucgaggcuggggcgggagcccggggccucccccagcucagcgcagggacucucaccuccuccucgugggaccccuucucgcccgcgcguggacccucgccgcgcucuugcuugacagucaccacgaagcccccaugcuggcccggagccuugccgcccgccggccuggagccaaggauaccgcggucagccccgucccaagaaucuccccucccccaaaagcccaccccagggcguuuugacccccgacggcggggcugcagcgagagugcaugagcccgaggaggcagggucugauggggucaguauccggggaaggugggacaagcggggcuccugggagggacuggaggccgagguggggggugcagaauuggguggagggagaagcccccugacccaggugggggagucaagacuccggcgggagggacugggucagggguucaggagcuagggcugcagccgggaaaguagcgagggcguggggaggggaucagugcacucacgcggcggccgcgccgggcugcuuggggccgugggacauggccgcuccgggccggaccuggaacacggacgcgggcggaggugaguagcgcccgggcugcccgauggcagaccgcgaacugggguaccccgcgauggagagccccgggaugccgggcccggagcgcugggggggccggauccaggggcagggaaguccucgagggcgggcgccccaagaauccuuuguugggcgauugccccccccgggaggccugggccgguuucccccgggccaggaaagaccccggcccggcccugggaccccugcacccccgcccccucucagggcccggaguuccgcggcuguuuucaccuccaaagaaacuuucccggaccucccgacugcgcgacgcuccaaccaaccgcccgcagcccgcccccgucggccgccccgccccuccccgcccccggcaug

SEQ ID NO: 16332 - RNA, 5814 nt, Homo sapiens
caaaccuguggacgccgacccgggaccgccgcuggcuggcugcuggcucacucgaccgucauggagacccugggggcccuucuggugcuggaguuucugcuccucuccccgguggaggcccagcaggguaggugcaggggggcgggagggggcgucgcgggauaggggaguuggucaggugaucaccaucucccaauuuuccauggcgagaaaaaggagagggggcaggaagaaaaggaagaguggcuuggaggcccuucucaacccccgcaguaccgcccggccucccucucgcugggcucugcccuccucuguaagggaccccccaccgcccacccgagccuuuccccucuccagcccuucugagcacaccuggcugaaccccccgccuugagcucggccccacucugagcucgggccuccuuuacaagccccuccccaucugaguccccgccucuuuugugaaccgcuccuucucacuccuccuccuuuauaaaccccuccccgagccccuccuccucuguaagccccuccccucugggcuccuccuucuuuauaagccccucccccugagccucugccuccucuauaagccccucucccucugagcccccuaguucacaagccucuccccauccgagccccuuccuccuuuguaagcaccuccuucucacucucccuccuuuauaaaccccuccccgagucccuccuccucuguaagccccuccccucugagcuccuccuucuuuauaagccccucccccugagccucugccuccucuacaagccccucccacucugagcccccuaguucacaagccccuccccaucugagccucuuccuccucuguaagccccuccuucucacucauccuuuauagaccccucccugagccccucgucuguuguaagccccuccccucugagcuccuccuucuuuauaagccccuccuccugagccucugccgccuuuauaagccccucccacucugagacccucuccccuuauaagcaccuccccucugagcuccuccuuuauaagccccucccucuaagccucugccuccuuuuauaagcuccccccaacagcuccucuguuguaagccccaaccccccagacucuucuuuauaagcccuccccaucugagccaccuccuccuucauaagccccuccccugagcuuguucuccuuuauaaaccccaccccugagccacuccuuugucauaagccccgcccuucugagguccgccuuuauaagccccucccccugagccucugccugcauuauaagccccgccccuucugagcccuccugauuuguaaacuccguccccucuaagccccccuucuuuuauaagccccuccccucucugggcccccaggcucccucccacucugguaagguacccucccccucucuaaacccucccgaccccccuacgccauccaggucucugaagcuccgucccuuuccaauacccccucugucggagcacccccagugaccuucucucucuccuugcuaggguggugggggaagggggucuucugaccuuuucuuccucugagucgaaccuccccaacuuccugcagccacggagcaucgccugaagccguggcuggugggccuggcugcgguagucggcuuccuguucaucgucuauuuggucuugcuggccaaccgccucugguguuccaaggccaggugggugcccgcccccaccccgcugcccccacagcccugcccccacccccagcuucccaacccucucugguacccccaucaccagccucaaaguccgaaggucucccauuucccugcugcuccuccaaccucuacucucagagcccagaucccgggcuugcacccgcccgucuccccaagacaacgagccaggcagcccagcccuuccuugcguccugggguucaugagccccggcugggagguugggacagaggcugaggcugucacaccgcuuccuucccuuuaccgcccccuuucuccucucccgcccccuuccaccuuucccuuuaucucugcagggcugaggacgaggaggagaccacguucagaauggaguccaaccuauaccaggaccagagguacuaugcgugcggaugcugggggucugugugaaccccuccucggggugggggaaugggugugcgcagaugaccuugcuguccugaauccuucaaacacauuccugcccugggaucuucaccuuuccuguaucuucuggcagcuccuucuccuccuccagucccuagucagggguuuccagccuggccaccagccuuccugacacuguccccagccccaagucugauucaugcuuaucaccaguggagcugucuuaguuguucacuaauuuugagacauuacguggugccuuccaguuguguaggcaacuuagcuuuuguccuggcuguguccucauacccagcauugggccuggaacacaggaggugcuuaauaaauaccuguugaagaagacugugguguaggauuguguaggugucuguacaaggccuagguaugggcgacccaccuggacucagugccuccuauggcucugacugccucccaaccugaggauucccacagaggacucagggaugcagaccuccaucuuccauccacccaucacccacucauccacccacucacccauucauccacucacccauucacccacucacccaccauccauccauccaucauccacucauccacccacucacccauucacccacucacccauccacccacucacccauucacccacucacccauccauccaucacccaccauccauccaucacccaccauccauccauccaucacccacccauccacccacucacccauccacccacucacccauucacccacucaccuauccacccacucacccauccacccacucacccauccaucacccauucacccacucacccauccacccacucacccaucuacccacucacccauccauccaucacccaccauccauccauccaucauccauccauccaucauccauucaucacccaucuguucacucacccagcugcccacccacccaucuauucaccuaccacuuauccacccacucacccauccauucaucaccccccauccauucaucacccauccacccaucaccuacccauccacccacccaccauccauccacccaccaucugucuaucauccauccauccauccauccauccauccauccauccacucacccaucccccaacccauccauucaccaacccguccacccacucacccauccauucaucacucauccauccaucacccacccccauccauucaucaccuacccauccacccacccaccauccauccaccgaccauccaugauccauccauccauccauccauccauccauccaucacccaucuauucacucacccaccccccgaccuauccauucaccaauccauccacccacucacccauccacccacccacucaucuguucacacacccauccaucuacccacccaucuauccaucagccauccauucaccauccauccacccacccaucuauucauccacccaucaauccaucauccauccacccacccacccauccacccauccauccauccauccauccauccaucaccuauccauccaucacccaucuauucacucauucauccacccacacagccauccauccaccuacccauuuauccauccauccauccuuccauccauccauccauccauccauccagggcugggggcucugucuugggcaaaggcuuggggacaggaguaggagagugggagcugggaggugaccagccuggcugggagagucucagcugaguccaagaugugccugagggagaggaccugagugguggcuuugucuaagaccuggcucagccccaguaaaauaugauuccuacucccaggauguacugggggaucuggaucccaccugugcaccuguaccuguagcuuccuuucugccuuguucaauccuccauccauccacccaaccauccacuuguacauccaucuaucagucugcccgugcaguccucacccuccaaccacccauccaucaguccaccuacccauuagcccauugaucuguccacucacugauacacgcacccacccaccuaugcguccaucgaacuaugcagucuucacucuccaacuguccauccaucagucuaucuauccauuagcucauugauccauccacccaccuacagucucauucauccuccaucuaccuauccauugguaugucauucucuucuuccuccaauucauccauucaucuacuuauuaaucugucccucccuccaugcaaccaucaauucacccaacugcuuaucuacucauccauccauccaccuauacauucauucauugaucuauacauccaucuauacucccauccacccauucuccauucugcauacccccauccacugauccaucagucucuccuuccugcaauguauucauuuaucuuccaauucauuuauucaaccuccaugcagcaguccauucauguaacuacuuaucuacucauccauccacccacccauccauccauucauccaccaacccauucauucauccauccacccauccaucuaucauccuuccauccaccauccaucaaucacccagccaucauccgcccacccacacacucacucauccauucauucgccaacucagucacccaucuguucacccacccauucauuaauucauccacccacucauccauccauucauccacccauucacuuauccacccacccacccaucaauucacccaccauccauccaucaccuauccaccuaccauccguccacccacucaacuauccacucacccauccacccacccacccauucaucugucuacucauccauucaucauccaucuauccacccacccacccauccauccauccuuccaaccacucacccaccuagccauccacccguucauccagucauccauacccccauccaucauccauccacccacccacuauccacccaccuguccacucaucuacccaucuauucccuaacuucuuuacacaccuacccaccuauccauccauccauggagcaguugagucuuaguugcaaugaugauaugcagugugaaccuccauaucaucuguccagccacugcacccagccucaaaagcagccuccuuugccaggaguaaacugagucccaagaggcaacagggagccuuuggcuuauguccauccauccauccacccauccaucccuccauggagcaauugagucuuaguugcugucuuugugaaauggaaaucgugaggccgcguaguuaggguuauuuugaagauucacugagauaccgcuuguaaaauacucaucacaugggcuggcucaagugaguggccauuaaauaggagugucucuguuucuuauuaugguuuggggccuuuguaucccuacagugaagacaagagagagaagaaagaggccaaggagaaagaagagaagaggaagaaggagaaaaagacagcaaaggaaggagagagcaacuugggacuggaucuggaggaaaaagagcccggagaccaugagagagcaaagagcacagucaugugaagauuccuggcugccucuuccaggcagucccccagagaugccucuucugcccccuaaaagcagugcccuggacuugaagcccgugaaaugacuccaucugggauucagaauacaguguucucaagugaagaag

SEQ ID NO: 16333 - RNA, 5814 nt, Homo sapiens
cuucuucacuugagaacacuguauucugaaucccagauggagucauuucacgggcuucaaguccagggcacugcuuuuagggggcagaagaggcaucucugggggacugccuggaagaggcagccaggaaucuucacaugacugugcucuuugcucucucauggucuccgggcucuuuuuccuccagauccagucccaaguugcucucuccuuccuuugcugucuuuuucuccuucuuccucuucucuucuuucuccuuggccucuuucuucucucucuugucuucacuguagggauacaaaggccccaaaccauaauaagaaacagagacacuccuauuuaauggccacucacuugagccagcccaugugaugaguauuuuacaagcgguaucucagugaaucuucaaaauaacccuaacuacgcggccucacgauuuccauuucacaaagacagcaacuaagacucaauugcuccauggagggauggauggguggauggauggauggacauaagccaaaggcucccuguugccucuugggacucaguuuacuccuggcaaaggaggcugcuuuugaggcugggugcaguggcuggacagaugauauggagguucacacugcauaucaucauugcaacuaagacucaacugcuccauggauggauggauagguggguagguguguaaagaaguuagggaauagauggguagaugaguggacagguggguggauaguggguggguggauggaugauggauggggguauggaugacuggaugaacggguggauggcuaggugggugagugguuggaaggauggauggauggguggguggguggauagauggaugaugaauggaugaguagacagaugaauggguggguggguggaugggugaguggauaguugaguggguggacggaugguagguggauaggugauggauggauggugggugaauugauggguggguggguggauaagugaauggguggaugaauggauggaugaguggguggaugaauuaaugaaugggugggugaacagaugggugacugaguuggcgaaugaauggaugagugagugugugggugggcggaugauggcugggugauugauggaugguggauggaaggaugauagauggauggguggauggaugaaugaauggguugguggaugaauggauggauggguggguggauggaugaguagauaaguaguuacaugaauggacugcugcauggagguugaauaaaugaauuggaagauaaaugaauacauugcaggaaggagagacugauggaucaguggauggggguaugcagaauggagaauggguggaugggaguauagauggauguauagaucaaugaaugaauguauagguggauggauggaugaguagauaagcaguugggugaauugaugguugcauggagggagggacagauuaauaaguagaugaauggaugaauuggaggaagaagagaaugacauaccaauggauagguagauggaggaugaaugagacuguagguggguggauggaucaaugagcuaauggauagauagacugauggauggacaguuggagagugaagacugcauaguucgauggacgcauaggugggugggugcguguaucagugaguggacagaucaaugggcuaauggguagguggacugauggaugggugguuggagggugaggacugcacgggcagacugauagauggauguacaaguggaugguuggguggauggauggaggauugaacaaggcagaaaggaagcuacagguacaggugcacaggugggauccagaucccccaguacauccugggaguaggaaucauauuuuacuggggcugagccaggucuuagacaaagccaccacucagguccucucccucaggcacaucuuggacucagcugagacucucccagccaggcuggucaccucccagcucccacucuccuacuccuguccccaagccuuugcccaagacagagcccccagcccuggauggauggauggauggauggauggaaggauggauggauggauaaauggguagguggauggauggcuguguggguggaugaaugagugaauagaugggugauggauggauaggugauggauggauggauggauggauggauggguggauggguggguggguggauggaugauggauugauggguggaugaauagauggguggguggauggauggugaauggauggcugauggauagauggguggguagauggaugggugugugaacagaugaguggguggguggaugggugaguggguggauggauuggugaauggauaggucggggggugggugagugaauagaugggugauggauggauggauggauggauggauggauggaucauggauggucgguggauggaugguggguggguggauggguaggugaugaauggaugggggugggugauggauggaugagugaugaauggaugggugaguggguggacggguuggugaauggauggguugggggaugggugaguggauggauggauggauggauggauggauggauggaugauagacagaugguggguggauggaugguggguggguggauggguaggugauggguggaugggugaugaauggauggggggugaugaauggaugggugaguggguggauaagugguaggugaauagaugggugggugggcagcugggugagugaacagaugggugaugaauggaugauggauggauggaugauggauggauggauggugggugauggauggaugggugaguggguagaugggugaguggguggaugggugagugggugaaugggugauggaugggugaguggguggaugggugaguggguggauaggugagugggugaaugggugaguggguggaugggugaguggguggaugggugggugauggauggauggauggugggugauggauggauggugggugauggauggaugggugagugggugaaugggugaguggguggaugggugagugggugaaugggugaguggguggaugaguggaugauggauggauggauggugggugagugggugaaugggugaguggaugaaugggugaguggguggaugagugggugauggguggauggaagauggaggucugcaucccugaguccucugugggaauccucagguugggaggcagucagagccauaggaggcacugaguccaggugggucgcccauaccuaggccuuguacagacaccuacacaauccuacaccacagucuucuucaacagguauuuauuaagcaccuccuguguuccaggcccaaugcuggguaugaggacacagccaggacaaaagcuaaguugccuacacaacuggaaggcaccacguaaugucucaaaauuagugaacaacuaagacagcuccacuggugauaagcaugaaucagacuuggggcuggggacagugucaggaaggcugguggccaggcuggaaaccccugacuagggacuggaggaggagaaggagcugccagaagauacaggaaaggugaagaucccagggcaggaauguguuugaaggauucaggacagcaaggucaucugcgcacacccauucccccaccccgaggagggguucacacagacccccagcauccgcacgcauaguaccucugguccugguauagguuggacuccauucugaacguggucuccuccucguccucagcccugcagagauaaagggaaagguggaagggggcgggagaggagaaagggggcgguaaagggaaggaagcggugugacagccucagccucugucccaaccucccagccggggcucaugaaccccaggacgcaaggaagggcugggcugccuggcucguugucuuggggagacgggcgggugcaagcccgggaucugggcucugagaguagagguuggaggagcagcagggaaaugggagaccuucggacuuugaggcuggugauggggguaccagagaggguugggaagcugggggugggggcagggcugugggggcagcggggugggggcgggcacccaccuggccuuggaacaccagaggcgguuggccagcaagaccaaauagacgaugaacaggaagccgacuaccgcagccaggcccaccagccacggcuucaggcgaugcuccguggcugcaggaaguuggggagguucgacucagaggaagaaaaggucagaagacccccuucccccaccacccuagcaaggagagagagaaggucacugggggugcuccgacagaggggguauuggaaagggacggagcuucagagaccuggauggcguaggggggucgggaggguuuagagagggggaggguaccuuaccagagugggagggagccugggggcccagagaggggaggggcuuauaaaagaaggggggcuuagaggggacggaguuuacaaaucaggagggcucagaaggggcggggcuuauaaugcaggcagaggcucagggggaggggcuuauaaaggcggaccucagaagggcggggcuuaugacaaaggaguggcucaggggugggguuuauaaaggagaacaagcucaggggaggggcuuaugaaggaggagguggcucagauggggagggcuuauaaagaagagucugggggguuggggcuuacaacagaggagcuguuggggggagcuuauaaaaggaggcagaggcuuagagggaggggcuuauaaaggaggagcucagaggggaggugcuuauaaggggagagggucucagagugggaggggcuuauaaaggcggcagaggcucaggaggaggggcuuauaaagaaggaggagcucagaggggaggggcuuacaacagacgaggggcucagggaggggucuauaaaggaugagugagaaggaggggcuuacagaggaggaagaggcucagauggggaggggcuugugaacuagggggcucagagugggaggggcuuguagaggaggcagaggcucagggggaggggcuuauaaagaaggaggagcucagaggggaggggcuuacagaggaggagggacucggggagggguuuauaaaggagggagagugagaaggaggugcuuacaaaggaggaaggggcucggauggggagaggcuugugaacuagggggcucagagggagaggggcuuauagaggaggcagaggcucagggggaggggcuuauaaagaaggaggagcccagaggggaggggcuuacagaggaggaggggcucggggagggguuuauaaaggaggaggagugagaaggagcgguucacaaaagaggcggggacucagauggggaggggcuuguaaaggaggcccgagcucagaguggggccgagcucaaggcgggggguucagccaggugugcucagaagggcuggagaggggaaaggcucgggugggcgguggggggucccuuacagaggagggcagagcccagcgagagggaggccgggcgguacugcggggguugagaagggccuccaagccacucuuccuuuucuuccugcccccucuccuuuuucucgccauggaaaauugggagauggugaucaccugaccaacuccccuaucccgcgacgcccccucccgccccccugcaccuacccugcugggccuccaccggggagaggagcagaaacuccagcaccagaagggcccccagggucuccaugacggucgagugagccagcagccagccagcggcggucccgggucggcguccacagguuug

SEQ ID NO: 16334 - RNA, 4622 nt, Homo sapiens
ccuguccuccaucccccguuucuguucauucacagcugcguccccgagcacuggaacagugccuagcacauaauagaugcucaguuaaaaaaaaaaagugcagacugagaguuaaaagugaagggaucgcagagagcagcuuuggauuuugcuucugguuggcaguuccugaaggugcguucugugcagguaaauacucccaaaucugugugugcugacccgggagaaggugaaaaggccagacagcuucuaacugagcgucuacucugugccaggcccuaggcgagacucugaugacgacagcgauggugauuuaaaaaaaaaaaaaaucaaaacgaaucauccagaacucuuuaggugauggguucugggcucggcugcgaaaagaugccccacucuguucccuagguggaccguuuccgccgucucuggggagaugacuuucuugaacccauuuuacagaugaggcucaucaagguuugagacccacgguuaaguuuccacaguggccccacaagguuuacuguucauccccccacaaaaaaauguugagaaagugguuugcccugauggcaaacuacagucuggguuucguuuugcuuguuuuucuugcaugaugguggguggggcacgaaucccacuuuuccaucaacucauuggguaggaaugacacccagugaggggccgcuugucccaggggaacuaguggaaauggagcggggacacuggaagcugucagugccaacuggacugggcccugagcacuguccccaccuuccacgcuccacuccugguuccgaguugggguccaaccuuaggguuuggggucuggggugggcacuuggcauuuccgucugguguuggguuuucagcagggaaaacagacucauaggacaggacagaacccccuccccaccgcacccccacccccagagcaaaccuggccucucaggugaacuucuauucagcccucaaagccuucuccgggaaggauucccuaaccgaccucacugggcccuggcucaccucagucccuaccccauucccacccucugcuccagccccaaccacagggggaucgggggugucuacauccagcucuguccccgccaacccaacccggagguuucuuguagccucuugaagcaucaccccaccuggggaggguuuggagcaugaagugggccgcgggaggggguuucagacaagacggggggcuugggcggggguggggccgccuggcggcucaccugggccaugccuacagccucagggcggcugugggcgcggucaguaggggugucccgggucuuugggccgcuucagcuggacuuugagccucuucaugccgaucuggaagccguucauggccuggauggcugccugggcgcuggccggguuaucaaagcucacgaagccugcagaaaccaggguggaccuccgugguuggcgcugcggguguccucggcuuguuccuaugcuguggcccuggcuucccggcucacgggguccugagcaggccugcgugcacaccugcacaggccaggguguuugugguggaggacacacagcagcccuggcuuuguucugacaccucuggacuuguauaccucugaggauggggcacucacuccuuaucuuggggucggcugugcugagacuucccagcugguauaggggccagguggggcuuccgaggguccuggagggccaccuuuuccccaccuucccucaggaggaugccugccuccuuccaagcccucuguccagccaggaucugugucuccagcugacuguguguccacaacuuugucucucucuuuuuuuugcagaagggaguggggacaggaucucacucugucacccaggcuggagugcaguggcgcaaucucagcucacugcagccucgaccuccuuggcucaagagaugcuccugccucagccuccugaguagcugggaccacaggcccauaccaccaugcccagcuaacugucucuguuucucuccccuccccucuuucucucguucucuagcuugagucuuuucuuccucucccucuccuucugucucaucucugucucuuucucuccaucucugucaguaccucugcuccagucucuguccagaggccaucagaaauacuccaccccauggccaggcgugguggcucacgccuguaaucccagcaccuugggaggccaagacgggcagaucaccugaggucaggaguuugagaccagccuggccaacauggucaaaccccgucucuacuaaaaauacaaaaauuagcuacgcaugguaguguccacccguaaucccagcuacucaggaggcugaggcaggagaaucgcuugagccugggagauggagcuugcagugagccgagaucgcacugauggcacaagacuccauuucaaaaaaaaaaaaaaaaacaaagucaagggcugacccuuuaaacaggacagugugagguuaacagucuggucuuuggccggguguggugguucacgucuguaauuccagcacuuugggaggccgaggcggguggaucaccugaggucgggaguuugggaccagccuggccaacauggugaaaccccauuucuacuaaaaauacaaaaauuagccagacgugauggcgggugccuguaaucccagcuacucgggaugcugagucaggagaaucacuugaacccaagaggcagagauugcggugagcugagaucgugcaauugcacuccagccugggcaacaagagugaagcucugccucaaaaaaagccaaaaaacaaaacaaaaaaaaagagucugguucuacuccagguucuucuaccucuuuccugcugugugacuuuggacaaauugcagcccuuuucagagccuuaauguccucugucuuuggguacaaggaaguccucccugaggcucacaaggcccuggucacccuccccuguccccucuccauguucccccuccucccucucucccccuccucacucugcuccagccacaugggccuccucacugcuccuccaacaugucaggcgccguccugccucggggucuuugcaugggcuguucccucugccugggacacucuucccccagauuucccaugccuggugcuccucauucaggccucaguucuuuuuuuuuuuuuuuuuugagucggagucuugcuuuauugcccaggcuggaguacaauggcacgaucucggcucacugcaaccuccaccuccaccuccuggguucuagugauucuccugcugcaaucuccuaaguagcugggauuacaggcacccaccaccaugcccggcuaauuuuuuuguauuuuuaguagagauggggguuucacuguguuagccaggaugucucgaucuucugaccucgugaaccacccaccucagccucccaaaggucugggacuacaggugugagccacugcgccuggccauuuuuguuuuuuuguaugagacagggucuugcuguguugucugggcuggaaugcaguggugugaucauagcucacugcagccucgaccucacggacucaagggaucgucccaccuccaucucccaaguagcugagacuaccagugugcaccaccaagccuggcuaauuuuuuuuuuguauuuuuuguagaaauggggucuugcuauguugcccaggcuggucuugaacuccuggguucaagggguccucacaccucagccuccugaguaguugggacuacaggcacacgccacuaagcucagcuaauuaaaaagguugucuuuuguaaacacggggucucauuauguuacccaggcuggucuugaacuccuggacucaagcaauccgcccaccucagccucucaaagugcugggauuggccaggcgcaguggaucaugccuguaaucccagcacuuugggaggccgaggcgggcagaucacgaggucaggagauggagaccuuccuggcuaacacugugaaaccccgucucuacuuaaaaaaaaaaaaaaaauuagcugggugugguggcgggcgccuguagucccagcuacuuaggaggcugaggcaggagaauggcgugaacccgggacgcagagcuugcagugagccgagauugcaccacugcacuccagccugggcgacagagcgagacucugucucaaaaaaaaaaaaaaaaaagaaacccaaaccaaaacaaacaaagugcugggaucacaggcgugauccacugugcccggccacaggcugguucugauugugauuauuucagcacagcccugucccgaggccgaccaaaacccucccauucccugucagggggcaggcgagggagguggauggggagggguggcgucggcggccacucaccgaaacacuugcucugguugguagcucgauccauaaacaccuuggaggaaaugauauugccgaaggguaggaacaucugcgucagcuccgugucuccaaacuccugggggaggugguagauaaacagguuacagcccucgggaccugcaggugggggagagaaagacauaaagcccccaaggagaggaggcgaacccccccgggggaggggcacaggucuggagcccgcaucuggcuucuccagcugucgggagaggggu

SEQ ID NO: 16335 - RNA, 556 nt, Homo sapiens
ggacccuuuucacaacauggcgccgaaagcgaagaaggaagcuccugccccuccuaaagcugaagccaaagcgaaggcuuuaaaggccaagaaggcaguguugaaagguguccacagccacaaaaagaagaagauccgcacgucacccaccuuccggcggccgaagacacugcgacuccggagacagcccaaauauccucggaagagcgcucccaggagaaacaagcuugaccacuaugcuaucaucaaguuuccgcugaccacugagucugccaugaagaagauagaagacaacaacacacuuguguucauuguggauguuaaagccaacaagcaccagauuaaacaggcugugaagaagcucuaugacauugauguggccaaggucaacauccugauucggccugauggagagaagaaggcauauguucgacuggcuccugauuacgaugcuuuggauguugccaacaaaauugggaucaucuaaacugaguccagcugccuaauucugaauauauauauauauauaucuuuucaccauaaaaaaaaaaacaca

SEQ ID NO: 16336 - RNA, 2146 nt, Homo sapiens
gagcccagucccgggcucccagccugcugcagggacucgcaaccucgccggggcguacacccuucgcccccggcccggcaaccaggaagaggcggcucgcccgggcgcagagcagccggcuccggguaacucuuucauccuccgaccucggcagcagcagggagggaguuucguucuccucaaaccagccccucacccccgguugcuucccacaccucuccguuucccugcuaccucgcagacagacagacaagggacacaaagaaaaaaagaagaagaaaaaaaaaaaaaaaaaaacuaccgccccuccuggucccauccuccagcccggagccgguaggaagaagagggcgaagcacaccuucccuucuccuccccaucccgacgcggugacccggguagaucugggcagccaggagcucugggcagccaggagccccgaagaggccgaaggcggagagguaggguuggaagaggcagaaaucaggcggagcgagcuagagcgcgagagagaagaaaauauccaacaaaaccacgcuaacgcgcccccuaccugggugcaacauacuuuggaaauagaagaugaccaggauaaaggaucccaagcaaguggccagcaccauccggcagauucuguucauccucaucacuuccagcagcgcuggcuucauggcuuuguccuggcugcggggaccgggguguccgggaagcgcgcccggggcgcaggagcagggaccccgccgcgcggaccggagcccgggaggcgcggggcagagcugagcaaggcucagagggaggaucggagucgcuucgcggccgcucucggagcccccagcccgggcagggguguggaaggugccggaguuggucuggaagugcugagaugcguggacccgcuggcugcgcgcuccugcuccuccuccucgccgcuccgccgccuccuccgaucccgccggcggccgccgcugccuggucgcgggccgggcggcuggggugcgagcggugaugguggugccgccgccgcugccgcugcgcuggccgcuguggcuguccgacgggcccucucccuucucuccaaaggcuacuucauugcgcuccaacgaucuauauauuccggggcuggguuuuaccaaaugcaacucgcggcccccggcgaggggagggcgccugcggagagccgggaggagggagggacccuagcgccggggcggagcgucgcgcuccccccgccccuacccgggauauggucgcguccagcuguugcccggggagugcggugugcgcgccgcgcucccgcagggucccaaaagcccucaguccccggccgggcucggccgccgucuggagguugugucagcguuuccaugacaaaacccggaggaaaaaaagacgaagaaaaucgccucggugcugccacccacccccgccagcguuuggagagggaaguggcaagcagcgggcugggucucggagggaagaauuaaggguuaggggguuucugguggcuggcaauuauuuaaaaucccugggcgacguagcggggaaguugccccaaacccccagggagcgagugcccauuuuccgacgcucagaacugggcgguuucguuuuucuuucaaaggacagcccagcuugggagucgggguuaaagagggcugacuuaaagucaggguuaaggaaacugcacgacccucgggucaggcgacagcugagcuuucccggggacuuauacagacagaaucucugacacccaccaucaccaccauuccucaaggcaaaagggaucuguggguugcaaaacucugcuaccccaaaggguagagcauccuccaaauuauucaaaauuaacagcagucuuagcugggagggggugagaaaaugccccuaggaagccaccucaaccaaguccagaaaacugcuggaaaagccaagccagccauagcacuggcagguacauggaaagauggugcugcuuucuuguauuguguagaaugacuuccaguuuccaauuccaugcauuuaggcuguuucacaaucaauaaaguggacacagccaauaguguagggaucacucguaugucagggaaaaaaaaaauguuaguuagacuaaccuuugugccuuaucaagucauuacuaauucaauua

SEQ ID NO: 16337 - RNA, 5065 nt, Homo sapiens
ugaauucugcuuugccaaagcaagauuuuauuaagauaggacuauccaauuuccuuccguuguucuugggacucuguguuuuugcaacucguuugccucugucugcguguugaauucuagagggugcgaugauggaagaauaaaaugggauggaauaauaccaguguccugcugcauugguauucaaauucaguauccaaggcuccacaugccugaaauacagauuuacucugaaauacaguggauggccaacaaauguuuccugauugaaaaaagauggaaggaaagggaagggagagaaggagaagcuagggaaguccuguguggaacaguagagcugggaucagguaccucaucagagaggcggggcaaggucugauaaccccuuuuuucaccguucuacaguaccgugugcgguggggucuggagugagccagaacagauaagucguugccccuugccaucccccaaaacuaugcccaggguagcuggccaggacucugucugcaucacacuccugccaguguauggcauggggccuggcaaauaggagguaccuuuaaaacgcuuguugagcagaacauuccaguugaccugauaguucuucaugaacauagucauucauuuucauugacagaacuuauguuaaaugauacgaaguuauuuugagagguaagugacccugacccuguccacaagaauuauucaguuccgugaauuugguccagcagagucugguuuuuaacagucauuuggccugagcuauugacugcaaacuuuuaagauucuuccaggccgucucauuagaaguugacagcacuuuggcaccacggagaccuacagguguccuuauucccccaccacgcuucugguaaugagaaaugaaagucguccagccucacucagcucacuguguguuccagauuacacaccaagguugugcaaucuagccuugguuuugcuagauacugauccggcuccagauaaaugucauuggaugacaacauauauguuccuuaaaacuccagcuuuuggaguuucaucccaguccuuaccuugcaucucaaucagggacagaauuuuggccgucauuugggaaggagccaaguggacacaggaugguuuuagacgagugguccuaacuuuuucaucugcauuuccauccaguguuggagcuaggacuuccgcaugcauccagacucugcuuucugcucauuucaugaccuuaggggagcuaugaauuccucugggccucaguuuccucaucgguaaagcaagcaagucauggaccuaccucaggcugguugugaggauggaaugagaugcugccugucagcuucuuagcaccaccuaaggucucuggugaugcugguuauugcagcugcacauccaaagcaccuggcgagcuuucaaacaccuuagacacccagacccacggaaucagaaucucuagggguaugcacccaugaguucaugguuuuuaaaauccucagagaugauuugugugccuagucaggauugaaaccacuaauucuaaaggaacuggauucaugggguuuugucuuuaggagggagucuagccaguagagccaacccacagaagcuggaguaagaauacuuggguuccaaucccgguaccaccccuggcuuacccccacaccauauacccuggcugugugaccuugagcuaacgacuuaacuucccuggaagucaguuuacacaauaagaaagugaggacaguauuuaugagcaccccucauagggucauauagggacuaaaugagauuauccaugccaagucuuauauuaaaaagugccugccacaaaggaagcccccaggaagcggugagcacaugauacauguuaacucacucuccagaacaacccuggguaguagauuaugucauuauccaguuuccguauguggagcaucucuguaacuccucuaaggucacggguguuaaacccacucccgagacaccaugacaacacagaacacacugcguugggacgucagcugggucagcugaaggacuugugagugcagcucccugagcugcagcugaccacacaagugggcaacugaauacaguccccauaaagcauguuuaucuuaucuggggcuggagauuagcuguguugugcagaagggaagaggcauuccaggucuuuccagcugucuugccugugaacauuuaucguccccuaguuccgacguuuauuauccccccggguggauagcacuaauucauaccagucuguccgauggcagcaacccccauagauguaugggucauggcggaagagggagaaaccccagacucuugcuauuuggagggaaugagauucugauagucacagcccucagcaaacuguucucuuuggaaccaauacaguuguuuuccuguaagaacacagagaagacccaggcaacucuggguuccagaaaugaaggccuccuugagaagccacauuaacccugacauuucuuucuccccauuucugugggcaaggaacacggcccccaggcaacucuggguuccagaaaugaaggccuccuugagaagccacauuagcccugacauuucuuucuccccauuucugugggcaaggaacacggcccccaggcacugaggaaguccccacugcagcgugcguuagacguacgcaccccucugcaagcacaggcucgcacaaucgcccgcugugucuccugccagccagcugggugaauguucccgggcagccagagcguuuuuccuccccuccucacacuccccuccccuucuccugccccgccagcuccacgcccuccugaauguuccauucuaaacagccacaaucaggagccuguucugcacugggaaaaagagcagcaugaaggcuuuuaaacuugcuggguaauuuaagguauuuaucgcuauuuggagagcuuugcuuguuuugaauccauucccccugcagcucucagaaauggugcaaaugauuuuuuuucccccuugaaaagggaugcuucuaggucuuuccacuguccccgaggccggauucugaaugcaggccuccagaccugggugcauucgcugagguuuuguucauucauaaacguuaauugggcaucucccugcuccaggccuacauuguguuuguagagugcucccccuuucugcaguggacuguguuucuaacucaugcgcaguaaacgaggucagagagccuggcuuugggauccaggcugacccaaggucaagcugcgcccugcaaauuagcugugugacccuggacaccguucucagcuucuccagaacacaguuuuucaucuguuaaauggguaugaugacagcucguagcuuacuugcuuuggaggccagccugcccguguccagaucccagcucugccacuuccuccuccugugagccuggcuuuuccguuuugucaguugauucaccuucagucaggaauaauagccaaucccucaaaagguggcaagagaacugaguugaugcauaucaaauacuugugcuuagcacauagaaauugcucaacucaacaaauguuaguuuagaggaggcccuuaauaaaucuaaguucccuuuuccccucucgcuuuccuaaagcuucaccuaagccaacagcuggacagaggcggaagcuugccaagagagucagaagaaucuggacuccacaccgccugcugcagggccugcuggccucacagggagagggaggaagggggguccacccuggccaggugcacucuggugagagcagcccacagaggccuuguggucucccaacuuccucaguccuuaggaugcuaacagggcuguagcagagcgaguccucaaaaccaaggggcuuccccaccacucugaauccaccagcaaucucugccucugcacggcacccagggcagggugguccuuccccgcuuuucuauuccagaccguccaugaacugccuccauuuccuccacccacccccaacauagccuccuucauggagcauauacacaugugcaagugcauauguucagacccacacacacacacacucacacucauacacacucacacaaacacauccauacacacaugcacucacacuuacacacacacucccacacauacacacccacacaugcacucacacucauacacacacucccacacaaacacauccauacacacgcacucacacucaugcacacucucccacacauacccacacacacacaaauauacucucacacauaccccugcauacacacacaucauacauacacaccacauauacacacacacucccacacauaccccucacauacacaaaccaauacacacccacacauacacucucacacacaccccacauaaacacacacccacacauacauucucacacacacucccacacauaccccccacaccuauacauauacaccaacagaaacacacacauacauacaugcacauacaugcacacucacacacacacucuuuuccagcuuuguguuucugcuucugccuuuucaguuucuuugauuucccacauauggauuuccugcccugccuucugaggguguugggcaggugagaagcccuaagaucauguucagagcugaaaacauaaucaccagauuggaauacuggagaugagaugguagagaauggcuaguuuuagcuuuucucauuaacacggggugggagcagaugaccuuuuccuuuuagcugacagcuagucugcuggccaugggcacacccuccuccgcaaagccucuugugaucuccagucugacuggacacggcuucuugcugcgcccgugauccuaagcauggggugugggugguagggaaaagccuggagcagggcugcuugguugaaaucuuggcucugcaaguuauuugguuuugcugugccuucauuuccccauuugcagaguggggucaguauuugcccugauucuuaggguuguuaagaauauucgaugaggagagccacaucaagugcuuggaaugccugucuacugaucauuacuguuaccagcgcgaucaugguuuugauca

SEQ ID NO: 16338 - RNA, 61435 nt, Homo sapiens
cggggccggggccggaagucacgugcugugacaguagcuggggugaggccgucgucgccgcacgggcugguuggggcugugucugugggaggcgccggggugauggcgguggagacucuguccccggacugggaguuugaccgcguugacgacggcucgcagaguaagggagcugcagggcgagggcugcggguggacgcuccuucggcccgccgcuguucugggcugggcagcgcuccugcgagagggacggcugcgcagccgucuggugcgggacacuucagagcccuuggggugugcgagggacgcgcucuccagcguuacuuucgggguuggggucccagccacggcgggucaggcugcccguucagggcucggcgugugaggcggagacucuccuggggagccugcggugccccgcggggagcggcgucccccuucagcugccccggggcuugggcggggcgcgcccgggaggcccagcggccccgggaucccaggcugcuucugucucuggccucuuggggauuucgccagauucugagcguucagcucuggaggacgcugaugucuggguuccuguuucgguuuccuguuuuucuucuuuuccucccaaaucaacuuuugcaaguuugggugucuuucccaucgcguugcuauaaccguagaagggagcgaaaaaagaacuuuucacccugcgaaaauaaacacgugaaugucauuuuaucauuuuccaggccuuuuauuuaugcuaagugauauuuuucagugauguucugcaguuuccaucgcaguuauaaaggcuucaaaaauuacagcaaaucuucaaauuuugcuucacaagaucgaauugucugauuuuaacuuagaagucuaucccgaaauaaacaaauuguguuucuuucaguaaaauauugaggccaaauuaauuguagugaaacucuacuugaaauaaauacaaguuggcaaucugcuucuuaucuuuggucauaguaaucuguguaagugaucuaagagagauuggagcaugcuguuugugauuuuuuuuuucccucauaguuuucccaaaagguggaacguugcuuuuaaaaauuccggaugaauuuugcuugauuuacgaagagagacuaaugccuacaauguuagaugaauuagguuuuacaagucucucagagaagagugagcuacauccaggauggguugcaguuuuucacaaaacauuccugaggucaggaguucaagaccagccuggcuaacauggugaaaccccgucucuacuaaaaaauaaauagcugggcuugguggcgagcgccuguaauuccagcuacuugggaggcugaggcaggagaaucgcuugaacccggcaggcggagguugcagugagccgagaucgcgccauugcacucuagccugggugauaauaagguauuagcucuuaugcagcauaaaaauuaaccuuggagauaaugacaaaaucuuuuaauuuuuuuuuguggaggggauucuguauuguuauaaagugaacuguaccuugucauauauguuuuauggacaaagaugacgaacugguaucuucaaaaaaaauuggaauagaguuauguuaauugaguuugaaaaugguucagccuggaguagaauggucugauucacucaacagauauuuucuacaaccaguggcugugcuagauauuagggauaaaaagauaaaacaaggagugcagucuguugacaaagaugagcauguuaaguagguuuuuggaauuuuuacucuuaaaaaauuaccauguaguucuuaucucaacuuuuguuauuuuaacuuucaccaauuuuacaaccguuuauugucagcaaggaacuuuuaauguuauuuuagguuuucuguuuccuguuugugaaucccugaacauacuaaaggagugauuuauuggcgugguguuucucuagcauugucuuuuuuuuuuuuuuuuuuuuucgagacaaggucucacucugucgcccagugccguggcaucgccacggcucacugcagccucgaccagcugagcucaggugaucuuccuaccucagccuccuuaguagcuggcugauuuuuucuuuuuaaauugggauagagacaagguuuugccauguugaacuccuggucucaagcgacccaccggccuuggccuccuaaaguguuggggugagccaccaugcccggccuagcauugucuuuaagaagucauuugcuggucaaaugcagcuuugacuggucauuuccuguguaguugagaauaagacaacuauuugggguucugagaaucugggcagucuuauauguaagcuguagggaagagaacaccucccugugcuuggcguucauuaauuuuuggucugugaaucauaucuagacuaauuguuuuccaaaauugccuagauuaaugcuauaauaagacagaaaccuuaaugaacuaaauggauucaccggauuuaaaacuuuaugugguugaagaauaaaggagagugggggcuaggucuuuauacuuuaauacagcaugagucagaacacacuuucucuuacuugcuucacauugcuaauuugaggagagcaaauuuuuaccuuuuuuagaagacaaagguugaauaaaguuauucauaucaauaaaagaaacugaguuggaguugaauuuguuaccuuugggaacaaguaaugaauuuuuauguguaacgugaaauacuuugacgaauaggcauauuuuaaaauccagcuuauuccaaugauuccuuaaaguuaccuaugaauguguuaauucugugaagaacagcauaguauucuguagucaagcaguguucuuugcugguuuuuccaacuugauuaugacaguuaaauaauuuaacaaauaucuugguuaaauuuuagacauuauagaaauaauaugcucaagcagguauaaaaccuccauuuaaaaauauuuagguguauuauuaaacauuaguguguauagaauuaaaaacuacauuuuuaaguguuacuucugugacagacuguuuuuuucaccuucagaucaugaauauuuguuuuugcaaaagaguuguucaugacuaaaagauagaaucaggacauugaauuguuuaaggcacuuuucagauugguucaaagcccucuauuauggggguagaugggcuaguggcuuuuucauaauauguuaggguuuuaagguaguaacuuuauauaugguaacaucuacugcuuuuaaaauuauuucguguauagagaagauugaaagcugaauuguuguuuaacuuuggaacuuuauuuucaggaaguccagacauuccagaguaauaauuaacagugcuuugcgugacuuuugagguuauuugaaguaaauguccugcaauucauuacuugcacuuaucacauacuguuuuaaaauuuaaacuuagaaauucaugccgaaguccaacuuaagaauuaugggaaauuucuugaggaguauaccucucaacugagaagaauugaggacgcucuggaugacucaauuggagauguuugggauuucaaucuugauccuauagcauuaaagguuugauuugauuuuuuaaaaauauauguauauauuuucuggacauacuauauccugaaaacauaauuuuuuaaaauggaaaaaguauuuuuauuugaaaucuaagaacaaaaugaaaguuggagaaaauuguuaauuuccuuuucucuaagccaugcagauguuuuuuaaauguguguguuuucuguuuaagaaugacaaacacacagccuuuagugucaaagaaugacacaaacuccaagucuuugagcuugccuuugauuuucauuauuaagaaaaugagggcuggauagaauauucaggcuuuguuuuuucuugauugagacuauuuuacauagagugaaaugcagauacucuuaauuuugccaaacacuuguaacucauaucccaauuaagauagagaauauuuucaccauuucugaaaaguucucucaugcuauauagauguuaaugugugaguaauuuuuuaauguauaaaauacauuacucuuuccauuuugaaauauuucuuuuaucuuuaaaauuaguuuguuaccacuugaaaaauaauuuacauuuuauugagcacuuguguauuacacacuguccuaagucacacacugacuuguuuuuauaacagcuuucuugagauauaauucauauaucauacaauucacucauuuaaauuguauaauucaguuguuuuuagcauauucacugaguuguacaaccaucacaacagucaauguuagaacguucucagcccccaaaaaagaaaccauguaccgugugauaaucaacccccaguucaugccauggcauaccugcccuaggcaaccaccagucaaucuacuuuuuaucucuauguguuugucuccucuguacacuucauauaaaugaaaucauacgauaugugcuccuuuguugcuggcuucuuuaacuuauguuuucaaggcucaucuauguugucacauguuuuuaguacuuucuuuuuuugcuguugcugaauaauauuccauuguaaggaauggauaaccacauuuuauuuauccauucaucaguugauagacauuggauuuuucuacuauuuggcugcuaugagcauuugggcacaugauuuuguguagacauauauaaguauauuguauauaaaauguguguacauuguguguauauuuuauacauauguauauaugggaguggaaauccuggguuaugugguaacuauguuuaacuuuuugaggaacugccagaauguuuuccaauauggcuauaccauuuuacauuacuaccagcacugcaugaggguuccaguuucucuacauccuugccagccuuuauugucuugauuauauucuuccuagugaaugugaaagcucauuguggcuuugauuugcauuucugauggcuaauaauguugagcaucuuuucaugugcuuauggccaugugucuguuuucuuuggagaaaugucuguucacauccuuugcccauuuuuaaauuggguuaucuuuuuaguauugcauuauaggacaaguauugacuuuuaauucccaccacaauccuauaaaguagauacaaugucaucuccauuuguaaaugagaaaacuaaggcauagaaaaguuaaguaacuuagucaaguaagugacacauuuaguuaaauaaugaauaucaggcagcuugacuccagagccugugcccuuauccaauacccugaacugccucacaaauacuuuauauauuuguaaacugaaauuacuuuccuuugacuucuuuucuugcaggcuggauagacuuagucuuacuuuaaaaaucauccccccccaaauuuguaauugucucuuuuuguuccucaacacuucugugagaaucauuguauguaaguuauaggaacucuacuaggaaacugucauucucaaccuguacuaucucugaggguaauaaguuucauauaucugucacuuggcauuaaguaauacauguugauuuuuuaaacagaugcuguugggcuuucucgccauuaaguaauacuuguugauuuuuuuaagacuugcuguugggcuuuaagggccucuucuagauaggauuauaaaaucuguuuuuuuucucaacucucagauuuuauaaaagggugaaaucaucucuuaguuuuuaucuuccccuacagaagcuuucuaaucuuuacaaucuuauuauaugacagacuccaucuccgcaguugcucucuucggaaccucuguuuaaguucuauuauugggcaguuauuuuauuguuuuuacuauacaagguucuuaguauuuugggaaaaaccacaaacucagauaaaaccucuguaaacaaaaauuacaaccuaaugagaaaggguauauaauaacuuacuugcauaaauaguuaguuaguauguaaccagaagggagaucugagauuucacuugauaaauagaucacauauagucaaugaucaggaagagguggaaauugaacgggcuuuaggagugaacuccacauacuauuuuaaguguuucugagcauggauuuauacaagaaaagauguauuuucugucuuguuucauucuuaauuuauuuugacccuuuagcuacaauaucuuauuaaauuuguggcugcauagaaaauucaaaaaugaugaaagguuuuuccccaugaucauaacuaauggaguuuaauaauguuacuauuaccuuauuaccuugcauuuucuuauacugcacucauaaucagccaccuuaugcuccauaggacaaguagagucgugauugugucauguugggccauuucuuuccuuacguguugucuaaugagauuguuuuggaugaaguaguugauauggugcuaauguugaguacaggaucuaacacaaguuuaagucgaauaaagcuagccucaauuuguguuuuuaaaauuucaguuauuuuucaaauuaaaagaaauguucuuuuccuuuguuucuguagcuuuugccuuaugaacaguccucucuuuuggaacucauaaagacugaaaacaagguacagaauccuaaaucuaaaaaauuguuuuaaaaauguuuuaguuaucuguaacaauuuacuuuuuauuuuguuuuuacucaugaaacuaggucuuaaacaaagucaucacuguuuaugcugcacuuuguugugaaaucaagaaauuaaaauaugagguaauuauuugaauucuugucuuaaaacuuuaaaaacaucauuuagaagcaaguauguguuuauauauguacagugugcaauaaauauuuauugaauguugaaugaauuauuuauuuaacguaauacuaauacggacuaccauucauugaguacuuaguauguacaaaacaccaggcuaacacuguaauccuuauaguaaccccaggagguaggugagacauugaugaggaaacugaagcuuaaagagagugucacuugcauaacaucuuacugguagucaacaguuugaaucuagguuuacaaaccuccagaguuuguguuaccugccauauauacuggcuaucuagagaaaacugauuuuuuuuucuuaaaaugcauuuaguuuuguguuuccuuacccaagaaccauuaaaagucugguagaaguugacaaacuucguauuuucuucuccugcuuuuugauaccaugugguugcucuuuauuucccauaaacuaaugggaggaugugggacagugaggguggucagauaagaugaaguaaaggcuaaaggaaucaagauacagcuuugaguaucaguaauauuuuuguuacucuaaagaugaauugcuuuauaaacagauuuugaauuuaaaugaauuuguaugcaaaugauguagcccucuguuuauuacuaaguauacagaucuaagagagcauaggaauuuggaaacaaaacaaccuuuaaaauuauuuuaauuuuuuucuuaaaaacaggcugaaacuaaauuuuacaauggucucuuguuuuauggagaaggagguaaguuuaaaauuccaaauugugaugccuuuuugauauugaaaugaacaaaaaguuaacagacaauuuuaggacuacuaugauuauauaauagugugagaaaaauaaguauucauauuuuuuguugguauguuugguaaacagguaaaaaagcugaggaagcagcagcaaauuugugauaucuuuguacuuuacgaaguacuguagguagaugagaauuuuccuugaauucauuaaauagugaagcaaauacuucuaauuauuugauuaaugauugucugauuuuucucuuugguguaaaaauucuguuuucaauacuaugcagaguaaaagauguccuaaugaaaaaaaaaaacuuuucccccuuuuuugguauugauugaguuuaaauuuaaaaaaugaaauaugcuuauucauguugccuuuuacagcuacagaugccagcaugguggaaggugauugccaaauucaaauggggagauuuauuucauucuuacagguaacugauuuuuacuuucuacugagcuuuuacuucaaaaaguuugaguaaauuacacaacacguaaaaaguucugaaaccuucaaauacuaaagauguguacucugaggauaagacacuuaauuagcauuggauuauaguuuaggagaucauaacuccuaaaagauuuccaaguauuuuuagaggaaaaagcuaucaaaauaaguuucuuuguguauauuucuuuauggacaacuugucaccaugccuuuuaaaauaauuuaaacuuuguacccacuggaaaagauaaauuguaucaggaaaaguuguuaacggauaggagagaauuaagcuauuacaugagcaaugaugaaguuguuuaaagcgguagcccuccaugcuucuaacagcuuguuucaguuuagauagcuucucaucacugccaguuuuaaugauuguagguccuuugguuuacucuuaucaaaagaauaaaauggcuucuauuuccuccucugugauaaaaauagugcauguacgaugugaaaaagcaaaaauugaagcuaaggaaaaaauacccauagucccaccuccuuucuguuguugaguacaagauuugauauauuucaucaaauuaggcaugcuaacauacuguucaaaucuuuuauaucuuuacuacuuuuuuuggucuaauugaucuaauugagagcauuuuguucauauugugauauguguuauucaggguccugucuagaaaacuccauacaagguauuucaaaagauguaguuuggaggauacaaaguagcagauauguaagaugaguaagucuagagaucugauguacaacaugaagauuacagguaauaaaauaccguauauggcauucaugcugaguagauuuuagcugcuuuugcuacaaaaaaauggguuagcuaugugagaugauggauuugcacuugacuauaguaaccuuuuuauuaucgguauguaucccauaacauguuguauaccuuaaauauacacaauaaaauguauuuaaauaagaagagaggggauucaauauagagaauugguuacccaggaguuggaggacaaagaaaauacugagguguaguccaaaggaaacagauaccuccuuuacauccagagaacaaaaaggauaaagauugggauugccaggaucugggagcuuggagaagaagccccaugaaacugaugccuaugcugagguggcacugccuaucugcugcuggcuucuuuuccagcaaggugucuaaaaaauguaguugguaaggucccaguaaauguggaaacuuugcauuuuucauuuugaggguauuuuauucaguguguacaaguuuagaauuguuaaucauuccugguaaauugaaucuuuuaucaucauuugugaccuuccuuagcuaugaucaugauuauguguauaugauuauguauauguauuuuacaugcauagcaauuuacuguacugaugcuaaucaagucuguuuugucugacaguauaauaauaaugcugcccuggcuccguuuuaguuaacauuuucuugauuuaucuuuuuccauucuggcagccuuucagugucauguuuuaguuggguuuauuuaaaaccacauauaucuaaauuuugcuuuuuuaauguagucugacaauaccuguuuuuuaaucgcuuaauuuauucuguuucuaggucuaucuuauauagucuguauguauaucugggcuuguuucugccuuuuuacuuuguucuuucuguuuguccuacauuuucucugcuuuuuuuaaacuucuagaaguuuaauaggacauguaaaacuauaacuauuuaaaaauaaaaugcguuauuuauuuucauuuuaaaaaauacuuuacaucauauuuagaucucacagcugcauaaaaauuccguuuuuaaacauucaacaaauauguuuuguaagccuaguauaugcuagaaacuguuauuggugcuggugauauagcaaugcacaacaccaacagaaauuccuguucucauagagcuuaaaauuuagaucagcauaguuuuaauuagguuuuaaauacuucagauacacacuguuucuauagguuuaaaaguugagagcuucugaaaauggauuuucagaaagucuaggauauguuagauaugagcuaauuauuuaaugacaaacauaucccuaggauaagugauacgacauuucacuugcugugugccaagccugcuuauacauacgauuacaggugaucaguguuugaaguuauuuuacagugacuucuggaaaccccuuccugccauaguuguacuuucuauacuggcagcuuuugagcuccuucacucacucagauguuuauucauguaauaggguagaaauuuauugagaagcaguugaguguuagucacuaugcuaggcaguggauauucaaagaaggaaugagacagcaccuaucauuuaggaguuauauaaguaacuacaauauuagacuugaaauaggaguaugaaugaaaugcagugggaacaaagagauaggaacgacccuggaguacaggaggugaguuaaguauugauugcuugagggaugcuugaacuugucuggcuuuugguuaacuggaggcuuuauuggaaaacuguuuuguuuuuguuagaguuguuaccauaaaauucaguaaaaaauggugagauuuaaagaguaacuuuauaauauauacccaccuucucguuucaggaacugucuugcuuuguuacgaggugcuaugaaguggugaugaacguaguccaccaguuggcugcccucuauaucaguaacaaguaauggauuuuagaaauauuuuugcuuuuauaauagagaugcagaaaauguucuuucuaaaauuaauaacuuguaauaguuuuucuuucauucagcauucuuugaacacuuaugauauuucaaacacuacuugauguguaucauacguagguuaguaagaugcaguuuccaccauggugagcgaacccauuaucugucugaaugacagugucuacagaacaaucuucaagaaauuugaccauauagaagaaggcuaacauggaauuaguacauguucuguguucucucucuuuauuccuuuccucuacacgaaugguugccugacucuaauggagucacuugagacuuuucuuagacuacagaaucuugagggauggagcuagggaaucuacauugaagaaauuuugugaguaguucuaauggucguaaauauacccaguaaaauauaccuuaaauauacacaguaaaauuuauuuaaauuaaaaaagggaauuuaauauggagaauugguuacaugggaguuggagggcugaaaggacaaagagaacagugaguucauccggaggaaacagauaccaccucuccauccagaaaacagaaaggaaaagauugagguuaccagaaucugggagcuuggagaagaagccucauggaauuggugcucgugccacugaggaggugauacugccuggcugcugcuggaccauuacccuaaaucaagaaaaacgaucacauuuucauagagcucuugcaguuuuaccacaaaauaauaucucauuugauuaguucuuuauacuuaaaauuuuuuuuccacacuuacaaucuaauuaauacauuaacuuuguuuagcucuaugucuagggauuauuaaugaugagaagagauaacugauaccuggaagagauaacaagagcaauuuuggcacuguucuuuuggucaccagcacauucauuguucuuacuauaccaugcugcauauaaacucuuuauacuggaguguuaacuguuucuuauucucccauuuucccccucaguuagguauuuauuuuauguucugucuuuucacuaaagcucucauggcaggagagaaugagaguauagcuuccauacccgcugcaguaccugauggguaguucuaagaagacucccccucauccuaccccugcccuagaaggaugaaauuuauuugaauuuuguguuuaaauuuaaaauaugcauucuaucuuguggaauaucuauaugugcuuuaauauuauaagcacuauuuaaaacuuguugagcaaaaugaguaggagguagaagugaauuuuucuuugacuuuugacuuugguauaauucuaguaguaugcacuguuuuucaguagggaugagaacucaaacccaacugaagagaggacugauuccuaaagaccaguuuggaggcugggcgcgguggcucaugccuguaaucccagcucucagggaggcaagaggcgggaggauagcuugagcccaggaguucgagaccugccugggcaauauagcgagacccccuucuccacaaaaaggaaaaacaaaacaaaacaaaaaaacaaaagacaaagaccaguuuggauaggauaacaaaaauucuaguugguaauugagaaauucuaauaguuuagaaagauaugaauaccacuuuuaauauuucucuaccuuuauuccaagauaaaucauuuggguuucaauggguaagguuauucauaggucaccuaucaucauagcccuacccaugagugggauauaggcaagaauacuauuagguuggugcaagaauuauugcuguuuuuguaucacaguuacuuuugcaccauccuaauaguaugcacaaaguaguucucuucuugggaaaguggacuugacgcucuuaaauuuuaaauaacuagagccuuaauaaagauaaauauuaaaauuccaagaucaucugcuccuguauguauuugaaauaagaauaaacuaugacaaaaaggaaguuuuuuuuaacuugguuguuauuuuauuauaggauugcacccaaaauuauagagacaacuggaguucauuuucagguaaaagacauuuagcuugaccuguaaaacuguaauuauuacuauauuuuacuuuggaguuuguaugguuggagaguaugacagucauaggaacacucuuaaagaggcguguguguguguguguguuuguguguguuugcauuuguucucuuucaucugugaaguugaugagucauuauugaccauuaucaguguaacuuaguuuuucccaguagugccguaaugcagauucucuaaaugaugucuuuggacagugaaauaaaucugcaguauugcaacuaaggaugaaauuuuguucaucuuaaaaagagaaaaguauucucuauuuaagacuaaaagacaaauaguccuuucugaggauccaaccuguagcugaauaaauugauuuacccacuacuuuuacuaauucaguaaucagcccaaaugauuuuacuuuaaacgucuacaugaggcuuaacuucuaacuagugacuaaaugauaaucauuaaagguuuuuugacagacuauguaugagcacuugggagaacugcuaacaguuuugcucacccuggaugaaauuauugauaaucauaucacacugaaagaccacuggacuauguacaaaagguacaccaauuaaaauauuuuaaaauguuucuuacuuugguuaauguauuuguguuaguaaaaaguaaacagauauaaauaauacagauuuucuaaaagaccuggggauugauauuuagaaggagcucauaucaaauauuuuuaugacuacaguaaccauucuuuaauuucacaugaguuuguugggacgaguauaauacaucuguauaaagcauccuaauucuuauaguaguagaaaguuaauuugccuagcuuaggacucagauuuauuguuuuccuuggguucuauucaggugacaguuuuuucuucuuuuucuuuguugagacagagucucacuguguugccaggcuggagugcaguggcgugaucucggcucacugcaacuucugccuccuggguucaagugauucuccuaccucagccucccaaguagcugggacuacaggcgugugccaccaugcccagcuaacuuuuguauuuuuaguagagacggcguuucaccauguuggccaggauggucuccaucucuugaccucaugauccgcccgccuuggccucccaaagugcugggauuacaggugugagccaccaugcccagcccgacaguuuuucuuuccugagcuugguuuuauuuuauuguauacccugaauuuuuuuuagaccaugguuuauuuuauucauguucugaguacuuauuaaaugucugguauguacagauuaugaggcauuuugauugaagaugauauuaaaaagcguaagaaaaucuauuaggauuguuguguucaaauuuucaaauguguagagccaaacaagaaauauaaauauaaaauuuugacuuccaggaaaauuuuuaauuuuuaauuuaagaauuuauuagguagauuuaagauguuucucuuaauuuuccucaagguuacugaaaucuguccaucacaauccuucaaaauuuggaauucaggaagaaaaauuaaagccauuugaaaaguucuugcugaagcuagaagggcaauuacuggauggaaugauauuccagguaaguaggucuguaucagacuguaacaguggggcucauauuagacgacaaagcucagaauuauaguaggacacuuuuauaauauacuguugaauauaauuuucuuuaaaaagugcuuuggcuuaaaauuauuguuacaguacuaaaauauuucuguaucuaguagccaacaaaaugaauaguauauuaguuguauuuggagcaagaguuuuagaaaaauuauguaaauggauaaaaauauuugaggauuaacaucuaaucuuaguaguuagguauaggcauaucuuguuuuauugcauuucgcuuuauugcauuucccagguaauugcauuuucuacaaauuaaagguuuguggcaauccugcaucaagcaagucuuucaucgucauuuuuccaacagcauguguucacuuugucucugugucacauuuugguaauucuugcaauauuuuaaacuuuuucauuauuauuauagcuguuauggugaucagugguuucugauguuacuauuguaauuguucuggggugcuacaaauagugccccuguaagaugaugaacuuaaucgauaaauguuguguguguucugacugcuuuaucaacuggcuagcucuuguccuuucucccucucuucaagccuuuuuauucucugagacacaaccauauugaaauuaggccaauuaauagcccuacaguggccucuaaguguucaaacgaaaagaagaguuucaugucucuuaaucaaaagcuagacaugguuaagcuuagcuaggaagucauaucaaaaguagagauagggccgggcgcgguggcucaugccuguaaucccagcacuuugggaggccaggcacgcagaucacgugaggucaggaguucaagaccagccuggccaagauggugaaaccuucucucuacuaaaaaugcaaaaauuaguaagguguuagggcaagcgcuuguaaucccagcuacucgggaagcugaggcaggagaaucgcuugaaccugggaggcagagguugcagugagucaggaucacgccauugcacuccagcuugggcgacgagggagacuccaucuuuuagggggguggggaaagcagagauaggcugaaaguuaggccucuugcugugacuagcuagccaacgugugaaugcaaaggaaaaauuuugaaggaaauuaaaaugcugugaacacacagaugauaagaaagugaaacagcauuacugcucauauggagaaaguuuuguuggacugaauugaaaaucaaaccaaccgcaacauuaguuuaagccaaagccuaauccagagcaaggcuguaacucucuuuaauucucugaaggcuaagagagguggggaagcuguagaagaaaaauuugaaccuagcacagguugguuuaugagguuuaaggaaggaagcugucuccauaacauuaaagugcaaaagcagcaagugcucauguagaagccaguaaguuauccagaagaucuggcuaaaaucacugauagagguggccacacuuagcaacagauuuuucaguguagauguaacagccuucuauuggaagaugccaccuacaucuuucauagaggaaaagucaauuccuggcuucaaagaaagccagugcccauuugccauucugaaaaucuuagggcccuuaaaaauuauauuacucuacucugccuguucucuguaaguggaacaacaaagccugaugacagcauaucaacauugaggcaagacccuuggccagcaaaaagaugauagcucacugaaggcucaaauguuagcauuuuuagcaauaaaguguuuuuuaauuaauauacuuuuuuuuagacauaaugcuauugcauacuuaauauacuauaguauaguguaaauauaacuuuuuuuuuuuuuuuuucgagacggacuuucacucuuguugcccaggcuggagugcaguggagcuaucucggcucaccacaaccucugccucacggguucaagcaauucuccugccucagccucccgaguagcugggauuaaaggcaucuacuaccaugcccagcuaauuuuguauuuuuaguagagaugggguuucuccauguuggucaggcuggucuugaacucccgaccucaggugaucugcccaccuuggaaauuggugucacucauguuuuugugcugguugggaacugaaccuaugguuucugugaggugugccuguauuguguuugcuguuaaccucuagguuuagguuuuuuuugguuuuguuuuuguuuuugagauggagucuugcccugucacccaggcuggagugcaguggcguaaucuuugcucacugcaaccuccgccuccuggguucaaaugauucuccugccucagccucccgaguagcugggauuacaggcguccaccacugcacucagcuaauuuuuguauuuuuaguagagacgagguuucaccauguuggccaggcuggucucgaacuccugaccucgugaucugcccaccucagccucccaaaguccugggauuacaggcaugagccaccaugcccggccagguuaagguuuuuaagacaacccuuaacaagucuguuuaauucuuccuaggcccagggaauguaauuuggguuugcacagucuaguaugguagcuucuaacuacauguggcuauuuaaauguaaauaaauuaaaaugaaauacaaaauucacuuuuuuacucacgcuagccacauuucaaguccuuaauagccacauauaguuaaugacuaguuauaucagacagcacagauacagaauauuuccaucaucacagaaaguucuguuggagagcgcugcuuuaagcagguuccacucgaaauugcauuauauuccauuuauaauauacuucaagguuaccuuuaguuuauguuuuacaugaucacaguuuuuaaccgauugaucucaacucuuguuuacaguugacccuuugaauaacaugcuuuugaagugugcacggguccacuuauauacagauuguuuuucaauaaauguauuagaaaauuuuuugaacauuagcaacacuuuugaaaaaaacuugcagacaaauggcauagccuagaaauauuaaaaaaacuugaggaaaaguuagguaugucaugaaugcauaaaauauauguagauacuaaucuauuuauguguuaauugacuuauguuauccauaaggcuuuuggucaacagugugcuauuacuaguuaaguuuuuggguagacaaaaguuauaugaagauuuuugacugcacgagggucagugucccuaacuuuauguuuaagcgucaacuauauaucaauuuaaauguuaguucauuagguuaagaagauaauuuuuuuguuauugauucuuuuuccaggagacauuucuauacaugcuauaauaaagugcuaggaaaguaauuguaagcagaaaacauaaauucuacucuuaaaagugcaaaguaaaauaaaaaauaugcuuuaucuuuuauacaucucugaacaucguguguaucucuuuauacaggauuauagauuuggguucaauuuuauuacuuucacauaacuaguacccaaauauauaaauacauauauauuuuucauucacaaagaucuaaauauuagauuagauuaagaaccugagcuuuaguuuuaguaaaauuuaaaugaugaauauagaaauuuaucauacacuguauuuaguguaugauauuuaaauguuuaaucguuuauuauugagagucugaauuucucuuucaauguuuccugucuaggccuguauagaacaacaauuugauucucucaauggaggaguaucugugucaaaaaauaguacuuuugcugaggaauuugcacauaguauucggucaauuuuugcaaauguagaagccaaacuugguaauguaaaucgcauuuuuugguuuuuguuuauaaaauuugcauuuccuuaaaagcauaauugaaguauauuuguucugcuuucucuuauguuauugauuuguaaggagaaccuucugaaauugaccagagagacaaguauguuggaauuuguggacucuuuguauugcacuuucagauuuuucgaacuauugauaaaaaguuuuauaagucuuuauuggacauuuguaagaagguaagaacuugaaacuuauuuuucaauuugagcagauuaaaaagauugcagauaaaacuaaauauuuuaaaaugcauuuuauuccuguuuacaaaaauaauuuaaaaguauucacuuguaaaauucaaguauuccagaaauaaguaacuuagugaaugaaaauacgucguauuucuacaucauauuacuacauauugguagaugguguucagauuuguuccuguacaacuucucuuagugcuacuaauacuacuuuuuucuuuuccuuuucuuugccacugauuuucauuacugaagaugaagaaauuuaaaauauauuucuuucuaugucuuugcuauuuucauaaugugguaucugauuucaaaauugaaagauuaguuuguguguaacaucaagugauaguaacuaugauaacccagccaauuuuuuaaaaaacuuauguacuuaaauagaaugaaacuaaaagacaugaagauucaaguuucuauuguugcauuuuuuuaucugacaguccaugaaaggguguuuuguguguguguuauuuaauauucaggugaauaaaauugucaugcucaacaccagauguagaaaugccuuaacucugccacagugaaagauauuugucucauaauauauuaauaaguauuuuuugugguuauuuuuucuugaaaucaguugucuuccauguguauuauagaacuuuuaaacagcuuguuguuuagccugcauuuaaugaauuuuccccuuuucccuuuucuguuucagguaccagccaucacucuaacugcuaauauuauuugguuuccugauaauuuucugauccagaaaauaccagcagcugccaaacugcuagacagaaaaagucuucaagccauuaaaauacacagggauacuuuucuacaacagaaagcucaaucacuuaccaaguagguuuuauaaacaaguauaaugaaaauauuuagauauccuuuauuuucaaagauuauacuaacacuuaauguauaguaccauuugaauuauaagauuaaauguacuugauaaguaagggucaggcaaucuccaggagauuuguuuucuagaaguuuuuuguaaagaauauuuuacacuuaaagucaauuuaagauguagacagauuauacuuuauggauacaaaugcguacauacauaguuuuuaucaucuguguuaaauauuuuuuguccaaaugaagucucagauuuuguugcaguagauaucauuugaugacauuaaaaacauucuguguccauggugauuuugggagagguugaguuuuucuugaugugcuuccuuuuucccccuucuuuuuauuuuuaugaaaauaguauaugcauguauauaaaacaucaaaaagugcuaaagcuuaaagggaaagauaauucuucccaguuccuuccuguauuucagucuugcucuccaaaggcacacuuuuaacucuuuguuucuucuuuuuuuuacauccuuauuuuuuguauacguccuuauuuuuuaucucuuauuguguaaauuuucaaauauacguaaaguagagaaaauaguauaaagagccccuacguucccaucacccagcuucaacaauuaauuuauugcacauucuuucuugaguacauggcuaaaaucacguuaacuuggauaaagcuuuugagugaaaugacacaggacucugccacuagccccaugcuggugacagauuuuuguuugugauauggcuaaagauguaauggggauacuuaccuacuuucuguugauuuugacuaucaaagggaaguuggaucacuacuauacauugggggaaggaagaucaugucauuuuuaguacugccauguccucugauuaaaguggaaaacuacaacagauuuaggcaggucuacucauuucagaacucuaguagauauccuaaaucaggguugaagagggauuaaaaacaaauguuuagauuuagauuaaagagcugaauuaaguaauacaagauauauguagagauuuaucuuuccauuugaguagcaguaaguggggaaaaauguguguauuuuaguucuuagaauguugauauuuuguaacagugugauggaguuacucaaaaugccaauacauacuuagcuuacauuaauaacucuaauacccagguuguggaaacuaguuaguuauaguacagguugaguaucccuaauugaaaugcuccaauacuggaaacuuuuugagugccaucguaaugcccaauggaaaugcucauuggagcauuuuggauuucagauuagggaugcugaacugguaaguauauaaugcaaauauuccaagaucugaaauacuucuggucccaaccauuuuggaugagggguacucaucauguaucuaggucaugggaauugauaguugcauuaaauuccguuuuguuuuuuuuuuugauuuuuuuuuagagaccgagucucgcucuguugcccaggcuggagugcagugguguuaucuuggcucacuguaaccucugucucccagauucaagcaguucuccuacuucagcucccaaguagcugggacuacaggugccuaccaccaugcccagcuacauuuuuuuuuuuuuuuuuugagacagagucucccugugucgcccaggcuggagugcaguggugugaucucggcucacugcaaccuccgccuccuggguucaugugauuuuccuuccucagccucccgaguagcugggauuacaggcacccaccaccacgcccggcuaauuuuuguauuuuuaguagagacuggguuucaccacgucagucaggcuggucucgaacuccugaccuugugaucugccugcuucagccucccaaacugcugggauuacaggcgugagccaccgcgccaacgccuggcuaauuuuuguauuuuuaguagagacgagguuucauuauguugggcaggcuggucuugaacuccugaccucaggugauccgccaccucggccuuccaaagugcugggauuauaggcgugagccaucacaccaggccucuuuuuaaaauuguuuuuauuuuuuauuuuuaaacuuuuaaguucaggauacaagugcagguuuguuacauagguaaccaugugucauggggguuuguugugcagauuacuucauaacccagguauauuccauggaauuuuuauuggucagaucauagcugguguuugguggugccauguuuugagagggucacaaacugcagcaucccuagaugcagcugaucaggaugucagaaggucugagaaccaugccuucuuguuugucuucucuuuguuagugucuguauaguuuggccuuuaaaagagaaaucuguggaaugaugugguggguuucuuuaaauauuugagggacauucagaaugaagagggaacagauuugaucucuguggcuccaguaggcuaaacuaaaaccaaaaggugaagaugacagauaguaaugauaauaauugccaacaucaugaagcucucaacucuauggcaggcauuaugcuaauagcuuuaaacauaccauguuccauaaagcauguaacagccuuccggcagaaaauaauaaauguaacaauuaauguuuauggagugcuuacuauaugcuaguagguauuccaggaacuugacacauaccuccuguaaugaucagaaaauuguaugagguagauacuuuuguugccauuuuguagaugagaaaacccuacagagauuaaacuugcccaaguuuaaacaacuaguagguggcagaugcaggcaguucaacucuacagcccaggcuguuaacuacuacuauaaaccauuuuuaucccauuuuuagauaaaaugagucuuagagaaaugaacuuugccaggucacacagcuaaguacaugucagagagggcauucaaaccagugccaauccuauucuggugccucugcagcagguagcauuguguaggcugcucuguagucuccuucacuaaagcuguguaggcagaauauagauaacugucaguccaagaucugugggaagugagucuuacuaaguggacaguugaauaaguugacuuucaaagacuuaucacaugaugagauuuuguuucuaaauucuuuacuacagagcuccaugaagaugaagggcacaguuauuuuuuucagucucuuagcaguuaugucaaggaaaccuaaaauucacuccacuaaagugaaacucagagggaugaugugaucagcagggcuuuguccugacauuuuagagaaaguugagggguugucuaagaggugucccaaggucaggcuucagaguuuauguaagugaguagggagcaauggagagcaaugagcaacaguauuccugcccccauacuauacaccagaccccaaguggccagugucccagcugccuccuugacugggguccaagguuuguggauuuuugcauuuugcuuuugauucacaaccacuuuaacacuggaaaauacugccuuuagaggacagaggucugaaucuuuguuucaaccccccauguugacauauaggcguugacacuguuuagugcuuuauguuggggcaggagauuuguuuuuuuaccuugguauuuuuccuguuuguacuuugaaaugcaacugacaauccaauaggacacuucacgauuuuuguacucuuugucaguuaacuugcuuuuuaaaacuugaagcaguuuuguuuuuauauauuuauuuauuuauuuauuuuuuuuuuuuuuugagacggagucucgcucugucucccagguuggacugcggacugcaguggcgcaaucucggcucacugcaagcuccgcuucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcgcccggccuguuuuuauauauuuauaagagguaaagaucaucagucaucuggaugugaucacagagugaugggcagaagugacauaaaagccucugcauuauccuauagccuuaccuaaagcuggcugaaugcuguucacuguguauuauugccuucuucauaguguuauugacacaguugcucaucagggagaguuccauagucuagccuaggucucuuucugugguccuugcuuaugacuuuucuguucucuccuguacaugggauuccugcugagucuugaucacaaccuccuccucaaaagugaagguguugcucuaggacugugcugucuguuuuuaaaaaaggaccaggcuuuuaaaaaaggaaucauucauaagucaaacaguauguuucagcaccacucuaagcaaagccacaaaguaugacuauuuguguuuuucgucuaauggaauuauggcucuguagaaacuguuuuucucagauuuugugcuaggguuucaccucccugagucacauuuauuagagauuuugacaggauccuucuuuagauugaaaucuugagauugacaguuugcccagcaauauggcuagcugcugaccucagugugggauucuaaacguaauugagugucuucaguuccuugcccugaagagcuauccuuuagcugauucugaccuguaagaaugggacauuucuuuacccuguguaacuaaagaagauuuuaaaagaguugguaggguccgauuccauaaaggagaauugcccauuuuugcauacuaaguuuuuguuuguuuguuuguuuuugagacggagucucgcucugucgcccaggcuggagugcaguggcgugaucuuagcucacugcaaucucuuccgccucccggguuuaagcaauucucuugccucagccuccggaguagcugagacuacaagcgugugccaccacacccagcuaauuuuuguauuuuuaguagagaugggguuucaccauguuggcgaggcuggucacaaacugcugaccucaggcaaucugccugccucggccucccgaagugcugggauuacaggugugagccaccaugcccggccacauacuaaguuuuuuaaagaaaaguauagcuuaaacagcuugugaauguaaaaagguucccaucuggaaugagacugaguugggaaacauugauggagagauuuaguauuuguaaucaucccgaauaguagagagaauuacauuuuguauugcccuagucuuucugggaggggaaagcuuccuggaugugagcuugaaucuuggcugaacuuaugaucuugcugccuacuuaacuucucuguguagcaguuucuuguucuguuuggagguuguaguaccugccucauaaaguuaaugugaggggugaaagagguaguguguguguguguguguguguguguguguguguguguguguguaaagugcuuggaaugguaccugucauguaguaagcauucaauaacuauuagcuuuuauaguccgauucugaccacuuccacuguuccuauucugguucaggcugucauccucuuucuucugcauuauuacaguagcuuuuaggugguuuuccugcuuuuaccauugccuccucuguaguuuauuuucaacucaucagauccucuugaaacuaaacuuagaucaaguuacuuugcucagauccucuaguggcuuucugucucucugagucaaaaucccuacuccuuguaaggccuuccacaaaucccuuccccaucaccccacucccucccucuguaucucgcucaucuaaucccugcucacagugcuucagguauacugacuuuuuuguuauuaccugaacaagccagacacauuuccaaaugucuuaggauuuugcguuugucuuucacuuuucugcacuucucguauauuugcaugaauuacucauucaucugcuucaaacuuuggcucaaaaucaccuacucaaugagccuacuuugaucaugcuauauaaaauuguaccuccaccccaguccuuauccuuuuuccccugcuuuuauuucuucuguaguauguaucuuuuaauuaauuuaaaauuuuacuuacugauuucauuauuauacagcucuccuuucuagaauguaagcaucaugggaggagggauuuguauucauuuuauuuacugcugauuucacuguuguauucucaguaccuguacugagaaacaguaccugggauguuuguugaaugaguaaauuauauaugucuauguaauauuuaucuuuugaaaaccagaaagaugaaaugacugcugcagggaaauaauguacugcaaucaguaucaagaaauggaaguaaauuuucuuugcugaguaaccccaauauuuuccuuuguuagagauguacagucuuacuacgucuuugugagcucauggaugaugaaaauggaaucuauuuugucuaaagagcagagaauggauaaauuugcugaagaucucaccaauagauguaauguuuuuauacagguaguugcaucuuauuucggggaaucauuuuuuuguuaauccaacuuacagaaguuaaacuuugaaaaaacugaacaaaggguagaguauguuuuuguuuauuaaagcaaguugauuugguuauguugggaucugugugacuuauuaauuuaaauuuucuaacaacccauucaaagcucuauauuccuuuacaacuugacuauuuagcuguaucguagaaguuuugauauguuguauuuuuacugucauuuauuucaaacuauuuaaauuuuuauuauaacugugggcuuuuugaaagauuuccuuauuuugaaauauaugaggauuuucuaguuauuuuauuauugaguuguagcaauaauuaaauaauuuuaguauuuugaaauuugcuuuauggccuagcccauggucaacuuugguaaacauuucacgucuacuugaaaagaauguauaauuuguauuugucaguuguagcauuuuguauaugacaagagggucauacugauuaaugauauugucuggguauuucagauacugagagucauguuagaauuucccacuauuguggauuugucuguuuauccuuguucuguaguuuuuguuuuguguauuuuuaggcuaaguauauaauguuuagaauuguucugucuuccuaguaaauuagaccuuuucuuguuaagaaauauuccuuguuaucucuaguaaugcuuuuuguuguaggucucuuucgugugauauuaacuauaacuguuuucuuuuaauuaaugucugcaugguauuaucuuuuuugauccuuucacuuguggccuuccuggcuccuuauaguuaaugugugucuuccguaaguaacguauauuuuucuccuaucugauaaucuuuguuuuuuuuucuucauaguacuauuuuuucuauaugucauuguugauauauuugguuuuaaacuaccaccugacuaguugcuuuguauuugucucacuuguucugugucccuuuucuuuuccucucucgcucuuuuuuggaguauuuuuaauuuuauuucuccuccucucuauuaguuuaauucuauauuauuuuauuguucuuuuagcggucacucuagacauuuuaagauguaucguuugcucauuuagcucuaauguauguuaguaguuuuaccacuuuccugacgguauaaggaucuuaaacagcuuuaguucuauuuaucucccucucaucuucugugcuguuguuguguacuuugaguuccucuguauuuuaaaccucacaaggcauuauuaucgcuauuguuguuuuuauagucagcguuuauuuagauuuacucauauuuaccuguucuguugcuuuuuauucuuccuacaucucuuaauuuucaucuuucuacuuggggaauaccugcuaguauuucauuaauacaagucucuguugaugaauuguaauaguuuuuggucugaauaugucuucauuucaaucauuuugcuguguuagaauucuagguuggugggguuuuuuuuuuucuucuagcuuuuaaaggugucauuuuauggucuucuggcuuccuuuguuuuuguuaagaagucaacuguagguuuguugcuucuaaaauauguaucuuucuuuacuuuuuggcuuuuagcaguguuccuacaaugccccuaggugugguuuucuuuguguguuugugcuacuuuggggucaguagagcuucuugaauucaugcaauauucuuuaccauuaacucuucgagcauuauuucuuuucuguuuccucuguucuaauucucucuucaucugucucuaaucaauucaucuacugaguuuuaaauuuuaauaauuuuacuuuuuagcuggcuuuuuuauaguuuacaguucucuucugagauacuugauuuuguguuuuauuuucuucaacacauucagcuuauuuugaagcacaugucuaauaauuucauuauuuggguauuugucuuaucuguuguuucucuuguuuuuguacaucucuuaccuuuuauauacccaguuauuuuuuauagagugccacacauuauauaugaaaagcuguagacguaauuugaggaucuggauauuuucuuccuccagaagggauuuguauuuguauuuguauuugcuuuuguacacagcuagucuaggacgguuagcaacccagguuauaucaaucuaguagguugaucaagaugauuugaagcaggauuuugauccugugaugguuguuuaauucacccuuacuuuuuugggggguuauccuucaggaugccaacucagaacuuaggugguuuaugaaaaccagcuccgaugagccccaagcuccuguuuuuauuucccuucccugugagauguuguugaaagguauguuuggcuuuugucuuuaaggcagaugauuuaagagaaagcaacccugaaugccaggaucacuucucugaguuucugucuuccagaucuuggccuuauauuuccuuauuuauuugaauccucuuugaugccuuaugaggcauuuuuaaaccguuuugcccauauauucuaguuguucucagugggaaggcugaucuaaauuauuuauucuaucauuaacuaauacagacuccagacuacccucucccucacaauuuagauuucaaaauacaucccuucacaaauuaaugguuaucugggaaugagcuaauaugggcccuggaguucugaacuucaaguaccccuaaaaaagggaagccuccuuuuucugccugacuuagaguuagaucuuugcuguuccuuguuugugcuuuuuaauuuuucccagggcugcacuagaguagggucugauguaauagucuugcagcugacaagguaagacuguggcucuuucugcauguaugugccaagcuuuggucuuacggucaccuuucuuaggaugcuauccucucuuugauuuuuucauuuucuuaauuuagcaugucucuucgccacagagaaacuuugugugugguucagaggaacuccuacuuugcgcugaguaucauuccuuuagugagccacuguuuccgaugggagaauacuuucuuucacauguggugggacaggagcaaaaguuugaggaacauuggcauauaucuucugccccaccuccauaauguaucuacaauaacauaguuaagguuccuugcuaaacuguacaugugucucuuuugggaacuuuauagacccaaagaaucuccaucauuaucuuuguguuuuucugugugucccuuuuggguuuaaaugaaaaaguguuugagaagcaauaucccuuuuuuccuuuauuccacuguuucacugaguuuaauagcauuaaaagaauuuuaacaccucacaagaccuggcuuccuucaugaauagaaggggagggagaaucuguucucauugggcuggaaggagagaaagccuaaugcagcaccaaacuaggcaaggaugagauagcagauggacuguggggauuggucuaggugaauaggaaagggggacuuggcuuggaacucaaaaauuucuuugccuaucuguauugacugaagaacagcccucuuucuccuuauuuuucaauuuguaacuccucagaguccucagcucuugccuuaaguggcaacagauaggagucuuuauucucuucccuggcagguaagauaaggaugaauagauaccuuucuaacauucaaauuguuucacucaaagcuuuuuuaagggaaagauucuuaagcuguaauuauacacuauuauuuugacaguacaaaacuucugguaugugacaggauaaauaaacgguuagggcugcuuugaaacuuaaccaccauguauaacauugucucugugaggaagaguauuuccaaaucuuaagagcuggcuuuaagaugaacuuuagaaacauuaguuauugguaaguugaggaauagcugcuguuaaauagauaaugaaaucuugaagaaaaucuuuccuugugauuauaaucaauguuuuccuuuacagggcuucuuguaugcauauaguauuaguaccauuauuaaaaccacaaugaaucucuacauguccaugcaaaagccaaugaccaaaaccucaguuaaggcauugugcaggcuuguugaacuucucaagguagguuuuagauuauuuuacugcuccaucauaauugagaaaugacccaggcuuaaauuaggauaaucuuguaagguuugacuacaugauuauaugagaacagaaaauugugagaaaguacuucucucucaauugaauaaaggaacuagccauuuaaauaaauuucugaguaacuacuuauggcuggucauuauauuuaaacuuuauuaaauaaaguuaauauauccaguuuacacaguaaaaaaaaaaguuaauguagugagagagaaaagaaagaaaauggaaaaguuaacuuuaauauuaucaguaaagcuuuacucuuggaaguuuuaaaaagguugcaugaguuaaaaaaaaaaaaaacagcuugucuaccauuauccauuauaguguuuacaugcguaugagguuaguuaacauaaggcuauuuauuuuguaauuuagaugaagugcuguaaucuugugauuugaacaguggacuacuuacagagguggucaaaugaauuaagaauuacagugcacuuaugcaaguaugguaacguguuucuuagcuuacuucuguauuaaagaaaaaaccuguaggcaggaaaguccaguuaaccuuuuguaaaaauugaaauuaagauuugcugguaaauuuucuccuaauaauugacuagauuuguucaggaaauaaagauuuuucuuuuggagauucugccuuuggauuuucagccuuuuuuucuuuguaugauuuguuuauagauauuuuauguuagauuuauuuuuuaugaacuauaaauacagacaaguauauguguauguuagaauauguauaaauauguaauacauaagcaugguuuuaaaaauaauaaccacugucccacuuaagaaauacccacugucccacuuaagaaauagaauguuaccaauauuuucaaaugcuguguuuuuuccuaauugcaucucaaccuguccaccucagaggaaacuacuguccugaauuuuauguuuaucauucucuuguuuuucuuuuuagcuugccaaauauggaugaaucaauaaagcauuaaucguuauauauguuuuugaaguuuauauuaguggagcaguauuuuauguauuuuuugauccauuuuuuuauucaacauuuuguuuuuuacucagcauuuuguauuugaggguauccauguugggaugaguagcacaucuauuuucauuguuguguaguggauagacuucggguuguuuccgguuuuuguaucauaaacaauguugccauccuuguauguguuucuugguguacuugugcaggaguuuuuguaaggaauuauauaccuaaaguugguuacuggauuauguguuacguauauguucaccuuuucaagaugaugucacauugucucuauagacagacuauauauauguguguguguauauauauauauauauauauauauauauauaugccucccacaauacauuagaaaauuacauuagaaauaaaauuguauuuccaauugaccaacacugguauuaucgagcuucauuuuuuaaaauaaauuaguggguauaauugguuuuaugauuuuuaauauuuaaccccugauuguuagugaugguaaauauccuuucaauuauuuauuaacuauguuucuucuuuugugaaaaaucuguucaugucuuuuccauuuuuuuuauuggauugugugccuuuaaaaaacaaaaucuuucauucauuuugggucuucuuauauccugaacauuagucacuuguaccugguagauauuuugugauacaucggcuugccuuuuuauuuucuuuauagagacuuuugaugaacagaagugcuuaguuuuaguauaguugaauuuaucaguucuauacuuuguaaguuuuuuuuuuuuuuugagacggagucuugcucaguugcccaggcuggagugcaguggcgccaucucggcucaccucaaccuccgccucccagguucaagcgauucugccucagcuacaggaacuacaggugugcgccaccaugcccggcuaauuuuuguauuuuuuaguagagacaggguuucacuauguuggccaggcuggucucgaacuccugaccuggugauccaccugccucgaccucccaaagugcugggauuacaggcgugagccaccacgccaggacuguaagguuuuuuuguaucucauuuacaaaucccuucccuagccuaaggucguaaagaucuucuauaauuuugccugaaauuuuuaaguugauugucagaaaauuauuucugauucuuuuuaggcaauagagcauauguucuacaggagaagcaugguuguggcugauucaguuucacauauaacacagcaccuucaacaucaggcucuucauucuauuucuguggccaagguaugcagcuuauuauguauuuagcauaaguauguuaucuuuuuuguuuguucuuucauuguuuuauauguguuuucugguuuaaccuguuuauuccauuccuucaaacauaauaugcucgguuauuuaucuccauaguauuuuacaauuuuuacuucaaguuauuggcauuaucuuuacugugaaauugcagcauguaauacauuaauacacuucuaaaaagacauugcacuuuugaaauugaugcaucauuuaaaaaaugauuucuuaguaaauuaacauggaaauuuuaaaguaugccuaauacauuugcuguuucugacaguacuaagggaucauauuacagaaguaaaguauaaaugucagaagcuuaaauggggaaaguauuuguguaugcucucuuaaauugaaucauggaaaagauaaucaagaaguuuuucuucugagucuuuuguuacugccucagaaacaaauaguuuuccuguuuuauuuuuaagaaaagagugauuucugacaaaaaauacagcgaacagcgucuugaugugcucucugcucuaguuuuggcugaaaacacucuaaauggaccaagcacaaagcaacggcgacuuauuguuucuuuggcacuaaguguuggcacacaaaugguaaguguauugcuauuacuuauggaacagaaaugagaucugagauuucacaguucccuuguuacugacccuagaaaccuuugacugcaacuucucugccuuuuuuuccugucccugauagaaaacauuuaaagaugaagaacucuuuccacuucaaguagucaugaaaaaacuggaucuuauuagugaacuuagagaacgguaaguaggacugggauaugcugugguacuccaaagacaggguuaauagaaacauugauuuucuuuuuagcauagcaagagaagaaauaaaauucagaucgagcauuaguuccuuucuguaacuucuuuagcaugaccaaaaugagauugugacuagggaucauauuuauuuagcuuugcuucuacaggaagcauguagccccuagaaaaacucacaugagaaaaagcagugcaaccucagagcaucuggccgacuuugaugcauaucgugauuauuauguuggguaucuuuauuggacuuaaauugcuguauuauaacagggcuuccucuauuugugugagacuuagcaauccaugauacguaguguucuaugauuuuauuuuaagacacgaauuugaauuaacauuguugaauuaguuuuuggaaggcuuauuuuuguagcuccuucuggcuuucuuguuuucuuuuuguugaguaagcguaaauuucuugaagggaaauuugaauuuugguuuccagcugaauuaagguuacagcacaauuuccauuuaguauucauauuuauaacuuacuuuuuuguuguucuggagaagcugacauuuuucuuguuauuggcauuuaauuuuccacucuuggaagaaauauugagccuuuuucauuauaagauaguuaaugaucauucuguugcccuuuaaggugugaaauagucacuuggcaaagauuguagacauguuaaguguggguuuuuuuuuggggcggggggggucacaauuuuuuuuuuuuaaaagauuuuucuuuccaacuuagagucagggaaaauggagcaugugaugcaaguauuuaagucuagucauagcaaauaauauugaaaaugaguuuguuuuuauuuaccaaaaccaaaaauggucaauaaauguuuauuuuaaacucugauauuugaauauuaugcauaucauuuuucaaguaugguuuacaaaagcauaugugcagaauucugacaaugucaggcauuggaguguuuguuaccuuuguuucauuuugauaguauuucuuuugugacuuuucuauacuauguuggguuaagugauguagggaaugcgaacuguguaagauggaacucuuccuucuguaguagaugucauuccuuucauauuguuuugggauucuucaguuuuggugugacugauuacuacuuuacauuguagaguccaaacacaaugugacuguuguuuuuuauacuggcaucgagcugucuucccaauuuauuuagaugauguauaugaaaaugcuguugaugcagccagauuacauguaaguaaagaacaauauaaagaauaauucuaucauuuuaaaagucacuguguaaaccguuuuaguuuaaaauagaucauuugauuuaauaaacuuuuaaaauugacuguuuuguaaacugcauauucauaaaguguuuauagucuguaguuaaauuuuauguuacuguuaacgaaguuaauuuauuuaauuucuuccuucauguuccuaaucauuuucauuucacuuaauuuuaguuuaugucauaguaaucugacauuuacucaucagcaaauuacaaugcaaaagaaaaaauauuuuuaagaaauauucauauuuuucuuuauggaaauaaguguguuuaaaugcacaagauaggaaaggacuagcgaaugugauuuuuuuuggguauauuuaguuaaaguauaugcuuuagguucuuuuucuuuaggaaaguuaagacaguuguggaaaaucauuuuuccuucagaucgagguuuugucuuucaagauaauuaacuuuugcaguauuguuuagauuagagaccugguuuuucuaaauucauguacauuuuaauuuucuucuuaguacauguucagugcuuugcgcgacuguguaccugcuaugaugcaugcaaggcauuuagaguccuaugagauacuucuggauugcuaugacaaggaaauuauggaaauuuuaaaugagguaacaucauauuugagauugaaaagcuuaaaacauguuuggaauguaguguuuggaaaaaaaauguucgauugaagcagacucacugaguuaaaauuauuuauaaauugcuggguagaacaaagaacuauuuuuaguuacaauaucacuguugugcuaauuggucuguaauucauuuauuuagaaaucacacuaggaauuaggagauuuuaaauuuacuuuuguaaauagauauuuuaauuuaaaguuguuuauuagaagaaugcaaaugugaaaugguuuugaauguugaaagcugcuaaugguccaguuaaagcaacuuaaccauuaauauuuuacugaauuuuauuugcagagcuccugagagaaggaaauuauauauuuaaaagauuuaguguguaacaaaaguaauuugaauccaauauguaugccccuccuuuuguuaaggaaauauguauuauaaacacugauaucuuuaaaauuaaauuuccauuuagugauauuuuuauuuggagggaggaauuaaaaaugaggaaauuucacaauauaauccuaccuggguuugaugaaauugugaaaaacuuuuuauaauuucuuguauuacguauucuuauuuaggaaauaaaauacaugccuggauaguaauuuagaacuccuugguagaccagaaaagaugauuaauuuuauuaccuuuagcacaaugaauuuugugauuuuuuuuuuaacaguuauuacaaggaagcuuuuuucuuuucucucuugccuguucucaugcccuuuccuccuuuguugcugguuuccauaaauuuuaugcuuuaaguugcauauucauguuccuuaugaugguaccaucaaucauuaguuuuagauuuucuuuucaagaguauuaaccuuaagguauuggugaaaauaaagacuuagaauuuauguaacugcuucugaccaaaaaacuauugguuuaaaauggagcauagacauguagggaaacaauacaauugcaauaucauuuugaaaaauuaaaguaucaaaucuuuugugaauagcauuugcuggacaaauuaugcaaagaaauagagaaagaucugcgacuuucugugcauacucauuuaaagcuggaugaccgaaacccuuucaaaguuggcaugaaagaccuggcucuuuuuuucucucugaauccaauucgguuuuucaaucguuucauugacauucggggugaguguuuugcuuuccuucuuagagucauauucucuuuuuuuuuuuuuuuuacccuacuguuaaacaaaacuuugaggguauauuuaaauuuuguguuguuauucuuuaauuacauuuuguuucuuuucucauuuuuauuaauaccuuauuuuaaaggaacaaaucugauguucaaggacaaguuguuguuuuuuccuuuuagguuucauuucuuuuccuuuucuacuguuucacaaguugaauuuuuuuuuuuugguagcuuacguaacucacuaccuagacaagacuuucuacaaucuaacaacuguagcccuucaugacugggccacuuauagugagaugagaaacuuagcuacucagcguuauggacugguuaugacagaggcacaucuucccagucagacuuuggaacagguauaguauaaaauguuuuuuuuagcauacugugacuguuggcuguaacaguacuuuuuaaggaagucuuuuuucuuuuugcuuuaguuaguaugugcuuauuuuuuaagaaauuauuugccauauaaaaucuuauacuugacaacaguaaaaaauuaggugcugcuaaauugcuuuauaaaggaauuuaccaccgggguccugcuuauauucagccuucuguugagcauucgagauauacauauauauuuauauuuauauacagcuuuucagaaacacuagaauagugaagugacuucuguagaauuuuaagaaguucaaagucacauuuaaggauuuuaagccugguuauaguauauaaaauuuaguaucuuaggaaaaaugguuaaauuuacaugauuacaaauguguuuuuuguucuuaaaaugaggaguauaggaaaacauuuagcuuugcuaauucaauuaguuaauguacaguauggcauugucucaugaauguaauaauuuauguuaucagauaauuugcguggaguucucuuuaagaugauccagauaauauuuaccaaaaaacauuuauucaguucuaaaauuugaggauucuaguuuucccuuuaucuugcugcauguagggauuauuucuaggaucaguuuguauauccuuucauuuauuuuguauauccuuucauuuauucauuuauauaucugauauuuauugagaacaugcuaggcacugaacuauguuuaggaauacaaagauaaauauaaauagucccagcucauguaauauccucugggagaaaaaauguguaaacaaauuuuuagauuagaauaugauaaaaguuauaauaaaaacuuaaaaagguauugugaugcuccuuugagcucuaauuagaaaaaacuauggaacaguuuauaugauaccauuggguguuagaguaauaucuauuuaaagaaugaaggauucuuaauagaaaacuuguacuauuuaaaaggggucuggugugaucaaaagaagcauaacaguuuggaauuagacuuucuaaagucccaaggcccugcugcugccuagcuauuuugccucagagaacaacuuccuuagcuucuuuuuugucaccuguggaauuuagaagaaugauaccucauauuuuagaauuacauauaaggaaccuugcaaaguaccugaaaaauaguauguauuuuaugaaugucacagcacauucugacuaccuuuuagaaucuggcuacuaguuuacuuuguagaaaaaauguagagaagauuguugaagagacaaauauucucaaggcugguggggagaugacugugggucauggaucuuuuaauauuuaaacuuaacuguuccugucugcacaaaagauaaaguaauaagcagccagguuucccuaaggagauagucuugauuugucuuuuaacguuugaucguaccuuuuauauaguucuuuaaaauaacuuaaaaauuauuaggaaacaguauaaucaauaagucauuaugcugauacaaguuuaacugauuauuuuaaugaauuauaauaaaacuuguauguguauuauguuguagggccuugauguuuuagaaauuaugagaaacauucauauauuugugucccgauaccucuauaaucucaacaaucaggugaguaggguuuauaaauuuuuuuuuuuuaauguagguggagauaguuggaaggcugaggggcaaggaauugauuuuuaugggugaaaauuaaaugaaacaaaaaauaauuguuuucgaggccuuguuuauuuuuuugccuugauuauaccaguuguguaucuuuuauucgaaauguuuaggacaagaaguguuuuggauuucagauuuuuuuuuggauuuuggaauauucguaucauauaccacuugaggaucccuaaucugaaaauccaaaaucugaaaugcuccagaaucguaaacuucugaccaccaacaugacgcucaaaggaaacgcucauuggaacauuuuggauuucagauuuucggauuaaggauacucaccuguacugucuugauugcauuuucaauuaaauugucuuuaaugaaauagauucuaaaauuuucuuuggauaccuguuugaccaguguuugcuauggguugcguuguuacugagcauaaauuuguuucauugcagauuuuuauugaacgaacaagcaauaacaagcauuugaauacuauuaauauucggcauauugcuaauucaauucgaacacauggcacgggaauuaugaauacaacuguaagaacuuuucuuuggggguugaguggguaauagacccguuuaauagcuuggaacgugguuuucucauagaauauugcgguaaacauacacuacuaguuuauauuuuacaugaauuuccauuuuuuuucugguuaguaauuaaaaugucugguccuaaaauuguguuggaugugaugggagcugugauacaaaagacacuuuaggguagauuaccaucucagagccaucauuauaaauagugcuagauauuugaggacaucagcacauuaauauaugugugugcacacauauauauauguuuaucuguguugaucugugaucccugaaaguuuacuuuugaaagucaacaauagauaguaauuuacuuaauguuauuuaugcccuuuuuggggcaggguuugcuaauuauuugauguccauauaaauaggaacuuacuaaaaauauauugaaucuucuuagaaaugggcauucaccgcuuggcgugguggcucacgcuuguaaucccagcacuuugggaggcugaagcaggaggaucaccugagguugggaguucaagaccagccugaccaacauggagaaaccccaucucuacuaaaaauacaaaauuagccaggcgugguggcgggcgccuguaaucccagcugcuugggaggcugaggcaggagaaucgcuugaaccugggaggcagagguugcagugagcugagauugcgccauugcacuccagcuugggcagcaagagcgaaacuccaucucaaaaaaaaaaaaacaaacaaaaacgaaaugggcauucacuugaaggaauuauuugaacucguaugcuauuuuucugucuguggaaaaagagaagucuuugaauuuaccugguuuucagagcacaguuaauuucuccuuuaggggagaagacugaaugcuuaaguaguacaguauuauuaaacacauuuggaguagggaauugggagaaaauggaaaguuaaguugggaucauuuaaguauacaguggaaaagcauugaagauuuugagccaaugagugauaugauuggagcuccauuauagugggguuaucaauauagaaaugaaacauacaauuuuaaauuccaaaugaagagucauccauguaaugaucauguuuguaccuuugaggauaaauaaaacugaacuuuugagaguaaacucuuccuugacuucuaucaucuaucaaauauucauguaacagaugugaauguauuuuaugugucagggacugugcugggcacuagugugagaaaaacacauuuccugcuuucacaguaaucacagggauauagauguucaucaguuaauuacacuaaugaauguagauuacugaugucuguugaugaaaugagcauagaaggauagaaaucaggauggcagaauaguuacccacuauuaagaguggaaaggauuaaaaacaaaagacuguuaaagagauuuuuuuaaaaaugcaaagaaacagaaaaaacaaggagagaguacaauguuuaagcuacaagauaaguucccgaaaaucauuuguuuccauaauuggguaaaugaauacugaguaaaacgggcacaaauuugucaaaaucauuaguaauacuugagaguuagugggguuggaaaugaauuuaggguuuucauuuguagguuggaauuaaucuuaugcuauuucugccuguagguuggaauuaaucuuuugcuauuuccaucuguagguuagaauuaauuuuacugugcuauuuugacuuuaaucucagcucauaccucacuuucuuaggauuuucugagucaagggcuuuuuguuauuuauugucaaagcacacauguacuuaacauucugagaaauuauuacaguagagauuuaauaauuuauuuaacaauacuuguuuaaaauguuugucaccuguucuagaauauaaacuucgugaagacaaggaccaugucuagcaugggagaaggcacguugccuuguguguaagaggugauuagaaauauuuauggauagauaauugaauaugugguaucuucaggaagguucagagaacaccauguuucuuacuuuaguaucauucuagaccuguagauuagcaauaaguaaucuuacugauggaggaacauagaaacuucucacuggaccauggcuuaaaaacuagagucuugagucugguuuugugauucucacuacagcccuuaguccuaucaugagaauauuuuccacuuuuuucuuuucuuuuuucuuuuuuaguaaaaauauguaagaggagcuuauagaaaguuuugugaacuucagcaauaaaaaauguuauuuaaauauuuucagguccaauaugaaauagacuuuuuaaauaguacuuuauagguaguacaaauagauaacugugauacaguaaaauuuauuugaauugauuugaauuaauuuuuauauuaacuuuuuucaacuuuuugaauuuuaauuuuauagguuaauuucaccuaccaguuuuugaaaaagaaguucuauauauuuagccaauuuauguaugaugaacacaucaaauccagauugauuaaagauauucgauuuuucagggaaauuaaggaccaaaaugaucauaagguaggcuaccuauucuuuuuaagguauuugauuaagcuauugaguauauggcaaauguguaugcuaaaauucauuauuuagaucucuauugggguuuuaguuuuauuuucccuauaauuucuuacucugcauuaucuguaggcuuaagguaaggaaaaaauuaaaucauaaauguagccaggugauacuuuuucuuuauuuuaaaauaauauaaaagcaggacaugcuuauuuugaaacauuuaagcaauauagaauggauaaacugaauauccaccuucauuucucuuuccauuccauuuucuggaggcaguugcuaacaauguagugugauggcuuucagauaucuuuguauauaaacauguauauuuacacacauauauugcuuuuaaaagcaguauaguaaaaauggaguaauauuauacauagcauuuugcacugugcucaucacgucaguacauacagaucugcuucaaguugauagggauacauccauguauaucauaacuuauuuaaccuucuucuguugaccauuauuuagguuuuucuaauuuuucauucuuacaaacagugcugcaguaacaucuuuacacaucuaucucuggaaaucucagacuuucugaaaacuuccuuaaggagaaauuucuaggacaaggaaaugugaacauuuaaaauugugguacauauugccuagcacuccaaaaacacuucacuauugauauucccacugauaauuuauacgaaugcugcuguuagcagggugcaguggcucaugccuguaauccagcacuuugagaggcuaagauagguagaucacuugaggcaaagcauuugagaccagcgugggcaacauggcgaaaccucaucucuacuaauaauaccaaaauuagccgggcaugguggcacaugccugaagucucagaugcucaggaggcugaguguauuagucuauucucaugcugcuaugaagaaauaccugugacuggguaauuuauaaaggaaagagguuuaauugacucacaguucugcauggcuggggaggccucaggaaacuuauaaucauggcggaagguaccucuucacagggugacgggaaagaaugagugcccagcgaagcgggaagcccuuacaaccaucagaucuugugagaacuaacucacuaucaugagaacaggguaggggaaacugcccccaugauucaguuaucuccaccuggucccucucaggacauguggggauuaugggaacuauaauucaagaugagauuuggguggggacaaagccaagcuauaucacugaggcacaagaaucacuugaaccuaggagguggagguugcagugagccgagauaaugccacugcucuccagccugagugacaagagcaagacucugucucaaaaaaaaaaaaaaaaaaaaaaaaagaacgccguuuuccuuucaccuuccaggcugaguuuucccauagugaagugaagugaagaaucuguugaauuguuaaguggcagcaggcgcauguagccauguggauugagaaccaacaggcuuagauggguccuauauuugauuugccauaugcggaacuauuuuaauuacuuuucuuaagauacaccuauuuccaguucucuuguauaaugguugcuaguucucuucagugccagaguagcaaaauauuacuuucucauaggauaaucuaauaaaauuacagauuacauuuaucaguagaggauuguauuaacucuuuuuuuuuuuugagacugagucuggcucugucucccaggcuggagugcaguggcacagucucagcucacugcagccuccgccucuuggguucaagcgauucuccugccucagcccccugaguagcugggauuaaaggugcacaccaccacacccagcuaauuuuaguauuuuuaguagagaugggguuucaccauauuggucagacuggucuuggacuccugaccuagugaucugccugccucggccucccaaagugcugggauuacaggcaugagccacugugcccagcccagcucauuuuuauuggagcagaaauuccuaguauuuagagauaaauauucaugcuauuauguaagaauugcuuucuuauuauuacaaaaugaauaauuuccuaaaucuccuaaucaaccaagaccaaaaaguaguuuuuuuauuggugaugguuacuagaaauuuuaacccagcugacguguguucauugagaaggaguauguuucuaagucccuaauaccuauucagcccacagaaacuuggucacacaucugugaacagguguuucugggaggaauugguuucuuuuuucuguuagaguuguuggagguuaggagacuaauaauugugguagggaaauuagguuaguggcauugauuauuagucguuuuagcuaaugucaaaaagaaaaaaguuauauugaccuugaacauugguaguguaugaauuauuaaucuuaauuaauuuuuaagcacaaugaaauacaaaauugaaaggagaguaguauuggcaugguuuauuugggaggcauuuugugcuuuagaaaucuuuauuaaaaguagccuuaaaauuuucugucuaguauccuuuugauagagcagaaaaauucaaucgaggcaucagaaaacuuggaguaacaccugagggacagagcuaccuugaucaauucaggcaacucaucagccagauugguaaguuaugauaaaaguguugggaaaucagguacagaucccuacagucuaucucauauauuaacuauuucacacuaauaagcagcucaugugaaagccugagcucagcuuuacuccacucauguaauuuuuuuacccccaaaauuuguaaguaugauuagacuguugcugcagaaauaauugauagacuauaggcuaaucacguaaauaaaaccucuucaauuauaauuaaaguuauuuaauaacuaaaucucaaaggucauauuaauaauuguaaacugguaaguacuuacugaauaccugcucuguucaaggcacuguuuugggcuucuaaaaggcucccacaaguuccagucuaaaugugaagguauaaaauauuuacaugaaaaguuauuaaguucuauguuacaccauuuuacuugugcauauaauguauuguccuucugcccuuacgaguggaacuugucuucugauauguaguacuuuuauauuuaaaaguaagaacuacauuucauaaucaucgcuuaacaaaacuuuauacuuauuugagcuuuucacauacauuauauguucacaauaacccugugagauaggcauguaaucguuuuaaagaugaaaaaagagaaacuuagagaaagaaguaagucauguuucugggacuuaaaccaggguuauuuagcuauaaguccaaauggguuuuauauucuugaaaguuuauauuaacaccaaacaguaaaaucuuauugacuauauuuugggaaaauucugccuugugagauugauuuauucauuuaucaagcauuuacuaagcaucuguuaugccacauuuucuguuaggugcugggaauaccaaccccuuugcuuucaggagacuuuagguuuacuaguggguaauacguuauaagcauuucauucuggaguaaaguuuuuucaguuaauugauuugcauauuagacauuucuauuauguuuuaguacaagaacuuggaggauuuuaccuuuguaaauguuuuauuauaaaccauucaauauuaaguauugucaaauaaguacaaauaaguuuucuucaaguggacauuuaauauuaagcggcaaacuuauggagcaauaguucuuaaccuuuuuugagaaucugaggaaaacuccaggaugauuguuccagaacuaaugccuauaugacauacguacacaauuuuguguaugauaugcuagaguccaugugcuuaaagcuugggucuauggaccucagauuaagagcuguccuucuagagcaguguuacuuaaguuuuauuuauacacauacccagaauuuuugcauccuguuaauacugccuucacuauuguuacauguuuuuauuuuuuuugagaguauaauuuuuccuuagaaauaacaguuguuaaaucauaguccuuaaaaugcuagucauuuuugcccuaaauacauaaucacuaaguguucuuuggugugccaucuaaugucaccuugcuuaccaccagguugcaguccacaauuggggaauauuauccuuuucauuuuaauccaucguuuuacucuuuauucucuucuuagaaaauauaaauucuuuuuuuuuuuuuuugagacagagucuugcucugucacccaggcuggagugcaguggcauguucucagcucacugcaaccugugccuccuagguucaagcgauucucccgccucagccuccuuaguauaugggacuucaggugcaugccaccacguccagccaaguuuuguauuuuuaguagagauaggguuucaccauguuggccaggguggucucgaucuccugaccucgugauccauccgccucugugucccaaagugcugggauuacaggcgugagccacugcgcccggccaauacaaauucuuuaccucugcuuauaaaacacuguaaugugcuuuugagucugauaaauaucuugagaaaagguguaaagaaucugggagcaaaauggaagccuuuuugacuaauaacuugccugcugaaauaauaauaauuaacauuuauugagcauuuacugugccauggcuauucuuagugcuuuauauguuuuaacucacgugaaucuuaccacaacauuuaugaaauauuucuucccuucauucacugcacagguauucauucaguacaacaaauguuucuaggugcugaugauauuuaugacaguaaacaaagucucuguccuuauugagcuuaauuuaccagaugagaagacugagauacagagagguaacauaacauaauuuguaggucucuuagcuaacaugugggagaccagauuugaacccagguggccuggcuucagagcuuuuacucuuaauugccgcucuauacuaggcucuccuauuuugcuuccucagacuuuggucugaugauuuggaggaaaacaaacuugucauuugacuuuuuaaagaugcacauuaaaaaaauuucaaugucauuucucauauugggacaggccuuaaaauagauucaauguuaacugcuauguaggguuguuaaaaacauaagauaauguauguaaaauguauguuacucaugauuaugaaauguuaacuuguuuuuacauuuccgucuguucuuucaaguaauuucaauaaaguucaauuauaaauugaauuccuacuauuugccaggacauguuggcucuagggauggagcagugaagaagacaaaggcuguacucauggaucuugaacucuaggugggggaagaugcagacagaaaaauacauaguaugucagugauaaguacuggguaaggagauguaagggggcugggcagugcuagucagugauguucagggaaaacaggaggugacauuugagcagggaccuaaauaagguuggggaguaagccacgugcaucuggggaaagagucuaccagacagaggcaacaguaagugcaaaagcccugauucguucacauuuuugagaaauaggggcuggaauggagugagcaaagaucuaaguggcagggcaugcuaucugaacaguagcagaggggugcaagaucgaugucaggauuuugauuacugaggguggaaagccauuacagcauuuucagaaaaagcaugauauggggccgggcauguguggcucacacacuguaaucccagcacuuugggaggccgagguggguggaucaccucaggucaggaguucaagaccagccuggccaacauggugaaaccccaucucuacuaaaaauacaaaaauuagccgggcgugguggcggacgccaugugaucacagcuacuugggaggcugaggcaggagaaucgcuugaacugcagaggcggagguugcagugagcugagaucauaccacuguacuccauccugggugacagagugagacucugucucaaaaaaaagaaaaagcacuauacgcucuaacuuaguuuuuaaaaauucacuagcagcucuguagauauuauacaacacuggggaauguggcaggaugcuaaaggugaaaguagggaaaucaggaggccauugcauauugcagugcuccagccaagagcuggugauggauuggauaggaggauaucuaugaaggggugaaugaaaaguggguggauucugguuacguuuucaaggcaaagucaauauaauuugcccagucauuuugauuauaaaaugugagagaaaggagccagggaugacuuuaagacauuuggcuugagcaacugaaaggauagaauugccaguuucuuugauaggcaaaauuggggauaaagauccugagcuugaguuggacauaugaaauauaaaauucuuauuagacauaaaaguguaggcaucggauaaaaaaaccuagaguucagaggaagaguccaggccagagauauaaauuugggaggcaucaaauaaagauuucuugauaucacuuccaauuguguauguggcggagauugaaucucaaugugagaggagaaauuauugauauuauaauuuuaagcuugaccauuuuaauguagucagcauuuaaugauuuuaguuuaucaaaugaaaauaacauuuacuuuuaaauauuuaauauaguuauauauaaguauguauguuuauauuuuaaguguagaaauauguaacaguuuuacuuuuuaugauaagaacugaaguaaaauauagcaaaauauuuugguucuuaggaguggaaaccuuguaauuuacuacuguauguaacuauauuccuauuagaauuuagaguuauuuauauaaauaucugauuuuuuugugugguuuuuaagguaaugcuaugggcuauguacgaaugauaagaucugguggucuucauuguagcagcaaugccauuagguauggaugcaaacaucauuuuugccuuguuuaugccauuuuaaaaauuguguccauuaaauauauguuacaagugauauuguagauaagguguuuguucuugauauauuuugagauaaaauauggaagaaaacuauuaauucuacuagauuuuucucaaauuuuaagacugcagcagacuucugaaaauauuucucuuaaguuaauuuaucaauaugguuuaugaaugcauguaaagauuacaugauuuuaaggauuaaaauauucauaucuaaaauucaauuuggaacuaaaguggugauaugaauaauauuacugaaaugcacaguuguuuccaaauacauaguugaaaauuuuagaguccugcaguaccacuuuuauaucugugucaauugcacauauuuuacuugaccuaauaaaugccuucccaaauucuuauguagauuuguuccugaucuugaagauauuguaaauuuugaagaacuaguaaaagaagaaggucuugcagaagaaacauuaaaagcagcaagguaaucuaaauuuggaaauauaaaaaaguguguuuauaaaaaacauucugaagagaagaccagaggguaauauguaauuuuuaugccacuguuuuuauuauacaaaauuauggccucaguuuaugaaguauaauuuuuaagacuucaguauucuaagaccuuuccagcuucuagaacaugcuguccaguauuucagccacuagccacacauggcucuugagcaccuaaaauuuggcugguccacacugagaugugcucaaguauaaaguacauaacuaaccuugaagauuuaguauaaaaggaggaaugccaaauaccucaaucauaaaauucauuucaccuauuuucuuuuuacuuuuuaaaauauuucucuucaccaacaguguucuagaaugccaguccuuucuuauauguaaucuauagcagcacuguagccacuaccauauauggccgguaaacacuuaaaauauggcaaaugcgacuggggaauugaaguguaaauuuuaucuuaauuuaaauuuaaauagcuaaugucugucuuauugaacagugcaggacuugagucaguugugcauuugucccauaacacgagaggcaugcagaauugguaagaauauguuuagaaaacuguauguuuuauucacacuuauagcagguuauugaaucaggcaugaaggggcaccccugggcaagggggagacaauuugaucaaaaagaauaaugauagauaaaaaucuguugaauaaaaaaaaucaaugagucauaaugauaagaaggguuaucauaagaagaucauaaugauaagagaaugaaagucauuucuuuauggaagaaugcuuguuaaauuuaggggggaaauuguaaccaucacuguaauacuugaaaucaagcaagaauccccagugguuucuaaaacauuaggugaaaaguuuuuagagaacagaggauucauucaguaauucaucccauaaaauugcuuauuaauuacaaaggagaaaacugucuuuacaguggagaaauauauuccaccuuggccaagugaucaaacuuagcaucaccaguaauggagcagacagauguaauguggccucuugaugcaauguaaugucaaguaccuaguuuguauucuugccagaaauguuuauccugaauuuauuaggaggaaauguccugaaaaauuuagaaugugagcauuuuaugaaacacuuggccuggacaaaaaauacacggagauuguucuagauuaggagaauaaagagaccugauaaucacauguaaugggugauacuuaaucauauccuagauaaggaaagaaacagcuguaaaggacauuugaggaauaauugggggacauuugaacauggauuguauauuaguuaauacuguauuauauucuuggguauaacaguguuuuguggcuuuguagaaaaauguuuucauucuuaauagauucaugcuaaagcauuaaugggcuaagugauaaaagguccacaacuuucaaguguuucagaaaaauagagaaaacaguugugucaaaauguuaacaaguggugaaucuaguugaaggguauacggguguucauuauacuauauuuuaacuuuuugauaggcuugaaaucuuaaaaaauaaaaaaguauaugggaaaaugcaugcauuucugugagaauaaggccccagcacagaagcuuugcucuggaauagucuguuagauagcuuaagcucuuugccagauuacauaagccauuuacaaaguuaagccauuugaagucaugugccugaaaaugguuuaaauaguuucugaugugugucucaaaggaaaggaucagaccuuuaccuuauguuaaaugaugccauucacuccgaaaguguugaccauuuaaaaaauauuuugaagcagugugaggaaaucagagaguaggauauugucuucuaagaucucuaggguaaagcugacugcuaguuggaagauccagauuggugcaagggagugguugauugaagucaaggaaauguagggucaugauaaugaauagauuaucugcauagacaggggagaacuggagcaggcauccuaauccugcguaauuguaggacggugguuaaaagguuaguagaugucugcuguuaggaagaaguaguugaguauuuggguaguuagauauaguuggauuaugugagucacaaaggaagauuucuuucuuacagugguggaggaauaauaauugaaagugguaguagcuguacaugagggaugcaggagaaaaagcagcugauguuuuugaagguugagagggaaacugaguucuugaaaaaaagagccagguuuauguugagguaaggggauguaggagaaacguuagagauuuaaggggaagaggaaauauuuacaaugaagaggaguucuacaggccucacugugggaagaagaaauacagaacuauuauuuuaagucccaagauguucuaauagucuauuuuugggacuaaauuuacuaauauugaucaguuuucuguccaugagaaaauaaguuuauucugaacuccaagaaaauuuucuuagaagugucuuacaguguuuccugcuuuucaaguguucuuaucuaaacuauugagagauggauuuuuuucaaagccacgcuucuuuugagaaaggaaccaaauaauuuuuugcuuuuuaggcauuuggauucaguccucagugaucacacacgaaauucugccgaaggcacagaauauuucaaaaugcuuguagacguuuuugcuccagaauuucgaaggccaaagaauauacaucuccgaaauuucuauauaauuguucccccucuggugaguauuuccagaaccuaaaaugaauuuuuuuuuuaaaaagaguaugcacaaauagaucugguuucuuuguaacacgaaaugcauacagacuacacuauuaauuuccugguugcauauaaaacuaaaugugaucucagugaaugugacauagaauuuuuuauuuguuagccaugcugaaggacacuuucuuauuguuaaauuuuuuuuuucuucugagauggggucuugcccugucacccaggcuggagugcaguggugugaucauggcuuacucaggcuugaccuccugggcucaagccagcccccugccucagccucccuaguagcugggacuacaggugugcaccaccaugccuaauuuugguaauuuguuuucuuuuuuaagauauggggucucacuguguagccuaagcuggucuugaacuccugggcucaagcaguccucuugccuuggccucccaaagugcugagauuacaggcaugagccaccacguauggccuaagauagauucuuauuuuuuuuaaauaauuacuggagaaauuugaguauuuuuuaaguuauaugaguauaugccauagaaucuuugggcagaauuauuaauauauaaucauuuuaagugcuuaauguagaauaacuuuagcuguuauuauaguuuuuucuaacacauuucuuaaagcauauuguuucaagauaacuucuuucuauucaguaguaaauacuaacaucuggacuaaauuuuuaaugcuucuuagaguauguaacguguucuugcucuaacucuguaguugcuaucuaaaaauaguucaaguuaucaaaaauugcauuauaaaaacagcuguuccauuagggaaaauggaguuaagaauuuuugagagguauauauuaguaauaagaguuguuuuggcuuaagguuccuauaaaguuuaaaaaaaauuguaaguagauagcuuuaaaaucuaaauaucacccagcagaugaagcucuuuauuauauuuaauuuugaucaagaauagugacuuuucauauugcugcccaaguuguuaacacaucuucuuacauauuaaaaccauuauuaccuauugaaaguagcuaauagccuauaaacagcuuuuuuccaugaauuuuguuucuuuuauacauuuguuaauuuucuaucauaauuguauuuuaacuaugauauagcaaaaaauguucauauucaucuuguaagaaucuuuucaucuuaagauagugucaaacuggagggagagugucauauuugguaauacuauaguuaacuuggggugaguucucaccauauuuuuuuaauuugaagggcaauguacucaaaccauuguagacagcaguuaacccauugguaagcuuaggaaaaagucuggaguuuuacaaggcaguugucagaauucgcuuagugauggagaaaacaaaguggauuaaaagcacuacaaagaaguauagaauacuguucuuguacuuguguuuguaguguaguuccagaaaaaagacaagcauaaaugagauuucuaaaaaagauugaauuaaugauugauaaaaaauucacaaacaggugauuaauugcugaauaaguuucacagucaaaaaaaugaaacuugguuuuguuuccagcguaggcuauuauaguacuuagcacacuguauaucauaauuaguuuuuaaacacuucugcauuuacucuucuagagcugugcuauccauguauagucacauguggcuacuuaaguuaauuaaaauuucauaaaauuaaaaucauaaggcagggcgaaaaaaauaaaaauaccuuuuuaaaaauuaaaaauucagcuugucagucacacuagccucauuucaagugcucaguggccgcuugugauuaguggcuuacuguauguacuggauggugcagauacacauuucugucccugccaacaguguugcucuagacugugaacucuagauagaaaucauuuguuuaaucauaaguacuuaauaaugccugguauauuguaagcuucaguaaaucuuuguugaauaaaagauaugauuagauaagucauuuuggaagagcugaauuuucaagagacguacuguuuugaggauucacacuuaagaacaugaaaagaaauaguauuuucgaaugaauuagguagguguaaguaaggacugucuugcauauguuuuuaagaguacuugugcuuugaaauaaagcaggccuacuuugcuaacuccagcauucacuuaauauaugacuuugggugagauaauaaaucucccaagccucgguguccuucucuguaaaaugugcauaauauuuuauaaugagauauacaaggcacuguucuugggcuaaguagugauugagggagugcccauauuuaaaggacuuggaaaggagauccaugaagauacacuuguauagauuguaucuucaccaagaggguaccuaaggcaaauguuucagaugaaaaggacaggaaucuagauucuauucuauucuauuuauagugauucuauuuauaauuuuuaaaaugucuguuauaggaauucugaagauuuucuuagcaaaauuguuuuucuaacauguuguuacaucuuuuuagacccucaacuuuguagagcauuccauuaguugcaaggaaaaauuaaauaaaaaaaauaaaauuggagcugccuuuacugaugauggcuuugccauggguaagcuuaauggaauuguuuuuccauuaauuuuauauugaccuuguaauggauucuuagaaacaucugcuugagaauaggucuauauguucuuuauagauuuuucuuucuuuuuucuuuuuuauuuuuuugagacagagucucgucucgcucuguugcccaggcuggagugcaguggcacgaucacugcaagcuccgccuccuggguucacaccauucuccugccucagccucccgaguagcugggacuacaggcacucgccaccacaccugccuaauuuuuuuugcauuuuuaguagagacgggguuucacuguguuagccaggauggucucgaucuccugaccucgugaucugcccgccgcagccucccaaagugcugggauuacaggcaugagccaccaugcccggccuauagauuuguuuuucaugaguguuguuuaccguguuuuuagcuggaauacaugauugacgauacuuguuuucuguaguuuauaacuuauugaaugccuucuuaguauugcuaaucacuuguccacuuuggccuaauauuuaggcuuuguuuuuguugggguuguacaguuuuaacgucuuauauuuaguuucucugguuuccuuguagcuuccucaauugccaucuuuuuagcaguugaaguguuuuuuuccuuucuuuuugaggcagggucuugcucugucacccaggcuggagugcaguggugcagucaugguucacugcagccucgaccuccuggacccaagcgauccucccaccucagccucccgaguagcugagacuacaggcaugcaucgccacaucuggcuaauuaaaaaaauuuuuguuuuuuuuagagacaggagucucacuguguugcccagguuggucuuaaacuccugggcucaagagguccucuagccucagccucccaaaguauugggauuauagguacaagucauggaaaguuuuauucuuuaugcuuacagcuauaucguuucuccuggugauuuauauggccauguuaguuauuuauuuucuucuuaauugacuugucuuuaguuauacuucuacauuguuuuuaaaggaggaauuaagccauuuuguuaaacccaucauucauuuaugcuguaaaauguaacuugaaacgggacaaacuuaaaaugcuaggaauuauuacucagaaugcuuaguguugggaauuauuggugaaggaguagaauaccacuucuguacucacuguaauuuaaccuuaguuuugcuuaugccugcagguguggcuuacauucuaaagcuuuuggaucaguaucgggaguuugauucacuucacugguuccagucuguuagagagaaauaccugaaggagauaagagcaguugcuaagcaacagaauguacagucagccagucaagaugaaaaacucuuacaaaccaugaaucucacucagaagcgacuggaugucuaucuacagguagagaggagccuaagagucacaucugcuuugacuuaccauuugauauccaugacuucuuaaugucugaaaagcagaagccauauagaaacuaccauuuucacaagugagaugaauaguggcaaaaagauuauauuuuaaaaugagugcuauuuggaagccauuugacucacaucuuaaaaaugggcggguuacuuauuucaguuucuguauuuaugauuuccacuagagcuuuuaaaaauaauaauaagaggcauaaaaaugcauauauuuuugguauuuugccauaauaaguauuuuugguuuuuauuucaaauuuuuaaauuuacuuaggaauuugaauugcuguauuucucacugagcagugcaagaauuuucuucagagcagacaagacugcggcugaagaaaaccaagaaaagaaagagaaggaaggucagugagugguuuaaauuuggaaagaccaauaaaugucuuuaguaauagacaguaaugcaccauuuuaucuggucagacaucuagcuucuuuguccuuuuggaaaauaacacagaccuagcauuaagucuuuuaaaaaaaguaaagccuguauagaucuugugugaaauugaaaaggaauuuauguaguuuaugcauuucacacuugguaacccuuuaaaaccuuguucaggaucaucugcuuuuaauuuaaauacacuuuucacaaguuugguuuuucuuucauggcucaaacuauuagauuugaaggaacaaauagaggaggacagcuaaauguugcugaaggcagagcugcugaugacuagauguugacugaaugagaugggacagaugauuaaagaacuguaaaaucauaggggcuauuuaguuguaguaaauagcauccugccuucuuucauagucaggcccuggagacucaggcaauauagccauaauaacugauagugauuucaaugaacuucagucauuaaggaaaggauucuguccauuguauucuauguaggaugguggaaaggaaucuauacuuuuuaaggcguaagagcauuguucaguguuucauauuuaauguccccaugauauauuucucucagauuugaaauuuaggaauaaucaucuucucugagaaacagauguuucccuuuuucugucauggauauuauauagcauacauuucucauugcuuggaagaucaaaacuagauacagcgacuaguuaacccuuauaauuuucauguuuacuagucuccuuuuugucuuacucgugcuucaugaaguuuucauaaaucaagauauaaagcucuucauaaaacaagauguuuuuauuaaucuuauuuuauguuaauuuuuaaaauacaccuuuuuucuuuauauagaguagaggugacucauuggguagaccacuuacgugaacuaccuuauuucuugacauuguugcauaaauuaaauauuacuaauauuacuuauuaauuaggugcauauccaggcguuuuuugaaucuagacuaaauaaacaugcuugaaaaaauuguuucagcuuauuaaucuggaagacacucaauauuaaaugaaaauuuauacauacuacauuuguguucauuuucaaggauaaauuagcaaagccauuuggaagaauuugaaucaauauaaucuaaauuaugaagaaacucaguuauugccucaguucugcucauguguuucaugaugccagaaccuuuuccccagcccaggugacugggaaaacucugcggggcgauuggacauuugcuuucaggcuaaagcauuaaaacaaaacaaacaacccuucagucucauggcagugggauuccuugcuuuggccuauuccucuuaaggaacucuccagaguugcaguuguuauguuaucacucacaucacuguucuaagacuauuucagcuaaagauugcucagagauauagucaguuucugaauacauuacucaaauagucuuugucuguuaaugaaauaugcacacaugacauuuugcacaaaaagccaggaauucauucugucaaaaacagugaaaagcuguuucauuuaaaauuauuuuaagaaauaauauauauuacguauaauuuauuauaauaaguuauaaauacaaauggaaaguuauucauucuggacaguuuugauaugugaguuugcagccauguuccuaccaggaaugacaauguacuguaaugguucuuucuuggcccagcuggaggaacuggcgugaggggagcgggccuuucuuagaccaggaauaucaagauuccucaggacaaaggagcccaugugguuugaagccccaccccaauacagguucugagcucccucaacuccaccuucauuaaaaaccaguggaaacaauugcaguguuuagccuagauuuuuaaaaauuuuaaaguguaaacaagguauaauuugugauguuagagaaacauuugauggaugcaacuguaauuugaaguuuggcaauacagcucuucucaaauuucuuuuacuucuuaauuuauuguuuaaaaaugaacauaaauauccauuauuauuuucacucaugcuuucagaagaaacuaaaacaagcaauggagaccugucugacagcacugugucugcugauccuguugugaaaugauacggaugguauucacugcacauaugaugaaaucaucagaauuguuaaaacuuuugccaguggaauggauaaacuauugaugaauuguuuccugggucacaucucuggaaaauagauguuacaguucuuaaaggcagugcuuuaaagugaaguucauucuguuuccaaaggcucuacuuucaaagguuaagaaugagauuuuaaaauuggauuuuugccuggacuugaggguacaagauguuucuauuugaagugaaguuauaaaagggcaaauccagauucauaaacuaucaccucggauuucuuguaaucuacauguuuguaauuuguauuugcauagaucuuugaucuauaguuauuucaagucaugggaaauucaaugcauauacuauauacagccaguaaauacaugcuuaacaaaaggaaugagccugaaguucauaaagaauacauaucaauauucuuauaaaaggaauauaugaagauggcuuugauacuagaggugaggcacaaguguuuuauguacucucaguguacaguauaacugaugauccuucuuucauuguuaauuucaugugacucacaagagcugcugaugucuuugaugagacauuuuauaacuaguuuacauugcuuugagaacauuuaaccuccaacagcugcuuuaaauuuaagauuuacuuaauacucagaaaauucagauaaagccauagaguccuguuugaagcuucacuucuauuuugguugaaggcaugauguaugaugucagaaaaaaaauugaaugaauuauuucuacauccaaacucagguuucuucuacauuagauugaauugaaauuuuggugaugguuuggguagacuuuuuuuuuauaucaaguauaauuuaaaacaucagauuaaauaauuacacuguucaggcuuuuaaaaaaauaccacugugagaauaaagcgcuagcaagauacaucacuuacugauuuuaaaaauacagaaagauuuugaguaaauuuugugcccagcaagcuguuaguuuuauuuuuguaaagguauguaaguuauuaaaugguuaaucauggccuuuuaaaaauaaaauaaagugauaccuuuacaaugaagacaaaaguuuaaaacuuucuaauacaaacaccauuuugggaaaugcuugauuuuuuucuauugcauuugucugcuaaacauuucuuuggauaaauccugcaaauacuucuaacauuauucuuugauuccagcuuuuagaauggguguacaaugcccuguuuguacuuacugguuagggucaggguaacuugccagcccaagauaaauacuuuaauuguuaaaagucagaagagacagaauauguaggaaauguuuuuuguuuauuauguaaacauggcuuacagaauuaugaacaguggauagauuaaaggcauuuaauauuuguaauucauaauaacuguagaaauggcccuaaagcaugcugcauaauuaauaauuuauauuuucauuauuauaaguguuuauauuaaugaucuugcauuugauuauaucaaauucgucauuucauagcaacaguauuguuuucucuguuuuucuucucuaacuucucugaaaucaucuccuauuaagggauagaaauuguuacuagaagagaaucacauguucuguguucauuaucccuacacauguaaauuaauuauuuuaucaauacuagauagaguucacaugcugacucccuggauaccuacaguugagaagaaaaugacagacaauuauuuuuccuuuaggucaaaauaaugucacugcuaucuggauaaauuauaaguucauauauuugaaauaagauccuggaaacgaauuuaaauggugucaaacugcagagcaacagggcuucaguauauucacaucuaauagguuaauauguacauuuggaugaugauuuuucuugauaacauuaacauuaauuuuauuuuuucagacauacuguaauuuaaaaauuaaugugagcguuuguuuuaaguucacagaaaacuuaauaauucaaauucucaggaauuaaggacucaccauaacauugucaguucuaaugaaauuuuguaaaagauggcaaguuuguuaccucacuugagugggguuuuccuuuucccccaauucuaagagaauauaauguguauacuaaaacauuaauaaacauaauuuugaaaauuu

SEQ ID NO: 16339 - RNA, 4910 nt, Homo sapiens
gugaagacuaagcacuuauuuagcuugcuauuuaaaguaaauuguccaccagaccacauguuuaaguuagaaacaucacagucuuagguaacuuuucaaaacuucaucuagcaaaguguaagaacaguuaucagccaaagcacaggcauuaauugacaugagcucgggauagggguuggagcaaagccuuagagucggaggcucgcguucaaauccugacugcaguuacuguuugaucacaggcaacuuagccucuuugagacucagauuucucaguagcaaaaugggcaacauaacacccaccuugcaguuuuacgaugauuagcagggcgauaugcauauguagggguccuagguaguaaauaaauaauguaguagguaguaaauaaauaaugacugcuacuacuauguuuucugaacaaauguuucuuuuuuuucuuuuauuuuuaacugacacaucauuguacauauuuauggggcacagugugauauuucgauacaugcauacaacguguaaugaucaaaucaggguuauucacauagcaaacauauaucauuuuguuguguugggaacauucaaaaucugcucuucuagcuaucugaauauauaaaauaaauuauuaauauagacaauauauuguauauaauuuauauacaauaaauuauaaacauacaauaaauaaauauauacaaucaauaaugaauauauacaauauaauauucuacuguauguucuuaaauacacaauauaaauuacuaauuuauuguauccucccaauuaaauuauuaauuauagucacccugcagugcuaucaaagaugagcacuuauuugucuuaucuaguuguaauuuugugcucgcuaaccaaccuuuggcuaucccuguccccucccccaaccucuaguaaccacaauucuacucucuacuucaaugagauuaacuuuuuuagcuuccacauaugagugagaacaugugguauuugucuugcugugccuggcuuauuucacucaacauaauguccuccaagcucaucuaugcugccugaaugacaggauuccugaacaacgauuucuugagaaagcgaacauaccuucuuucuuuuaaauugcuuugaaaauagaaagugcagugaaggaccaguaaugagccuuauguaaauaaaagauguaggauaguguggaugucacacuuucaagugccaauguuacuacaucuguccuguauccaagaacaaaaccagaaaucagagucuaaccaagcaguaugauuaaacugcuuaaaauugccccaggccaggcacgguggcucauuccuguaaucccagcacuuugggaggccuaggcaggugggucaccuguggucaggaguuugagaccagccugaccgacauggugaaaccucgucucuauugaaaauacaaaaaaauuagcugggcgugguggcacaugccuguaauuccagguacuugggaggcugaggcaggggaauugcuugaacuagggaggcggagguugcagugagccaagaucgugccauugcacuccagccugggugacaagagugaaauuccaucgcaaaaaaaaaaaggcuccaaauucuaguaggagcuauggaagaugaaaaguaucguauuaauauccacgauuuauugaguggauauagucuagcccuuaauccucauaccaacccugugggauguguuauuggcguaauugcuaauaccacauacauuguuacugucaggccucugugcccaagccaagccaucgcauccccugugacuugcacguauacgcccagauggccugaaguaacugaagaaucagaaaagaagugaaaaugcccugcccugccuuaacugaugacauuccaccacaaaagaagugaaaauggccggcccuugccuuaagugaugacauuaccuugugaaaguccuuuuccuggcucuuccuggcucauccuggcucaaaaagcucccccacugagcaccucacgacccccaccccugcccgccagagaacaaccccccuuucuuugacuguaauuuuccuuuaccuacccaaaucuuauaaaacggccccaccccuaucucccuuugcugacucucuuuuuggacucagcccgccugcacccaggugauuaaaagcuuuauugcucacacaaagccuguuugguggucucuucacacagacgcacaugaaaguuaccaucgccacuuugcagauuagagaacugaggcauagagggggaaaacaauuauccaagaugaucauaagagguggaacagggauuugaaccuagucacucugccucuagaucugaagcucuuaaucaaggagccugggcucuuguuggagaaaaugcuuuaucgaugugaaaacauucacacacaaugccugauagcauugugcugaagugugguuccaauuauaaacgugguaggaauucagucuggagaggaacucccagugccugggcaugacugugugcuaggcauuguacuggguguuuuucauccuucccauuuaaggagacggagcauggcauauaugaaaggagaagggggagcuuuggaacuggacagguaggguuuaaauccugguccugccauuuacaaacuguguaaccucugggaaauuacuuaaccuuucugauacgguuucuucaauugaaaauagggauuguaaacagcuacuuuacagaggaggguuuacugucauaaaacaguaccagccuaugguagaugaugcuguugauucaauagauacugaugaagucccacauaucugggaguaacacuaucagccagaauaagccagguuaugcugcuuuaacaaaucccacugacuuaacauaaauaaaguuuaauauuugcugacacuacuuuuccaaugcagauuggcugggauuuucugccaucuuuacacagagacucaggcuggcuuggggaggcuccaacuuuguaccaccaugauugucaagauaggaaaaagaagacauggggauuugcucacuggcuccuaaagguuccaagugaaagcaacacaaucacuucugcucucauuccauuggccuaagcaaguccgauggucucaucuaacuucaagaggaugggguaguggauuucuaccacaucgcaggggaggggaagaaguagaaaauauuuuaaaauacuacuguagacacaauguguuuaucucuacaauagaucugcuaaauccauaucuuaagagaaaaccgaagcucugagagguuaugucauuugaccaaggccacacagccaauccucugggaagccaggacucaaccugcaugccacucauccugacugugggaucuauaggcacaacguccacaaacuguauagaagcagaacaguuucaggauggggguggguggcagggaggcccugcaaaugcgguggacagaauaggaauugaauaggcaugaugcgccuuugugucuguguucugucauugcuccuggggaagggaagaaggggcagggaaguuugugugaaauaucaguagaaggaaaguuuggacagguaagaauaucacgcgucagaguacagcagagacacguguggaggaugagggcaguguuucaggccauuacucuggcagcagugaggaggcucccggggaggguuggggagagcgggcuguugcuggaguccgggguaaggugaccagggguagacaggaaugaaggcggcgggaauguagaggaagggcugcaccugagagcugcagaggaggccccagugagguccacugguggaaaagaaccgccaugcgaucugcagaacaccagaccuucuucagccuucacucuucccacccuagucugguacauugcaccacuuguuaaaaaaaaaaauuucccuaagaccucuuuuucucuagccuucuuccuuauuuuucauggucucuucuuagaacggcggcagccacgccgcggugggaggcccuuccugccugacccuuaccgugcgggguaccguuccugucaccaucgccaggaucuggcccuuucagugaaaggaaaucucccaaggccuaaggaggcaagaggccugcaaaucgccuccugcucagcaaacggguugcucagcaggcccgggguccugguccaccccaggucccugguuugcccaccuccgauggcggccuucgcuggcagggugggcgccucuggggagccagcuccgucccggcgccuuuagagccccaucucuuccacgucccuggccuuccuccccuuccaggcggcuguccccgccgggguccagauggugucggagggccggcgguucgacggcgggcccgggguucagccucccggccucccuccgucccugacucuccuuucuucggagagggcgcgggggccggggccaaagcgccgcucuugggguucuccuggacucggaguugccccaggcgggcgcagcucugccccgcggggugccagccucgggcgggcaagguccgugagucaccgccuguaaccgaacaccaggccucccugcccccucccccagcuccggccgccaggcugcggcgacaccuacaagaaaaugaaggggcgcccaggcccgcggcggccccggccguaucgcgagcaggucccggcggcccccggcucgcggcgcucuuucuuccccggccccggggcucggccagccgcaaccgccgccccggcgccagcaggaauccaggccgagcgaccggccccggagcccgaggcggcggagggcccgcgguagcugcgacuggcgagcccgagagcgcccggggagggggcgcccggcuuggaauuucccggucccuuccggcccagcgaggacaaagcacuccuggccgccgccgccgccgccgccguggccuacgccgcgccgcacaaag

SEQ ID NO: 16340 - RNA, 677 nt, Homo sapiens
cugugaucugaauguuugugucccucccaaaauucacauguugaaauccuaaccaccaaaaugugaugguauuaggaggcagggccucugggaggugauuaaguuaugaggucagagucuucaugaaugggauccgugucuuauaaaauagacccaagggaauguuuuggcccuuucuaccaggugaagacauagagagaagacaucaucuaugaacaggaaugugggcaaucaucagacacuggaucagccagcaccuugaucuuggacuucccagccucuagaacugugagaaauaaauuucuguuguuuaucagcuucccagucuaugguauucuguuacagcagccugaaugcacucaaugucuuaagcuagaauccuccagaaguagaccccaagacaagaauuugaauauaaguggcuuauuuugguaggugaucccagauacacugagaagagagugagaaagugagaauggaaggggaggaaacugcuauaggaaggguucugcaaugaccagguuaccacuaugggcaacugaggcucaguguccugaggacaucagagagauggcacagaauaugcuucagaguuguccccuggggucugaggaggcugaggcuuuauccuucagcauuggcuauuggcugaggcugcucccaaguguuaauaucca

SEQ ID NO: 16341 - RNA, 10205 nt, Homo sapiens
agaauguaaccacucuggaaaagucauaacaaagcucaaguguuuauuaagaauuaaaaauacuguaaauaagccauacaguucauuucacaguaaacuaaacaaaacuuuuuuuuuuuuuuuuuacuuuucggguuuuuuuuuuuuuuuuuuuuucaauuuuuuuuggaagggcaagacagccauuaaagaacaauacagcucagagggaagggagauacagcaaacaauuacacaaacgcaguaugcacgcuccuugccgacagggcugcccagacggcaaaccucuucauggacaucauguuaaaauaaaaggacuuggccugcauuccccagggagacccccuauuccacuguagacagcucuccucacgaauuuuuugaaagaacccaaggacuccccuuucugguagucgaaaccugugcauuccuuggugaccuccggagagagaacaugggccggcaguggggacagagggcaccgggacucugcuggguguagugcuucacauucagaaccgccuggaugcuuugcauaguuaccucugauaucacaagaugcgucaggaagagaaacgacacgcacaccaugagggaggcagcccucaagcagcggauuccuuucaaagaaagacccaggggcuucuccccuccucauucagagcugacagcuaugagcuuuaaccgguucaaaguggaagacaagugagagauaucucauaaaaauuucggccagaacaaaaaaaaaaguaaaauuaauuuuccuuaaagacaacuagaaagaaaaggguccccccaacccaccuuuuuuuuuuuuuuacuugaaaucugccagccagacaggauuucugagguuaaucugcuucuguuaauccucaauuuaagccuuuaucauuuuucucugacuagagacauccaugaaaagccaccuguuauucacaggggcugcgcuucaggaaaccaaccaaaugcagaagcagagaacuuaaauauuguaaauaaguuaacugggcaugaaaauacaaugccuugguguucagguggugacaacugcucuuuaagaggggacaagaaauugggggguaggggacacaugggaaaaaaccacacauuuuuuggucaugagaaauuggacuuuaaauccgcgcccugcacacgcaauucauuuagaccuuuucgugaaucuucuccacuuucacaaacaaccuauccagaucauuccucaggucaucuaguaaacccuuggcugauuccagauuguucucguugguuucuauuuugaccgaguaugcaaccaaacuguccacagcaguccugagcauuuucaaguccgccuccacuuggcugacugaggcuuucagguugucuagagaagaaagucuguccaggaaguccugaggaggcagacgggcggccugggcuugguccugacugagcagcgugugcaccugcuccugcaccuucuggagugauuccacggugcuggggagcucgcccacacuccucuucagcuccuccacgucaccguagagcaccagcugggucucgcccaggcuccucaccgugcuggccaggccauccuggucugccucugaggacccgaggccuuccaggcgccccugcagggcggccaggcgcugcucgugcuccuggcucuuggacaggagggacuccaggcucucggucuggcgcgcagaagccaccugcauggagagcaccccauccuccacgugcuggagccuggaguccagucccugacucuuuugcuggagugccucaaaggcuuccgagugucugaagccuccguccuccuucggcccgugggaaucggacuucagcuggcggagcucuuccuccagucuccggaucuccuccgggaggcgggagacggacuccucagaccugagaagcuucuccgugagggccugcagggcgagccgcuccgugucggccgccuccuugaaagccugcugcuccugcuugaggcucaccagcucgcggaccucgguguagaugucagacuccauagucugaaggguacuucucagggccuccaugucccacucucuggacuuggcugaggucuguaucuccuucacagcuuccuuuaaggcuuucaaauccugcuuguuccccucagauucuuccagggaggcaaccuuugccuucaugucauugaucuccuucuggcuccucuucuggacuucugugaagauggcgauguugucguugauggauuuggugagcuccgucagccgcuccuccaccguguucuccagggacgugaagucccgcucccgggcguccuucaccacauggaucccauccgagaggucuuugagaaucucauucuggaguuucugcagcacuucgcugauccggcugaccucacucuccccuugcuucacagcuuucucugugaggucuuguuuauguugggagcuucucaagauggacucaaaaguuccaaauguggcuugcaaagacugcaccuguaaucaaaauccagacguuaauugcugagaagagcugaugaguuucacaugauacaacuuuuuuugucugcccagccuccagguccuguuuuuuuccagaaugucaccacaauuuuccuuuggagaaacauccuuccacauauaguccauaugguuuuaaggaccaauccuaggguccccuccuagugcuccagggaugauuuauaacccaggccugacuaaucaggcugcacagcacaaugauuaauaaccuggaaauaaauggauuaauaaccauuaaagguggcacauggugccaccuuuaaugcuuuguugcaaaaaaaaaaaaaagaaaaaaaaagggaaaagacagaaaacaagaaccugacucuaucaaguccccaucaugcagaagagacaugucgugaggaugcaaucagccaaacccacaauguggaaaauucuacaggacaaagaaccaggaucuucaacaacuaaguggcauuuuaaaagaaggaaaagcaggaaacuuacagacugaaagaaauuuaggaaauuuuucaaucaaauauaauguguggaucuucuauagauccugauuugaacaaaccagcuguuaaaaagacaucuuugagcugggccuggugguguccaccugaagucccaacuacuugggaagcuaaggugacagguugccuugagcccaggagugccuugagccugggcaacagagugagguucugucucuaaaacaacaaaaaaauuaaaaaauaaauaaaauuuuuaaagccauuuuugaaauaaucaagaacugugauucuggacugggugucagaugacauucaaguaauacuguaaucuuuguuagguaugauaugcuguguucuguuaaaacaaacagggaaaggaguacaaagggaaggaaaggaaaggaacgcuuaucaguuggaaauaaauccuaaaaugcuuuggguaaacuaaaaaugucagccagggauucuuuuuuuuuuuuuuuuuuugagacggagucucgcucugucgcccaggcuggagugcaguggcgggaucucggcucacugcaagcuccgccucccggguucacgccauucuccugccucagccucccgaguagcugggacuacaggcgcccgccacuacgcccggcuaauuuuuuguauuuuuuaguagagacgggguuucaccguuuuagccgggauggucucgaucuccugaccucgugauccgcccgccucggccucccaaagugcugggauuacaggcgugagccaccgcgccuggccucauuuuaaaacuaauuccuaauucacuauccccuggaucugccaggacaacacaggcucuuuagaggcccuaaagcugaacugccaacauuuucugaagcccuggacccacuucugccuaguaaauuuucuggcuucaggacaggacaaccucucugccugugcuauggccaugcaacaccaacagcaucuggagaagaagggagaccaggcugggcacgcauagggcaagagagugguucacagucagacuucuaacuccagccaaaaaaaaaaaguggcagaggggaagagugccgauggaaugaaaaaagaauggcaaaacaucaguaauucuugaaacugagguucauuauauucuuuuuuuguuuacacuugaacacugccaugauaaaaaguuaaaaaauaaaacagcacggucucuggagccagacugccuagguucaaaucauaacuuuaacacuuuccagcagugugaucuuggggaaguuauuuagccuaucuguaccuugguuuccucagcugaaggaugggaaaacaguaccggacucauaugauugucuguaugaagauuaagugaauuaauaauauaucaaguacuuaaacugugcccagcacauagugaacacucaauacauggcagcuauuaucaucgugauuauuucccauuucuucugaagcaccugguaagucugcagauuccuagaaauauccucaacccaugccaaaaggcaggaggauaaacugaagugggaugugaacaacaucccucagcucucgugccagccccaccaguagccagcucuguaagcaugaagagucacauucacuuuccgagucccaggcuccucauccaauagcaaauaggucucuaaagugcugucuagcuccaucagucuguuuuaaggcagauuagaauaagguucucaggggcuccagaauacuagacaauuucccugcccaaccaaauacaaccugagucuuaaaggacacucugugaagguacuggagagagcccaucucugaaacuacguuauuaaaucacacugucugccuguucuaagcauagcacucagaacagaggugugagcaggugagcacaguaccuucaacauggcaggcuuucauccaguguuuuuugauggaaucacauaaugagggaauucaagcaaagccugaugagcugguccaugucuccucugaucccugucagcccugaccugcgcuggcucuucacaaaugguuaggaaggagacuagaacagaaauuauauccaacccccaacacuauaaaaaagaacaugguguuccccuacugaggggacuaugaguugugcaucuuuaugugcaaauaauucauuaucaucaauaugcauuggaaauaucuguucccccaacaaaugugggaugcccacuaagugguaggcaacaggcaagaugccagagaugaaauaauggcuaggauccuugcccucaagguuacacccuaggguggggggacuggguguuagcagugguugacauucaaccggacacuugugauggaccaauaacuauacaaaggacuucagacacaucaucucauuacacccucaccauaaucucaugaguugguaucucccagugaucuccauuuuacuaaugaggaaacugguaagugguaggcucaaacguuaaaaucccaaaaugcuugauuucagaaccugagcucucaaccaguaugugauaugcucaggcaggggcacugacuucaaagugcccugaguaccuggaagagagacugccaacuccugaagcccugacuccuuagccagagaaucuagacaagaaaacaaagaaauaugaccagggagcucacucuuccacaaauagguccuagucucauuaaacugucccuaccaggccuaagccuacuccuaccauugcuuuauaucacgcuggaucugccagggcaacacaggcucuucagagggccuagagaugaacugccaacacuuucugaagcccaggacccacuugugccugcugaauccucuggguaaggacaggccugccucucugccugugcuacagucauucagaagauuugagccauucuccaauaacaagaacaucuggagaacaagagacaggugggcacccaacuccagcuacacaacuuauggucugugugugaccuugaaugaguuacacagccaguccucagcugccccaucugcaaaaugguacuacuaaaugauaccugccucagaggguggcugggagaacagaaaucauggcuauaaagcauuuaauagcauggcugacccauagugaacaguaauuaugaauacuguaaguauacuucccugcuaugaaccaaacuccaccccccaacaaguaaccaagaguuauaaaaggguucaaacuuaggcugucagagaaccaaacacaacugguuccucaaugcaaaauaauuuauuuacuggccaccccaaagauacagacagaguggccacauucuauggcaaaucuaacacuguucuggccauguucugagucucaagucaauggaacauuuauugggcaccuacuauguacuaggcuaaauaguggagugguuaauaguguuccaggaguuagacaacaguuuggauccuagcccagccacuaacuagcuauaucaccgcucaguuacuuagccucucacuuuucucaucugucaaagagggcugauaauaguacuuaccucuugggguuguugugagagucagcagaugaugcauuuucaaaugcuuugcauagugccuggcacguaauaagugcaccauaaauaugacacauuaaauuauaguuugauuacacuacuaaauuaaaagaaaaguggucagccaggcgcaguggcucacaucuguaaucccagcacuuugagaggccaaggcaggaggacugcuugagcccaggaguuugagaccagccugagcaacacagcaagacccugucucuaccaaaaauuuuaaaaauaaauaaauagcuggacgugcuugugcaugccuguggucccagcuacuugugaggcugaggcaagaggaacacuugaggccaggaguucaaggcugcagugagcuaugaucacaccacuacgcuccagccuggugacagagugagacccugucucuacgaaauauaaaauaugaaauaaaaaacagagaagucacuauuucaauuauuuuagagccaugaggauucuuaaaagucuggauggagcccucuucucauugugugggugggaaaacugagccccaaagaagaaagugaucuauauacauagcugugauggagaaggggugagaagcaaaaagaagggacuaagugaggggcagggagaagcacagagaauuaaccuggauucaagaccuucccuauuuuggccucaacuuccaacccacccucucucacaauuuccuacaugugacucugccauuggcaggguagccaccuccucucucucaaacaugcucaaaauagugccccugccacgguguucaucacaguccuucucucaacauuuaucgaucaccagcuagauggcuggcacuacccuggccaccgggauacaggcgaaauuccacacccucccucuucugaacuuucacaggaguuacccucaacugacaccuccuuaugcgcugcacaagugauucgugucuuuugcuccuucauacccucccacaaagccuacacagagccaugcaacugucagacuuuaauaaauauuaugauugacuaguaaguaggaggaugaaagagaagaaacagaggcuagucauuauacuccagcaguaugucuauuuuuuaagaaugguuugacauucaggauaggcaaagcagcacugccuacuuaauucccuuagaaaagucaccucccuuggccugcagcguuuagcaggcugacucauuccaguugcucugccagucuuuuuuuuuuuuuuuuuuuuuuuugagacggagucucacucuguugccccggcuggggugcacuggcaggauuuccgcucacugcaaccuccaccucccggguucaagcaauucuccugccucaaccuccugaguagcugggacuacaggcaugugccaccacaccccgcuaauuuuuguauuuuuaguagacacaggguuucaccauguuggccaggcugcucucaaacuucugaccucaggugauccgcccgccucggccuccuacagugccgggauuacaggcgugagccaccacgcccggccgugcucugccagucuuaagaggaaauuccugguccugcacacucaacaaaagcagagagcaacuuggcaggacagacagcaugcugggaaaaggaggcaguggcuccgggaucagaaguggcgggauuuuuuguuucagucuugcaaccaacuuucauugagcaaugacauaguggagggcgaauaagaucaaaggggcuguacuugguauggaaaaaccacagaaggguggaagcuaagcaccuucgccuugagaguuggguccauccauaccugaaauggaccccuguggacccuugacgaacagggcaguggccuagacauucucgugugucugucacucaccagcuggggacuuugucaacucauuccucugucuaaaccucaauguucugcucugggaaaugaaaucaaaacuguuaguccucccucccaggguaguuauaagaauuagauaauaugugagugaguaagcauucuaaacaccauauaaauguggcuagaaguauuauucaccaguaugaucuaguauuuuuggcccuccucuuccccuaaagcggaaguagggccgggcgcaguggcucacgccuguaaucccagcacuuugggaggccgaggcaggcggaucacuugaggucagaaguucgagaccagccuggccaauacggugaaacuuugucucuacuacuaauaaaaaauuagcuggguaugguggcacaugucuguaaucccagcuacucaggaggcugaggcaggagaaucgcuggaaccugggaggcagagguugcagugagcugagaucguaccacugcacuccagccugggcgacagagccagacucccucucaaaagaaaacccaaaaaagcugaaguaggacuacgucaaaggcccaccugggcaggcugguccaauacaggacaagggaccuaaagauagaugguauuucauuuggaccugcaaaugaguaagaaugccagcuccgggucuauuaaaaaccccgcucggaugucucccacaggcagagcugagguggggccuugccugaggcuuccagggaugcgcuggcuucccuuccaaccuccuuuucagacagcucugcccauucagcgguuccuaaugcagaaagaaugggcuccccggagccugccggcuuccuuacaggucaccgcuaaugcccugugacaggcccuuggcccacccugccaggcgggccugggcauccucgcggcggcccaucccucggggccgauuccuccgcagccauuaacaaagggggucuggggacugccucggaacuagggggccgcguggagugggaugucuaggccagggcccgccaaggaggagcggccggcucccgccuccgggccugggcaggcagcgcuaggggccggucgggaagcacgaaggagcccggccguggguccggaggccgcagucgauggggacaguugcggggccggggguacccaccuucugcucgacgcccugcaagcccuggcccagcuccucccucugccgggagaaguccugguggcugcgccggaccugcuggaccuccuccaggacgugguggacgcaccagcccgagaaagcggccgccgccaccagggcgagguagaagagaaaguugagcgcccugccgagccugcgcgagcaggacgccgaggacgaggcggcggcggcggcagcggcggcggaggcggaggaggaggaggaggacuugccgccgccgccgccgccgccgcgguggccgcccuugccgugcgccugguucugcgggugcugcugcgggugcugcugcgggugcggcgcgggcggcggcggcggcugcugcggcgccggcggcggcuucuucgccacgucauccgcgccgcccgacgggugggcacccuucuccgaggggcucgcggcgccguggccgcccuuggagccccuuuguuuggccgagggcauggcgggcgcggcggcggcucgggccgcgggcugggaggcgagcgagcgcggcgcgcggcccgggaaacuugcaggggcucccccgggacugggcgagcggcacgcgggcgcugcuggcgucggagcggcgagaggacgcgcggccggggaaggaggccgggccgaggaggcgggaggagggggccugccuccgccgccgcggcgccgaccc

SEQ ID NO: 16342 - RNA, 115043 nt, Homo sapiens
aauugcaguccauuuagcggcugguucauagaugggcggggaagagccggguugcucuaguccuuugagaaugauucauagaggagggucaggaaagaagaacgguucagucugugaaagcccccuuaaaagacuggacaguucuccgagggagggagaggcaggagagcaagcagggccuugggccugacuccgccucgguccgcuagccaggccucgaccgaguccugggccuugucaggggcggccgugaggcgccgguugcugggggagcggugacgucgcggggugaaaguugaggggcggugacgucgggccggcccgggcggaggcuggcggguuggaggcaggacggagggagggaaagagggaaggaaggaagcugggaaggagcgagcgggggcgcgaggcguuuaccuggaggcagcggcuugggcgcgcagagcggccgcggcucccccgcaccugcggccauggaugaggagcgcgcccucuacaucguccgggccggcgaagcaggggcuaucgagcggguccugagggauuacagcgacaagguaaagaguccuggccccgggcgugcgguaucgcacccccgggccgcccuccgugcuugcacaucgcauccuuccccaccccccucauuccggggaugcgcauugcucucccccgaaaacguuuccggcuugggcaugcguguuugugcccccagccuuuuccauccaugcauccugcaucccacuacccccacuguagcgcccacuccucugauuccuggcccagcagcuugaccuccgguccuccucucaagcgugcaagucacacccccggaauccguagaugugcaucugugccccgugccccacuccuggaugcauaaaugcaugagaggcuuccucaccuguauagcauaaaaauacgugcuucccugcauaaacacggcccuugacaugcaucaaauguaucagcaacgauggcaguuucuauacguuuagcacuguacgguuuucaaggcauugaugucucaucuauggucuccuuugauccucagaguguuuauaggguagaugguaucauccuccccauuuuauagaugaggaaaccgaggugcaaagagcugaaaucacgcccaaggucauggacauauaauguuguaaguggguggagaauguaacuccuaaugauaccuguuauuuguaucgcauuaacagcuuuccuauccauuaucuuauuuaaucuuacagcaauccugugagguauuaucugcauuuugcaauugagacucuagauugguuaaguaacuugcccaaggucauacuuggagcugguauuccaguuuaguucuuuccacuucacaacucugcguaaaagaguaucuuguuauaaaucccagucacuucucagaaccucuuuccaagaaccguuagcucuucauuacuuuuccuuccaggaauuuuacaugcucacuucaaaagauagccuaccacaccuuuauccuuugguuuagaagacugcuuuauaggaaugacuggcgacucccuucugugaaaacacacccaacaccaagucacaaccuagcuguuaauguuuuucuuucuuuugcccccguacaucgucuccccuucaguguuugcuuuguguccaccacugcauccauccacuuuguauuacugacaauuggugucuuauuuuugaaucuuuuccacccggggcagaaauggcauacugguggcugaauucccguuuaaucuucccaacaacccugggaggagagugaugguauuccccaauucacaaaugauaaaauuuagaaugauaauguggucccaaguccacacagccacugagagauagagcugagauuugaauuuacguuguccaacuccaaguccagcgagcgcucuuucugccguacuguguugcuuuccuugggaagauucauagguucuaucuauucauaucuuagcuccuucacuuucugauacacuuuauuguugaacaugucugccuaauuuaggaauaacucauucaaugcauaguuguacauauuguggagauuaugauuuaacccgauuuauuacugcuuuccagaaaagauauaaggcagcuucaaacugauuuucagaagcaagaaaugcaaagagaacuuggccauuuguugaaucaacuaauguuuauuuagcacuuacuauaugccagauacccagcaauaaauaggaauuuguuucuguaggggaggaaggaggaaaaaccuucaacuggauauaaucacguucuuuaauauuucuccuucccuuuauggcuaaacuaauuagacuccagauuugcuuccuccaauuuaucucuucucauuggucucccuccagauugguaucuacuuaccacuccuggccaggugcugucagagcuuaaauccugaacaucuccagcuccccuuuuguauugggaauguuuuuaagguuguuuugcauggugugucuugcuuaaggugguaucugaaguguuucaaaagauucccaaacccuuguaauuuugggaucaagccugagagugcucugacuagaugugaacugggucaguuagcucuuucagaagaaagcgcucccuucuuuuuuggagacagggucuguaucugucacccaggcuggagugcacuggugcaaucacggcucacugcagccuccaucuccucccccccaccgacccucccaaguagcugagacuacaggugcgugcaacagcacugggcuaacuuuuuaaauucauuuuuuguagagauggggucucacuguguugcccaggcugcucucaaacugcugggcucaagcaguccucucaccuuggccucccaaaguacugcgauuauagguguaagguacugugccuggcgagaaagcucucauauuuaauacugacuguaguagggccaguauaguagggcugauuauaauacaaagaaaauggcugaacaucauauugcagugagguuuugccccucaaagggagagauuuugagagcagaugaauaggaagugaauguaugaucauagugguucaggcaguaagaauggggagguggaauuaaauugcccagcucuaugguauauggaauuuagaacccugaaaaaaaauaguuggguaccauauacuucaguuuccuuaucuggaaaaauggauuugagaaauguuuggauuaugaggugauuauagggcauugaggaguccaacagagagaaaugaaugcuguagagagagagagaccgguucguuauuugggagaguaguggagagguucuuuaugcuaccuuauaccucuaauaaagcuaguccuugaaaggaggcagucaaguguaguagaaagguggugggauuugacaucagauaaacuugguucaaaucccaacucugccauuuauuagcuuuaugacuauggauaaauuauauuaagccugugagucucaguugccuuaccuguaaaauagggauaauaucaccauucucuuaaauuauugugaggauuacauuaaaugaaauauaaugccaacacugggcacaaugcaccuaggaagcacucaguaaguuacaguuauaaugaccaggguaccuaagagguguggccggagcacagguucuguagccagccuggcuaugauccucaacuuaauggcuugugugacccuaaacgaguuacuuaacuuugcuguggcuuaguuuccucaucugccaaauggagauaauaauaguaacuauaucauagauuuguugucaggauuaaaugaguuacauguguaaagcacacagaacagugccugccacugaggaggcaccccauaacuguuagcuuugaacaaaaaaauuaaacguggcaugaguugggauagcacgauauuaaaauuugggaauaugcuccauucuuccccuucuuuuucuaauggguagcaaaauuguaccuuguaccgcuuuuagagauaccugucgggcuccgggaaacaucuaauuucuacuguguuauauagauucucauuuccaagccuucuugcuucauucacugaccuuuguuaucuuggagagaggaaauauguaucuaucccagaaagaaugaaacuugucuguuugucaagggcaugacacagcauaggucucagcauaggcaaguuuuuuuguuuguuuguuuguuuaaugggaggagcaguuguuuuucucuccucucaaugcaccuguuaacauuuauugagugccugcuauguacuauguauuaucccaagcauuuucacauuucguaugucaucuuauauuaauuccucuuauauuaauccucuuauauuaaaacuuaugagggagauggaaguauucuauauacaggcucaaggucacauagcuaagaaauggcagaccuggucuucagauuccauauccagggaucuuuuugcagggcuauguugccuuuacccugucucuucuguguuuuugagcacagaaaaaguuucuuuuucaggagugguauacuacgguuauuccucaauauccaaaggggauugcuuccaggaucuccuguggauaccagaaucuguggauaccaaaaucuucuaaugcuuuagucccugauagaaaacaccauaguauuugcauauaaucugggcacacccuccauuuuuuugagauggaguuuugcucuuguugccccaggcuggagugcaauggcgcgaucucggcuuaucauaaccucugccuccuggguucgaaugauucuccugcuucagccuccugagaagcugggauuacaggcaugcaucaccaugcgcggcuaauuuuguaucuuuaguagagacgggguuucaccauguuggucaggcuggucucgaauuuccgaccucaggugaucugcccgccucggccucccaaagugcugggauuauaggcgugagccacugagccuggcugggcauauccuccuauauacauuuuuuuuuuuuuuuugagacagagucucauucugccgcccaggcuggagugcaguggcuugaugucgccuaacugcagccuccgccucccagguucaagcgauucuccugccucagcuuccugaguagcugggacuacagaugugugccaccaugccuggcuaauuuuuguauuuuuaguggagacaggauuucaccauguuggccgggcuggucaugaacuccugaccucaagugauccacucaccugggccucccaaagugcucugauuacaggcaugagccacuaugccuggccucuccuauauacuuuaaucucuagauuacuuauaauacguaauacaaugugaaugguauacaaauaguuguacuguauuauuuagggaauaaugccaagaagaaaaaaaaaagccugcacuuguucaacacagacacacacaaaaaaaaauuuuuuuuuuuuuuuuucagauauuuucaagccauuguugguugaauccacagauacagaauccuuuggcuacuguuggguccuaaucaccucaacuuuaguuauagaaugaacuguuaauuuggggaauuauguaucauuccagucuagacuguucaagcucuugcucccccacgggggccuguucuuuuuuuuuuuuuuuuuuuuuguguguguguguguguguagaguugggggucucaccauguugccuaggcuggucuugaacuucugggccucagccucccaaagugcugagauuacaggcaugaggcacagugcccagcccucaggacuucucuaauaacacauuuaguagagagauuaguugccaucauuaucaugauuaucaacaacaaacugugacuaagggcccugagguauggaguaguaucaugauucuuuacaucgcaggcuauuuauguuagaggagccucaaagauaauagggcccaacccccucguuuaauagaugacucaucaacuaugaugauaaccagagacguggcuugguggcccugcaggccaccuggacauaugacuaccccauacauagcaaauuccagcagcauuccaguuuugaaguauggcaaguuuuuggccaaaugaaagguauuuaagauacagacagauagguaggucucuaguaguaguccucuuaggagaagaaaacaagacugcuggcagugaggucuucauucaugugcuagaagaaccugauucauagaaaccugauauugggacaguucuauaaauauagccucuacauuugaauagaguauguaaauauccaggaccauguaagaggacuuuuuguuuucuacuuuggaaguugggcucugacucuuugauuucacucuguggguucuugcagagaagcauguuuagugggcuguuccuuuguuauacuuuguucuuauguccagauuauguuauauaauuuguuucuaauuuuuaguuguagaagcaaucuguguucaugaaacagcacaacauacaccacgcaauuagguuuauucccuuguaguagugcuguuugaguguaucuuuagaaaucuaugaaauuauuccuagcucucuaauaggucaauauuuggccagaugccacaccauagguuauucaacaauaacaguaguggccauugaacacuacugugugcaaggugccaugcuuauaaaaaauaaggaaaauuugauagguaguaaaguugaauaacuugaccaaguuuacacuuuuaguaaacaguaagacuggacucaaacucaagguugucugacuccugauccugagcuuuuuagagcuuauucauggaguaugaaaccuguagugagaguccucauaauagucuggugugucacugagcuguuagcuugcuugaucucuaaauugaacaaugguuuaacucuuuuuuuuuaaaugggguuuuaucguguugcccuggcuggucucaaacuccuggucucaagccaucuguccaccucagccccccaaaguguuaggauuacaggugugagccaccaugcccggccaauuuaacucuuuauauuugauuuuuugcuccuguuucucuggaaauuaaacauguaaagaaggugagauggcugacuguuggcuaacaguucuagaaauacauguacagcuggaaaugcuuguucucucuuuccccauuucagccuuagaaaggggagagaauaaagauagggguacugaauaaguuaaguaugaucuaaguuggauaaaagaacccagguuuauagaagccaacaucuauuggauccaaacacucuuagagguuugagcuucugaauagauuggcgcauuccagauucaauuuguagugccucacagaccauuauauuuucuaauuaagagcaacagaauaauuagaccuugguacuauucugaauucccaccuuaaaagauuaauucuacagaggaacuguuuaaaagacacuuauaacuuacugagugucuuuccaaaagacaauuuauuuuucuuuccccuuaccauuaaugccaaaaaaaaguuuagaagaaacguuauauuaacaaguagguacauuuauuccagauaauuuauggaauuagcauuuuacauauaauggcaaaaaaauaggcuuucuugguuucuuagugcgauuauuuucauuuguauugaaccuuuaggggcuuuaguuuacaacuuuaaccugauaucuggcacuuuuaagucuaauguuaauuuucacuaaaccucaggucuauacauuucuaaguauagcccucagauuuacaaucuuucuuuccucuccuccuucuuucuuuuucuuguucuuuauuaucuauuuaaaaaaaauuuuuauuaugaaaacaauauaccaacaaugagucuucuuuuuaaaaaauugcuacauaauauuuugucaggugaauauauuauguauaauagaauacugucacaugcauaacauuccgucagucuccuguugguuauuccaguucucgcuuuuuuucuuccacuauguuggaugacacugcagugauacacauauaauuauucucuccuucuagaucaguaggauaaauuccuaggaguaggaguucugggucaaagaauaugaauauuuuuaugucuucuaauauguguuguugccaaaucacuuucucuuuuaagguuuaugucaguuuauacugccaccaggaguaucaugccuggauuauugauguccauuccucacagggcauuauguccuuagucuugcuuuccuuuaaucuggccugugagcuaccgcccaaaauguucuaccagaaugcuggucucacaccuccgucguagucuuccccugguugccugucaccuauuugccaauucagguguaaauuuuaaaauccaugcccuuaccaccugaguucauuccuuuuaauuguuuugcaucuauauucgaggcagccucccucccucaaauggccacucucuccuaccucugagucuucccucugaucauuucuuacauucagaacuucuuuucugccaacauuucucuaucuucuuuaauuuaaaaaauugcugcuucuacaaagaugucaacacagaaccaccugugaugaugauaucuuuaguacucaguguacuucacuccugguggguugccaguaaauauuugucaguguggcuaaugagagaaagaaaaaagaaaaaguggagagauuuuugguggagauuuuuguuuuuuaauagaaaggcuuagaauucuuaagaguacuugguucuccugaauaaaacuucagaggagaaugaggaauucugugcucuauuuuugggguaccauuguucuuucugugaucaugggcaagccaacuuauucugucuucuauuccccucuacuucagcuacagaguagaaaauauaguauugccaaucauugcagaagagucaugacacucucugccuuuccaguuauuuuuuccucauaaucauuggcaucaucaucauuauaucccuaauauuuacugaguauugcuacuugccagcacugagauugugcuuuauauacaugccuuagcuuuuuuuuaacugucacagucucucuaugaacuagguacacccuguuuucagaugagaaacucaguuccagagaguuuacuugcuuaaggucacagcuaguaggugguggagccaccaugauuuaaacucuuauucuuauugaauuacuuuucugaaauaucaaaccaucaagucuucccuauccacaguucucugaugauuucuuauugcauaugaaaaagaaaguauaaacucagcagcaucggaaggcccuuccaaaucacuguccagucuacuuuuccauucucuucuuccuccaugccccaccccaaacguauguccuguguuccagucucacaaaguugcuuauuucacaaauauaucauauaguuucacacauucgagccuuuguuuuuguuccuggaaugcauuccauuugccucuggcaaacuccuguuuaucccucacgauccaacacaaaugcucuguauucugugaaagccauuccggauuuuccugggcaguuaguggcuugguuugcugugcuccuuuguauauauaucugcuguagucuuuucacacugcuuuauaacuauuuguuuacaugccugucucccuuacuuuaauaagaauauugagauacgggaaggcaacauuuuuuacagggacauuauuuuagaugcuauuaaacguagccaaaauuaaaaaauacauguauuuaaaaugacauuguuucccuuuuuucccccucagcauagggcuacuuucaaauuugaaucaacagaugaagauaaaagaaagguaagccuugguguugcucugugaauguuuauguguguguguauugcauucauggacuuucuaagcaguggucauguuuucaucugaugguuauugauugguuucuuguuucccuucauuuuguuuuuuaggaacccugagaagaaagguuagguuagguuuaguuuggguuacacguaacucuuuccuccuuuguccucgcaggacuauuaacacuuguauaaaucaggggagugggagggauucagaggagucucuucccagaucuacucacucccaaagacugacuguuuaguggcaagacuccagguugcccaaaauccauugcuaauauuacaaaacuuagcuugaggcaaggucucgcucuaucacccagguuggagugcaguggcucacuguaaccccagacuccugggcucaggcaguccuccugccucagccucccaguagcuagagcuacaggcacacaccagcaugcccauuuuaaaauuuuuuuguagagacagggucucaucauguugcccaugcuggucuauugagcuucuggccuuaagugaucccuccugccuuaaccucccaaagugcugggauuacaggugugagcuaccaugccuggcccugccuuugugucuugcuguacuccguacaucuaucccuggcuauacaaaugccagaaccaaacaagagaguaugacugaaucaguguaaaucuaucacugcugcuagaaaaauagcuuaaauccaguauuuugcuaguaguggguugacagugccuugaaaucauuccuccauucaccuguauccccauaccuaauaucagugucuugcucauuuuacguuuucagauuucuuccauccauuuucuccuuaaccucugcucuaauucaggccuacaucugauuacugcaucaguuuccugacuguucuuucauuuuccaguuacaugcuuuucuaguagauuggcauccauaaauccaaaauaacaaucugaccaugucauccuuagccuuaaaacccuucaucuaucccuucauugacuuucuuuaccuacagaauaaacuucaagcuucuuaacaugacaugcugggugcucagugaucugucauaugccuacuuucgcagcuuauuucuuuucucucccuuguauuuuguguuuuagaaauagaaaauguuuccaguuaugcacacauccacaucccuucuguuucuugcuuacuacuuuugcaauauauuguuuucuaccuagagugcucucucccucuuguacaccucuucuuuuucucaccuggugaaucccuacucaccucaggggcaccuccuucagcaagccuccucugacauuccaguuaaggugaaguaccucuucaauauucucauaauacucuauauaaaucucuaaauuaauauuuaugccuuguuucuuaauuauauaucuguugauguuagacacugguaucuuuauacacuugacauuuggagugcccagcacauaauaggcacucaaaaaguauuuauuggaugagugaccauggaauauaaauuuuguagauuaaagguuuaacucugacuuucuuuuggauuugaacaauguaaccaagacuagaauaccuuuuuagaacagggauucucaacuagggauaugcucuuuggagagcuuuuucaaaauagcccugcucaggcccaaccucuuaucuaccgagugagaauuugggaggugagcuccagacauguguauucuaugucucucucucucucucucucucucucucuguguguguguguguguguguguguguguguguguauaaaguauauaaauuauuuagaaacagaaucuuguuucguugcccaugcuggagugcaguggcaugauuauaguccccuguaacacuccugggcuuaagugauccucccgcccuaggcuccuuaguagcuaggaauacagguaugugccaccaugcccagccaauuuuuaaauuuuuuguagagacgggcucucacucuguugcucaggcuggccucaagggaucuucccacuuugaccuccuacagcccuaggaucacaggugugagccaccacauuuggcccaagguguauuuuuuuuuuuuuuuuuuuuuuuuuugagacggagucuugcuguuucgcccaggcuggagugcaguggcgccaucucagcucacugcaagcuccgccucccagguucaugccauucuccugccucagccucccaaguagcugggacuacaggcgcccgcaaccacgcccagcuaauuuuuaguauuuuuaguagagaugggguuucaccguguuagccaggauggucucaaucuccugagcucgugaucugcccaucucggccucccaaaguguugggauuacaggcgugagccaccgcaccuggccccaauguguauuuuuauagauggucuucaggaaauaaauacucauauaucugaugggagugcaaaauggcacaaucccuauggggaagaaacuggcagugucuaccaaaauuacagauacguuuuacucuuucaccaagaagugucucuuuuagaaaucuauucugcagauagauugaaccccaaguaagcaaaguuauucacugaaacauuguacauaauagcaaaagauuggaaacaaguguccagcauuuaaggaguguuugaagaaacuauggcucauuuacauuauggaauauuaugauguaguagaaagagauuugcuguaugugcuaaugagagagugaaaaaaaaaaagcaagguguuaaaaagaacauguuguuugacaaacucaugauaaguauucaggcuaggaagccagcugcuauuuauuuaauuucauuggaagauccauacuauauccauagauucauggugccuuagaaaucugacauuagagucuuugguagugcuuuuacugguaaauacaagcauauuaagacagagucuccuaccccauauaaauuucaggugaaagggagaaauuucuuucacaguuauuaauaaaauguguuuauuuccaauaggguaguagaaaaaaacuaacauuuucaaaguacugucuuuuucugaguuuuagauuucugaagagaguaacuacucuguagugcuuauuaccaguuacaguguguagguuucugcuuccugggaggucuguuauaaacaaaugucauuagggaccuagccagguaaucuucauuaaugggaaaacaucaacaaacaaauucauuucugugaagucuccagggguuaaaaccauuugugacucuuucaugccuaaggcucuuuuuagacuuagacaucagaacuauuggacagcucagaaggaucuauaccuuaauaagcuuuucaaguucuuaauggagagacauauagaauauaggcauuucuguaccuuaagccuacucagaaaauaaaaggaagucacauuacugcccaauucguuugcucccuauauucguuuucacacugcugauaaagacauaccugagacugggaagaaaaagagguuuaauuggacuuagaauugcacguggcuggggaggccucagaaucauggugggaggugaaaggcccugcuugcauggugguggcaagagagaaaaaugaggaagaugcaaaaguggaaacccccgauaagcccaucagauccugugagacuuauucacuaccacgagaacaguaugggggaaacugccccaugauucaaauuaucucccaccaugcuccucccacagugcgugggaauuacgggaguacaauucaagaugagguuugggugaggacacagagccaaaccauaucauucugccucuggccccuccaaaucucauguucucacauuucaaaaccaauuaugccuuuccaacagucccccaaagucuuaacucauuucagcguuaacccaaaaguccacaguccaaagucucaucugagacaaggcaagucccuuccgccuaugagccuguaaaaucaaaagcaagcuaguuacuuccuagauacaguggggguacaggcauuggguaaauacagccauuccaaaugggagaaauugaccaaaacaaagggguuacagggcccaugcaagucugaaauccagcagggcaguaaaauuuuaaagcuccaaaaugaucuccuuugacuucaugucucacaucuaggucacggugauucaagagguagguucccauagucuugggcagcuccacgccuguggcuuugcaggguauagcuccacaccuggcuguuuucacaggcugguguucagugucugcggcucuuccaggugcagggugcaagcugucagugaucuaccauucugggguuuggaggaugguggcccucuucucacagcucuacuaggcggugccccaguagggacuccgugugggggcucugaagccacauuucccuucugcacugcccuagcagagguucuccaugagggccccgccccugcagcaaacuuuugccugggcauccaggccuuucuguacaucuucugaaauauagguggagguucccaaaccucaauucuugacuucugugcacccacaggcucaacaccacauggaagcugccaaggucuagggcuuguacccccugaaaccaugggcugagcugucccuugggcccuuuuagcaauggcuggagcaucugggacucagggcaccaagucccuaggcugcacacagccagggacacugggcccggcccauuaaaccauuuuucccuccuaggcuuccgggucuguaaugggaggggcugcauuaagaccuaugacaugcccuggagacauuuuccccauuuucuuggggauuaacauuuggcuccucauuaguuucacaauuucugcaaccagcuugaauuucuccucagaaaauggguuuuucuuuucuacugcauugucaagcugcaaaguuucugaauuuuuaugcuguguuucccuuuuaaaguggaaugcuuuuaacagcacccaagucaccucuugaauguguugcugcuuagaaauuucuccugccagauauccuaaaucaucucucucaaguucaaaguuccacagaucucuagggcaggggcaaaaugccaccagucccuuugcuaaaacaugacaagagucaccuuugcuccacuugcaacaaguuuccucaucuccaucugagaccaccucauccuggaccuuauuguucuuaucacuaucagcauuuuugucaaagccauucaacaagucucuaggagguuccaaacuuucccacauuguccugucuucugagcccuccaaacuguuccaaccucugccugauaccuaguuccaaaguugcuuccauauuuucggguaucuuuucagcaacaccccacucuacugguaccaacuuaacauacuaguccauuuucacacggcuaauaaagacauacccgagacugggaagaaaaagcaguuuaauuggacuuaaaauuccacauggcuggggaggccucaaaauuauggugggaggcgaaagguacuucuuacauggugguggcaagagagaaugagauaaacccaucagcuuucaugagacuaauucauuaccacgagaacaguaugggggaaaccgcccccaugauucaaauuaucucucagcaggugccucccacaacauacgggaauuaugggagcacaauucaagaugagauuuggguggggacacagccaaaccauaucacuccccucguucucuuuccuaaauguguuuuuggagcucuaugccagcaacuacuuaguaacagcgggacauuuuuugguaaacuacauugcuaucucuuugaaaaacacuaaccccucuuauaugaaaaaucuuugugacaacuuagaaguaaguguaagggaacagugcccuucaaaaaaaaaaaaacuugauuauacugugcuuuuuaggagauaauuauaaauuaaugaucuuuagaccuaauuccugacacuuauauaguguuuugcaguuuuacaaagauuugcuucuuaccgguagugcuguaaguaugguaagaauaucaccauuccuaucuuaugaauaaggaaacugaggcucauaugaaugacagcuugcuaacacucacaccacuaguuagugguucagccucacauagacagcagauuaucuauuaugugcagcuccuucacugcucacugcucaauagcucccucuuauuaccauugagguauauuucagaaggcuugaaauuaucauccaguaccuuguuuucucucauuuuauaccuugagaaaccauuuagguaacuagauuuaaguuggaagauagcaaaggaaauuagcaacuagaagugcuuacauuuuucuagagaaguaaagucagauacaacggcuaauguuugugcauauaaugcaaauaguuccaggugcauguggaucauuguauacuuagauaaaagcaccuguguuuauugaagcauuugcuuuauauucuguaccuaaauugguaggcugugauuaucuaccagcacauaaacaaauaugucaugcaaauauguaggauugguggggaggauauaaugaauaaucugaaaauucacauguugaggaaaugaaagcucuuaaacaaaaagcuuuaaaacaaaacugaccucaaaaccaauaaagaguacuaauugcaauaaguuuuggaagagacauaucauaaaaugauuaaaagauuuccagcucuuucacauauaagaauacagccuuaucaaauguggaaaauuucaguugucugagauaaaucuuuguguauauaguaauuuuccucaaaagaguaaaguuaaaaguagccaaauaucaagcauauuuuauuaccuucaaauucacacagcccauauuucugugaagccguaagguaauugucaaguugagauugcaagcucuuugaggacaagaacucuagcuuacuuuauauuuucagcaaaauaggcaccuauaauaaaugcuuguuaacugaaugaaaagaacuuggugagugaguggaggccagaauuccugugacuuguacauauuguuugguuuuguguucuauauuauuuuagcuauaaaguagaaucccaagcacagcucauguuguucacugaaaaagcaggauacagugcaaaaguaugcauacaguaugaucacagccacguaaaacugauaaaaaccauacaaagaaaaaauggugacaaggagauaaauggcagccaccuguauaguuauuacuguggauauuuuucuuuucuguuuuuuaaacuguucuuuuauauuacaauagauuauaaugauauaagcauagguucauuauauaauuauaacguuacaauauacuguuacaauagugugauuggaguuauaagcgaaggacuaauauuucuuuuuucaaaucauguauuuucucuaaaauuggccuucuugauuacguauuccuuuugggagagcauaaaaaacucuuacucaguuuggggcaguauuaucggcagagccaguuuauggagugaaauauauauaaacacaaaaguucauucugccauuucaaauacuuuuuucuuuuuuucccccagacacaaauguauuuagcauauuagagaucucuguaauccacaaauguuuucucaguaaauccuguauuccuggccuuguguuaggccuuggcuccuaaguuggcuuuuuguccaugguguuugguuuggcacuuucucaauuauagaugcaugcugaggcuugccauuguggacuauagaaaaugaauggguaaauuucuauauuagauucccccaaggaauaugugccaaaauagaaucauuaauccuagacugugaauccaugcuuuggaauagcuugaggaauggaugcuuguucuaaaagcccuuuguccuuauuuuggucauuuggaauugucacacuccaguuuuuacuaaaauaaaauaagcuuuguaugcuuugcaaauuugacucaaaauuuauuuggugucuuugcuugagggaauguuuuguuacauagugcaaguacaguucucacuuagaaaccaguaauuuucaacaucuucaucucuuuaaaauaauugcacacaauaccaaaaguacaucuaaaccuuuuacuuuuuaaaguuccuguccagcuggaaucugacacaagacuugacuuaggucuggguuguaucauagggcaggaugaaugcuucacgguaggucaaaaaaacaauuuaaacuucauuccaaauuccacuuuuaguuuuagauguuuuccauggcacuggaggaguaaaucuagaaagcaaggacaggacagcccugacuuaguaagccacagguauggcagucuauacaugaucguuggaucacuuuuuaagauuucugucugggauaauaagaauacuaucucugauuuguacuuuagaguuucaggugcauuuucucauauagagauuucaucaagaaguuccgcuuccagccaugacagugugaagaucucuacagaucugcucccuaauggaacugguaaaaauuauuuuuaagaacaaccauuuaaagucuggaaauagucccaaaggcauacagucaaugaagaaacaccuauucaaaaaaaucuaaaaguaagaaaagugggccggaugcugugucucacucuuguaaucccagcuacuuggguggcuugaggagagaggauugcuugagucuaggaaucugacacuguggugagcuaugaucacgccacugcacuccagcaugggugacagagugagacccuaucucuaaggaaaaaaagcaaggaaagugaaagucuguguuauuugaaccaagaccuguucucccucucuucucuuggcuaagugagauagaacucuucuccaaacuggugcagggaagaauauacgguucccuuucccucuagucccaguuggagugcugucuucacaggagugauggaaugucagcauuucucauccugcccccagcuaccuguugcugaaacuaaauucuggauaaguguagcugagaggugggucuuaccuccuuccauucugcccuuccucaugggauagcagcuguaccuuggaugugacacugcugagaauaccggggccacagucauccugguggcggaacaugguuccaccccaggaaaagcaaaccaaggagaucaaggguugcuguaccuuuacuucaguugagcugucagcccuaaagugagggugucacacagaagcauaccauugucucugcccccagcaucagcaccagggcucagaaauuuuguccaggggaagaagcaagccuuauaaaagagagugcugaaugucuccucaaaggaacugacuucauuugcacagaauauggagaaguucaugccuaagggugcagguugugaugaaaggcacuuggggugacauuaacacagucauuggagauauagguuaacccaaaggccagcuacuuugcuaggaggaaugggauaacugagcuagauugcuagagugaaaggaggaaagugguagcugggaggaacuaucccuucaaaagauuggaucuguuuguggagcaauuuuugccccaggacauuuuugaagacaguagaucagucaaccagcaauuagugucacauaagagcugugugugaucaggaaaagagaaagucagaggggucugccaaagccacugucaucccagugcaacuguggacauacccaauggugugcccuauaaggugcaacauuagggcuucacacuuugaggaagcagagagagaauagacugcuaagauaauuuagccagucacuaaacaaauaaacaaauacaauagcaacuccuggagaagguggguggaagggagugcaaauaccuagaguuguuacaagauguccaguuuccaugggcggggugggggugggggagggaagcaggcaccaaaaacugccuguaugaccagauguuggauuuaacaaagacuucagaguagccauuauaaauauauucagagaacuaaaggaaaccaugauuaaagaaguaacagauguaaugaagucacauaaaauggagaaaucaauacagagauagaaguuauuuuuaaaaagagcccaauagacauucuggaguugaauaaaguacaauaacugaaauaaaaauucacugaaggggcucaacaguagauuugaacuggcagaagaaagaauaagcaaaccugaagacacagcaauagagaauauucaaggcaaagaacagaagaaagaauaaagaaaaacgaagagagccuuagagaauuguggaauaacauuuacauaccagccuacacauaaugggaauaccagaaggagaggagagagaaagaaaggagaagaaaaauauauuugaagaaauaaugguuuaaacuucccaaauuuauuggaaaccuacauauccaggaaguucagugaacccaaagagaugcauaaauacaucauaguaaaaaugcuaaaagccaaagacgaggagaaaaucuugaaaacagcaagagaaaaaugacucaucauuacaagggaaggucaauaagauucacagcugacuuaucagaaauguaagucagugggauaacauauuggaagugcuuaaagaagaaaccucaucuaagaauccuguaucuaguaaagcuauuuuuuaacacugcaagggagauaaagacauuuucagauaaacaaaaaacugaaagaauuuguugcuagcugacucaccuuacaagacuuaauaaaacaaguucuuuagacugaaagcaaguaacccuaaacaguacuuugaauccacgugaagauauaaagaguaccuguaaagcuaauuauguaauuguagaagucaguaugaauacauaauucucccauuuucuguuaauugauuuuaagagcauuuguauaaaacgauauguauauaauguauuguucagucaguaauauagagaaauguaauacacuugccaaaaacagcacaauggugaaugggagcaaagcuguauugaacuaaggaagcaaauccagaugguaacuaggauccacaagaacaaaucaagaaaaccagaaaugauaaauaaggcuaauauaucaaaagcuauaaauguauacuuguucucccagcuucuuuaaaagacaaaauuauaaaguaauaauuauaauaauguauuauuggauuuguaauuuuuauagauguauauaacaauaauacuauagaaaaagggggaagggaauagugaaguagcuacguugucugggguaaauacccgugguucgucuucucacgccaagacaauuuaggacauggacacacaccaggaguuuaggagcggaggucuaauaggcaaaagaaagaaaagaaaacagcucucucucuagugagagagaggggacuucugagaggaaaaaggagccagcagcggaugugccagauuuuauagucagauuugaggaggugaugucugauuuacauagggcucacagacugguucgaucagguaugauguuuacauagcguggggagggcuggccgccccaaccucaucuuauuaugcaaaugaacuuucccauuggccagcacugucuugucugcuccuuaauguacauguggcugacaaagagaagggaagauggagccaccaucuugaauaugauuggcacaacugcuggcauguaugucugcagcucgauuuuacaggcugcucuuuguuagaaaggaaaauaauuuggggcugcuuuucauuaaaaggaaaaccuuaccgaggacuuccguacccucacuaucugccuaaguaauuucuucuuaacuccuguaucaauaauguuauacaggaauguuucuguaucucacuggaauuaguauaaaucuggagcuguuucuaauaagguauauaugcuaagcccuagaauaaugacuaaggacauaacucauacuuacacuuugaaaacuguaaaacauuguuaaaggaaauuagagaagcuuaaaauaaaugaaaaaacaucccauggucauggauuagaagacuuacuauugcuaaaaugucaguacuccucauauugaucuacagauucaacgcaauaccuuuuagaaacccagguggcuuccuuguagaaauugacaagcuaguucuaaaauucauaugaauuuuugacacagaguagucaaaacaaccuugaaaggaagaacaaacucagaggauucacaauuccuuauuuuaaaauuuacuacagggccaagagcgguggcucacaccuauaaucccagcacguuaggaggccgaggugggagggucuguugagcucaggaguucgagaccagccugggcaauauagugagacccccaccccccuccaucucuaaaaagaaaaaagaaauugcuacaaagcaguaauaaccaaggcagcugguauuggugugaggauaaauguagauauuaacaaauggugcugugacacuuagguagccacauguaaaagaaugcagcuggauucuuaccucuugcuguauacaaaaauucaacugaaucaaagacccaaauguaagcauuaaagucauaaaauucuuaggagaaaacauaaagguaaaucuucaugucccuggauuugccaguggauucuuagagauaacaccaaaagcacaaguaauaaaagaaaaaaauaacaugaauuggauuucaucaaaguuaaaauacuuuugugcuuugaaggauacuaucaugaaaguaaaaagacaacccacagaaugggagaaaauauuugcagauccuaugucugauaaaagacguguaucuagacuauguaacucuuacaacucaaaggcaacucaaucuuaaaaugggcaaaugaucugacuagacacuuuuccaaagaagauauacaaauggucaguaaagaugcuugauaucauuagucaucagagaaaugcaaaucaaaaccaccauaaaauaucaauucauacccacuaggauggcuaaaacaaaaaagauaacaaguguugacaagaacuggaagaaaucaaaauccccauacacugcuggugggaauguaguauggugcagcacuuuggaaaacagucugguggauccucaaaagguugaauaauuaccauaugacccagcaguuguacuccugggugucuacccaagagaaguggaaauacauauccacaugaaaacuuguacacaaauauucauggcauuauucauaauugccaaaagauguaaacaugcccaucaccuggugaguggauaaauaaaauguguuauaucuauacaaugaaauauuugaccauacaaaggaauaaacuaacugaugcugcuacaacauggaugaaccuugaaaacauuauguuacacgaaagauaccagacacuuaaaaggccacagauuguaugauuuuauuaacuuaaaauuuuagaauaggcagaucuauggugacaaaguagauucauaguugccaggggcuggaggaagaggggaaucaggaguuacuacuaauagauaucuugagcuucuucuggggaugaugagaauguucuaaaauuagauaauaagggugguugcacaagugugaauauaguaaaaaccaaugaauugcaugcuuuaacaaguugaaucuuacaauaugugaauuauaucucaagcuauuuuaaaauaaauacuaguagauaauguauccucuacacccaucaucguuccaaguacuguuggguauuaacauuuaauccucacaacaaagcuauaaaguagguagaauuuugcuuauuuuacagaugaggaaacaaaggcacgcagagaaauuacucgcugaaaauaaagaaguuggaggccaugauucgagcuuaggcagccuggcuccaagacccgugugcuacaccguacugccgcucauuaauaauuggauugaccuguuguguaguuuaugaaucgauucuauuuauuuccugauuuuaggcacccgaaaugugagauuugauggagaacauaaagcuuugacauuaaacuaguuauagcguugacagaaaacagaagaucaugcuugccaguguaagugacugaauaaaauaacuagugaagaagauagcuguguaguacuggccuuauaacacuuaggcauaucguagaucuuuuugaugccucggauucauuuuuuguugucaaaaauguaagguuuccuuuucucgguagcuggcuuuuuucuuccuuucaaauuuugaucagaugcugagcaaagugcagaaauuuguacaucuuugauguauggaaaacucauagggaccugaaaguucuuggcugaccagauguuuccacguucucaacuccucuauuuguagauaaaaaaacuagagguugacuuacccaagaucagaguuaaugagcagaaaagcuggaacucaaaccaauuccucugucuucuuuucugacuucagugaugaucuuugcagggccuauccucagauagcucacaguguaauaagggacccacagugucuuccaguacaguaugauuccuucuaaggcauccuacacugagggucaucacccugacugaauacuuucgguaauggaaagcuuacagcagccacuguacuuuuuuuuuuuuagauagcuguaauuguuagaaggcuguuacuuauaugaacucuaaaucugcuuugcuuguccuaguuuacccauauuucucucugcugcuguuguccgucauuugacuuagcuuuccaccucuuuuuugccacuuagucuuuaucauuuuuuucccccacuuacugcccaacacauuuaucaaaaagcuuucucuggcaaaauuucuuauaguucauuccuucagucuuuuagcacauagcuuaaauugcugucuauugaaauuuagcauuucuuauucauuuuacauaguuucaaccucccuaauauuauaaacuacuugagucauguucuuuuauaucucacuaacucaaaauagacaucuugucacuaaguuagaauauauuucucuugaauaauuugcaugcacuuaaauuuuaaauugggaacauuuucagauacguuccuguaucagggugguguacauaggugcucaguaauggacacuguagaaucuauagaauuaauagaaaaacugcaguguuauuuuuuauaacaucacuacuucccuuucucaaguggcuuugccauuucauuaaaaugcaaacccuuguaaacaaaacaaaaauauuucuagcaauauuuuucuuguauagaaugugcuuguuaacguuucuugaucuguuuguccaucuggccaucuuuaugauguaaugugcaucaaccuccuacucuaugccaagcacuaugcuagagguuucuaauauaucaucucauuucauauuuauaagcccuaguuguuaucccuaucuauuuagaguuaaggaaauguagcucaagugauuucaagaaauuugcccaagauuaccuagccacaggggcagagcacagcuaguggcugaauccaggugcuuuuuuuacuucaacuauacuguuucaauuaagucacguaaaagaugccuuauacuucauaauagggucuuucauaugcugucuauguaaauaauuaccauaagcaugugagauagauacauuucuaucuuacaaauaaggaaauuuaguuucagaaagaucaauuuacuccagauccaaguucagaaaauagaacuagggauuaggaagaacccacauauuuuguuuccguacuuuuucugcuauauuauuaauguguucuuaugccuuugaagaccucuaaaaucacacagcuaucucauugagacaacuuaacuucccucuuuccccuguucucggcuaucuuagucugcuugagcugucaaaauaccguagacuguauggcuuaaaggacagaaauuuauuucucccaguucugaaggcugggaagucaagaucaagaugcugucaagguagauuuccuuucgaagccuuuucuccuagcuugugagcagcugccaugucacugugugcucacauaaccacuucuuuguaugcauuuauacagcaagaacacaagcucuuggugucucuuauaagggaaguaaucccaagagaccggggccucacccucaugacuucaccuaaccccacuuaccucuguauuaguuuguucuuacucugcuauaaagaaauaccugagacuggguaauuuauaaagaaaagagguuuaauuggcucacaguucuacaggcuguacaggaagcaaggcagcaucuuuccggggaagccucaggaagcuuuuacucauggcagaaggcaaagcuggagggagacaccuuauguggcugagcaggaggaagagagagagaagggggagaugcuacacacuuuuaaacagccagaucucacgagaacucaggacaguaccaaggggaaaauccacccccaugacccagucaccucccaccauguaauucucaccuccggcaccagggauugcauuucaacaugagauugaggggggacacagauccaaaccauaucacuguucgaaagccccaucuccauauauuaauauuaucacauuguggguuagagcuuuaacauaugaaucugggggcaugggacacaaacauacaguccauauguuagcuuaccaucagagucccugacuaucuuucauacgugcuugggcuauuagagcugaaaaccagggauucaaagauagaggaacuaguucagaguggcuaauugaguguuguggaguagauggcauuggagacaaaguaaggaaauuccaaagagauuguauauaggaaagaacuugauucacuaaaaaggcaaagaagcaaaggggcugcuauaggaccaggauuuauaucagccaccaagauaugagguauauguuauugugacaguguucaucuugcagccuugccuaguguacuguauaaucaaacuauagcuugugcuaagaacucccuaaagauuaaaugaguauuguucucucauuugguaaauucuaauuugaaacaaaugaagauaccgcuguauuugccaacauacuaacuuuaaauacuaaaauacauuucacaugggcaguggagaacagggcuuucugaaaaauaggcuuaaguaguaaaagaagcagaguuggcugguacuguguuugaagagaaauagaaaguuuugacauacccauuuuugcccucaaaauggaggcuuguaaguggaagcuuauaaaacuuuucuugucaagaaagaaagggcagcugauugguuuuauaagcuuccauuuacaccuaagcucuuuccuguuaaugaacucuugaugauguaaugugucuuucucaggauugcuaauuagcaaaaaaguuugagccaaacuuguuuaauaauuguuucucagaacuuuauuuucaguuuuuuugacagaucaccaugauauauaacauaacauugauuguguuacugaaacauguacaugugcaggaaaggaaguuagagaugaaauuuaggaagugagauacagccucguucauagagacaguauccauuaaauaaaaagugagaauugccauugccucccauauuacaaguaggaaaaacccucaaguguauauaauauuaaucuuuuacaugaacucagcugcaugaguauucauuuuagaagaucuccauguuagcuuuuuauaaagaauuccaaauuugaccucuagaauccucccagaaccuuuauuaaaaacauauuuuaaaauucuggcaauaagucauuaacuaguauuuuugugaaauacaguuuuugaauagguccgucuuguggaacugacaacauugucccaacuacaguuauaguaagcuuauuuuagaauuuaauacaacccucaucuucugcauguacacauguaccucuuguuccccccuacauacacgugcuguauacagagggcagaaauuaaggacuaucagauuuagguggcugaccuucagcuccaguuaagaacuaaaauuagauccuuguggaauauauauccagugacguucaucacagaagaguguagacauaaccuugagaggccagggaaacaucauccauccaagggagccugccuuaacuacaaaaauuccuuugacaucucauuuuuuaucuuaacauucauguaaguuauguauugugauuuguaaugcauucauuuauuuucauguagaaaucgccuaccccaaauaaaucuuuuaguaaaauagugguuaaagaauauguaccaaaauuacccuaugacuuuaaguaucccuggcacugggccacaucucccagaugaaugugcauaaccuauuuuaagauuagggucuaucccgucacuauaggaguauacugguagauucaagugaguauaauucaagcauguggcuaacacuguagccauaauggacaaaaaagcagggaaggaggagucuauucuauuaucuauucuauuuuuuuaaagagaaaguggcagacuauagggauagguauuucacugccacuacaauaugagaauuuuuuuuuuuuuuuuuuuuuuuuuuuaaguagaaccauguuuaaggauuuaggucuguuuauuuaaggaaaacaaaaaucuguucuuagaaauucccuucacuggccugguuuagcccagaauuucuuuuaauguuaagaacacucauuuuuguuuuaguucuuguguaucacuagauaccaguaaaagagaguaggacugagucaaauaagaauuugaguccccuuuucugcuguagcuuucucugcuaccuuaagcaaaucauuuagccuaucugggagucaguuuucauaucuauaaauccucuuguccugaguauguuaauagguguuauuuuuugaaaggguucuauggucaaaguaaggaaauaucaguuuaaaaaaaaugaacagggcugggcacaguggcucaagccugcaauuccagcacuuugggaggcaaaggugaggggauugcuuaauuaaggcuuggaguuugaaaccagccugggcagcauagcaagacccugucuuuaaaaguaaaaaaaaauagcugaacacaguuaauuggaccucuauuccuagcuacuugggagggugaggcaggaggauccuuugagccccggaguucgaaguuacagugagcugugaucgugccauugcucuccagccugggugacaagagugaugauacccugucucaaaaaaaaaaaaaaaaaaaaaaagcaaguuucuuuuccauaauacaugggagaaucuuugguaguuugauaugccuuauaaguuucccaagcuuauuugccuacaaaacccauuuuuauagaaucuuuuguacugcuaguguuuguuaaugguaagugaucauuauagugccuucuaacucuuaacauucugaaauuggacacaguuuguuugacugugcagcucguuucuagacuguaguuauccuagguuacuaacaaguugaacucaaugcuuguaauguguguguauccugccauuuuuuccagcugguacuggaaaguuauugcauuuuccuguuucuuguaaauaaaacaaacauuacucccugucuuuugcaguuuuucacuuucucugugccccuuuguuucaguguauucaauuauuggcccauuuuuauucuaaauuaaucuauucaucuuuaucugaguuucaccaacucauaguaaagauuucugaaacccucagcccauuaaauccuuuugagaaacacuaauguuggagagaaaacuaugucacuucuacauguggacuuauuucaaucagaaaaacaagccaccuuuaaaauguugcuauugguuaagaucuuuaauuauaggucuuguucuuagaaaugcaaaauuuuagcucuuacuguguaccaucauuucauuuaauaaaacaacauugucauagaaggaguauuauccccguuuuauagguaaugaaacuaaagcucagagaaaccuaauaacuuguccagaucucacaaauaauaaauagcagucauauccaacuuauauucucuauuauaccuuguagcuucuuauuaaaacauaugauaauacuguauguggcaugugugguguaguuacaaugauaaguaacauuuauugacuaauucuaggguagcacaugcacaucaucucauuuaauucccucaacaacccuaugaaguagguacuuuuuuuuccuuccuuucuuucuuuuuuuuuuuuugagacagagucucgcucugucgcccaggcuggagugcaauggcgugaucucugcucacugcagucuccgccuccugggcccaagcgauucuccugccccagccucaugaguggcuaggauuacaggcgcccacuaccacgcccaucuaauuuuuguauuuuuaguagacaugggguuucaccauguuggccaggcuggucucggaacuucugaccucaagugauccgcccgccuuggccucccaaagugcugggcgugagccaccaugccuaggcugaaguagguacuauuauaccaguuuuacagguaaggaaguaaauaaauuggucagguggcagcugggaaucaaauccagagcuuuaauaaccuauuaaauguuuggaaauaauauucuauagcacacagugcuuugaagaugucauacuuaguauguauguuuguaaauauucaacauauuugacagcaucuuugugcauguggaagaagagaaauauguuaaacagacccugcccccgccaaagcugauaaaagagagaacucuccauaaauauaauucaaggucagagguguuaagugcuauaaaagugcuagagauuaaguguucuggauuuagagguggaagggauuacuuccugcugggggauggugaaaaagauagcguuugauuugaagggaggagugauucaagaaggucagggguugggaagacguuuugaauccaggaaguaacaugagaaaaggcacagaaguuuggacaggcauuagagaguagauuauugugccuagaucaaggauauugugacaauaaguaguugaaugugaguuuuagaaaggugaguuaugggggaucgggccccuuccugguuaauguguuuggauguguuuuauuucagguaucuacuaugggacaguuaaagagaaaugucuaccaggcagcaacauuuucuuuuugcugccagcuuuaggaagcaagucaccuaucucagaaguaaaagauaccaccaacaaccaaguuauacaaguuagaaaucuaugagguuccuugccuccucuuucuucuucauucuugaccaaucauuccaccaaucauucagucaauucugcacccuuaaaaucuuuccucugcugggcgccauggcucacugcuguaaucccaacacuuugggaggugagaagaucacuugaguucaggagaucaaggcugcaguaagucauaauggcaccacugcacuccagccuaggugacagagugagacccugucucaaacaacaacaacaaaaaaaacccuguaauuuucccaguuucauuaccacugccuuaguucagaccuccaucaucccucacuaggauuacugcaacaaccacuuaacugcccugcuucugguccugcuccccuuuucuuguucauuuuccacauuaacaucagaguaauauuuccaaaauacaaaucuaaugucauuauccugcuuaauacucugcaguaaguuccccauuucccucuggauuaauuccagacucuucauucuucucauauaaacguggacuaguauauuuucucuuuaaaaaagaaagaacagccuuucuugaucuuacauucccucuuauugccagcccauuucucuguuugucuuacagcaacaucuugaaagguaucuacuucucucucucuuuuucaccucccaguuacucuucagaaacuguuuuuuuguguuugguuuuuuucuuuucuuuuugagauggaguuuugcucuuguugcccaggcuggagugcaauggugcgaucucggcucacagcaaacuccaccucccggguucaagcgacucuucugccucagccucccaaguaacugggauuacaggcaugugccuccaugcccggcuaauuguaauuuuaguagagacgggguuucuccacguuggccaggcuggccucgaacucccgaccucaggugauccgcccaccucggccucccaaagugcugggaguacaggcaugagccacugugccuguccccagaaacuguuuuuaucaaggccauuugugcucuagcauugccaggucuuaaugcuauuugaucuuucaucugcauuucaaacagcugaccauucccuacauaaaauauuuucugccaucuuguguuccagaacaccacacuccuaaauuuccucuugcuaauaccucuuuaccuccuuuaucaguuuuucuuccccacagccacugagugguggcaucuuucauggcuuuuagucccccuuuucucuauauauuuuucucuaggcaaucucauuuacuuuuguaacuuaagaaugccuuuauugccggcgcaauggcucacgccuguaaucccagcacuuugggaggcugagguggguggaucaugaggucaggaguuggagaccagccugaccaaccuggugaaaccccgucucuacuaaaaauacaaaaauuagcugggccugguggugcgcgcguguaaucccagcuacuugagaggcugagacaggggaauugcuugaacccgggaggcggagauugcacgcgccaagaucaugccauugcacuccauccuaggcaagagugagccuccaucucaaaaauaaauaaauaaauaaaagaaugcccuuauucauauagaaagcauagauaacccugauggcugcuuagggcuccagccacauacauucagcuuccuauuugacaucucuaguuaucacaaacuuaaugugaccuuacagaauuuucccccaaaccuguucuuuccucagucauccccuucucaauaaaugguacuauguuggcuuaagccagaaacuucccucucccccacaaauaguaaguccugucaauuuucccucuaaaauacacaccaaauccauucgcuugucucccucuccgcugcuaccacucuaguugaaacuauguuuguuccaguccaacccauuuugauucuguaugguacagauucuguaugguacaucaaugggauaccauauuucaaagcuguauuauauuuagguuaaagcuaaguuguuuuaacaaggggaccucaagauagaagugguuuacaaaauaugaguguuuauuaccuuuucaaguaauaguucugagauaaucauucaggcagugaauggcucugcuuuaugaauuuauucaggggccuguuuccuuucaagucgucaagucaugcuucaccuucugagcauugucuuaaccuaggcuggacugccacuuucagguuuuaggcuauagaaggggauaagacaguggagaagucauacccacugucuucaagagccagaccuggaaauggcauagaucgugucuauacacuuucauucuaguggcaagagcuccaucauauagcagugaagaacaacuggggaauaugguguagcuagguagccaugggccuugccacaguuguuacugcaugagaaaaggacagugaguuuugguggacagcuaucaguuuccaucacagugucuaacaauuaaacuguuagaugagccuacagucagcccucuguauccauagauucaaccaacagaauucaaaaauauuuaggggaggcugggcacuguagcucaugccuguaaucccagcacuuugggaggccaaggcuggcagaucaccugaggucaggaguucgagaccagccuggccaacaugguuaaaccccaucucuacuaaaauacaaaaauuaguggggugugguggcacgugucuguaaucccagcuacucaggaggcuggggcaggagaaucgcuugaaccugggaggcggagguugcagugagcugagaucgcaccacuguacuccagccugggcaaaagagcgagacucugucucaaaaaaaaaaaaaaaaauuaggggaaaaaaccucccaaaacaaugauauaacaguaaaaaauacaaauaaaaaauacaguauaacaauuuacauagcauuuauguuguauuggguauuauaaguagucuagaggugauuuaaaguauaugggagguugugcaaagguuauaugcaaguacuauaccacuuuauauuagggacuugagcaucuguggauuucaguaucuauggagguccuggaacuagccuucugaggacacugagggacaacuauauuuaugaaacuuuauguuauuuauuuauuacucugguaucucaguuuugcuaccuuauaugguugaagaaaacuuacaaaggauaagaaauguggucuagaacagugcuucucaaauuauuugagaugaaggaucaaggucuuuucuuguuuguuuuucccuaauuugcaguaggccaauacuuuucuaaaauauaauaaaaauuaaucacuaaaagaaauaaucaucaaauuacuaugaaaguuucuaaaugcauacucuuuuuuuaugccugucucaccuuauguaccuaucucaacaugaucuagcaacaaggagcuggugaauuggcacuaaucaauggacaauucuucuaaguagcacuugccucaaaaguguuuucuaauaaccuauuuuggauucccagagucuaguagaugaacugugguaucaaucuuuuaaacaaagacauuuucuuuauguauaaaauauaaaacuuuuaauuuuuuaauaguuuuagaaaucaccucuuaagauaguauauaaaucuugauagaucguuugaaugcccacauaugcuucauagccuauuuuguuucauagcuaaagccaaagaugauccuuguuuuauugauucagagugaaaaaaaagccuacuauucuggagcucaaagaagguugucuuagagggcauuuaguuuuaaugcacgguguggagggaaaaaaaggccuaauaaagugacaugcucaaaaucacaauaaaucggagacagcuaugguaugaucauaauuuacaguggaaauuacauuggaaucagaugauccggauugaguccugaucuuuuauuucuuagccaaguggcuccaggcaaucauuuaacguuuuaagaauuguguggugggaccgggcaugguggcucaggccuguaaucccagcacuuugggaggccgaggugggaggaucaccugaggucaggaguuugagaccagccuggccaacauggcgaaaccccaucucuacugaaaauacaaaaauuagcaggcgugguggugugugucuguaaucccagcuauucaggaggcugagacaggagaaucacuugaacuccgaaggcggagguuacagugagccgagauugugccacugcacuucagccugggagacagagaagacucuugucucaaaaaaaaaaaaaaaaaaaaaaagaauugugcaguaaguguucaguaagcauuucuuagauugagaaacauaaaaguuuuuuguaaacuguaaagcacauaagcaaaaaauauuacagguuacacaucccaaauccccaaaccugaaaucuccaaaauuugaaacaaaaaaaaaauuuauggauacguaauaauucuacauauuuaugggguacaugugauacuuugacacaaguguacacaauguauaaugaucaaaucaggguaauugggguauccauccucucaaacuuuuaaaauuucuuuguguuaggaacauuccaauucuguucuucuaguucuuuugaaauauauaauaaauuauugguaacuguaauugaccuguugggcuacugaacacuagaucuuauuccuucuaaugguauuuuuguacccauuaaccaaccccuccauauccaccacaaagccacuucuacuaucacuucuuaggaagaaauaaaacauauuuauuauuuauuauuuauuauuuauuucuuaggaaaaaauaaaacauaauaguagucaccauuaaagagugcuuauuaugucccagcgucuauuuuauaacaucccugugagauauggauguuauuuccuuuuuuuuuuuuuugauccucccaccucagccuccuaaagugcuaggauuauaggcaugagugaccaugcccagccucccauuuuuuaaaaaugggaaacugagguuaagaagugucuaaaucauacagcugguaaaaaaaaaaaaaaagaaagaaaagaaagucacacaguggcaaacccagguauuaaacuccggucuuugauuuaaaagccacuacaauacguuuucuucguaaaaaagaugucccuuccgccuucagagagcuuuuaguaguugaggcaaacucauaaaaagaaaacugacaggacggaugugcuaagcaccaaaugauugcuacagauuugugguuuagguaucccuuagaaaagaagaauguugagggcugaagugguuagggaaaauuuuauguugaaaguggguuuuaagcuuagccuucgagaauugcuaaaacuuaaauagaaaaggaaaaggacugauguguagagggaggcuguaaaaaagcaaagaagcucaauaugagauaauuuggaaagaaauauagcuaaagaggaaaauuugauaagaauaguaugaaagaagacucagagcagguuagcagaucuuaagugccaaacugaggacuuugacauuuuaccuuauaauaauguauaacagauaaccuguacugaacauuuaucacuugccaggcacugcccuauguguuuguacaugcacgaucucauuuaauucuugcaguaaaugagguccagagacaaguaacuugccaaggccacaauuguucagaagaagagccaagauuugcauacaaacaauuuaaauucagaacuucuacucuuaauuaccacacugauuugguuuuagagucuaugguggguugaacaaauuucaagcccaggaucacugaccuuaaacaaguaauaugccucacaccuuuggcaguuuuuaacauuuuaguuaagaaacguaaugugacaauagaaacugacaucucauuccugucccugccacccuuacacaucuuuagcacauggcagugaaggagaagucaagguaaugugcuaaugguuuucaagucugccugcuuuucuguguucgucuggucagguauucucaguuaacccuugacccuaacguccgaauuaugucacucuguuguuaaucauaguucagugauucucacauuguggauucuggaccagcaguagcaucaacuaggaauuuguuaaaagucccauuucuggacccucaucccagaccuacugagucagaaacucuagggaugaggugcaacagucuguuuuuuaaaaguccuuuaggugauuaugaugcaugaugaaguuugagaaccaccuuuagaguccacucuaggauuucaguucgggagcaaacuacuaaaaaguuuuuggcaauccuugauggguagauguaguggcagggcauaccaugcugaaggaacaguggaggaaagacucaggauguaucauggucagggucugggggucaauuuggaacaccugaagaagaaacuguguguguuugcauuguguguaucagacaacaguaggaaaggggaaauugggcccauuucagcagcauucugugggcagcaggaagguaugaaagguguuugaggagagcagagcauguuuuaggaagaguaaaaucaacuuaaauaguuauagcacagaaaaguacugacagggcaaaauaaaggggaaauacaagagcaccuuugaaacauggaagcaguacacaaacucaacagauagaagagcuacaaagaaugcugccuuuucaaccacuuuuauuuguuucuaauaauauucuuuaaauagaaauuauuguauugaguaaaacauuaaauaugucuauuaaacaucacuuuuauuuuuuacguguuuuugguucuaaaaauuguaauuuaaaaagagucguuguccaaaaagugguauuaauuuucaagagauauggcaaaaagcugugcaacagucaccgugugagguaggucuguagugagaaaugguauguucaagaacaacuaugauuaaaaacugugcaaaaaaaucuugucuuugcuugcuggaugaucuucuacaagcuuuuagaugaagcaguuuuuaacuauaaauuuuguaggcaccuuuaaucucuuucaugucccagaguuucucaguccauuugguuuuuguauagcccuggcuauuccaauuugucuucaggcucugcucuuuuucuuucuugagucugaaguuauuaggaagaaagguaccauauugccuauaguuuguuuuuuuuuuuuuaauuuuauugucgcuguuguuuuugguuuagaauggaagaaagauauuugugugcuuuuagauauguagaacuccaaguucacauauauaauauuuuauaauaccuuauuacauguuucucaacuuaaggaggaugguagauauuuccuucuugaauaaaauuguguggaaacaaaggugaucugacuccacccccaggaauauaccacaugugaagcaguauguagaauguauuuuuuugucuugaauaugaaagaucuaaauauggagaaaauuuucccuguucuguauacuuuuaauuaaugggcacauuauacuuuccacuauccccaaacuacauucaaaaaaagugcuuuaacaaugauaguaaaauauuaagagaaaguccuuucuaaauaucagguauggcagggauagaauugacaauguuaugaaauuuuuuuuugucuuaucagauaaaguucuuuuccacaucuauuuagagaacgcaauacagucaucccucuguaucgugcagucugcaucuaugaauuuaaucaauuguagguugaaaauacucaaggaaaaaaaggauaguuguguagaacauguacaaacuuuucugucauuauuccuuaaauaauaaaacgauuuacguagcauuuacauuguauuagauauuauaaauaaucuagugaugucuucaaguauacaguaagaagugcauagguuauaugcaaauacuaugccuuuuuuuuuuuuuuuuuuuuuugagacagagucucgcucuguugccagccuggagugcaguggcaugaucuuggcucacugcaaccuccgacucccugguucaagugauucuccugccucagccucccgaguagcugagauuacaggcacgugccaccaugcccagcuaauuuuuuguauuuuuaguagagacgggguuccaccacguuagccaggauggucuugaucuccugaccucauguuccgccuuccucagccucuugaagugcugggauuacaggcgugagccacugcguccagccuucuauaccauuuuauauaagagacuugaguaucuguggauuuuauuaucugcagaggguucuggaaucaaucccacacagauaccaagggaugacuacauuuaaaauaggcauuuuuguagcugaugacuaugugcacauagccuagguuuccugacaagaucacaaugggacccacaggcagccucuuuuuauugaagaauuaagucugaugauagauuaauagaaauuuuguaaaaucuuauauugguaauaguaguuguuguuuuuauaagauguaagggaguacagaaauguucggugauagaguaguuauaccugcuugccucacauauaaggguaagcuugagagacccagaccugcaguuuguagagaagaaaacugacauugaauuuugagggaguggucagugauccuuaaauuugacaaugguauaaaaaaauccuuuuuaggaaauauaagauauuuggguucauucuagaauuguuuuugagauauugauagcaagguuuggaaccagaacuacuacauauauuuguacagucugugcccuacagcaagauaacaaaagaaagcuaaaauucuguccacagucugagcuuuccaagcuaugugugcuuuuuaauaauuugcccacccagugggaacuuuuuucuguaguuuguauaccaggaggggucaccuuuuugcaauuggcucaaggcauaauagaugcuaauucaacucuauuuggaaccuaacacuugaauaauuuuuuaucaguuugucagcaaaaguucuucucugggguuguuugaugauuaaauauuauuagaucuuagcuaaaggggguucaaggguuucugaaacaugggacugcugcuaaagagcuauaaauucagaagcaauagcaugacuaaaacucagcagaaaugcauacuucuuuaagucuuuuugcaagagccuguacucuggacaaauaugaaccaauucuugagacguuaaucuuuauuucugggaagggaacagcuaugauucaaacugauugucuuccauccugauggugaccuuauauuucaguuucuaacauuccgugauuuaaaaaauaauaaaaaccuuuucucucuggauuuuuaacuguuguuaaguacauuggcagagaaacauucuguguuaagucauuugagccaaauaaugauuuuugcauacucguucuuguuuuucagaaacucugugaaggcauauuuaaaguccuuauaaaggacaucccaacaacaugucaaguguccugccuggaaguacuccgcauucucuccagagacaaaaagguuuuaguuccugugacaacuaaggaaaauaugcagauacugcugcgacuagccaagcuaaaugaguuagaugauucuuuggagaaaguaucagaguucccaguuauuguggagucauuaaaaugucuguguaauauaguguucaacagucagauggcacagcagcucagccuggaacuuaaucuugcugcaaagcucuguaaccuccugagaaagugcaaggaccggaaauuuaucaaugacauuaagugcuuugacuugcgcuugcucuuccuucugucacuuuugcacaccgacaucaggucacaauugcgcuaugagcuccagggacuaccgcugcuaacgcagaucuuggaaagugccuuuagcaucaaguggaccgaugaguaugaaucggccauagaccauaauggaccuccucucucaccucaggagacagacugugccauugaggcccucaaagcucucuucaaugugacgguagacaguuggaaggugcauaaagagguaagguagagaaggcuauuuuugucuaccuggaauuuaauuggucugggacaucccuagaguuuccugcaagagaagaauacaaguugggaaauggaaaaaguucccacuucucccauuaagcaauuguauuacccaggauauacuucuuaaccauuguaagucuuauucuuuccauuugugugauaacaccuaucagaauagguguaaaaauggacuacuauuuuguaagaugccaaauauaguuuucugaguugcauuauucucucuuuuuaagagugccgcuuucaggaauaagguuuaaauuauaagauuugaggggaaacaaaacaauguaguugauaaagcuauaggcauuuucaguggcugccaucuuaaagaaaaguuaagacagaucaagccaauugaaguugaucaaucagaauuggugucugcucaggagaguagaagaugcucuguguaugccuguugucccagucucugggagguuucucuguaguguuagauaacuaucagaggcauaggaccacaacuagauaucugugcucauauauaaguucuagaaaacaagcugauuauaccagagugugggaaagguuauuuuaaaccacuugacuuauuucuaaacaaagaucuuucuucacuguggcuuggacccuucagcaacccaaagugacgcagauuugauaguuuacauuugaguacccacaagaacaauaugcuaaauaggaaacuuaguuuaaggaagucaacaaauuaagugaaguagacauaagcuuuuuucccuccuucuagaagcauaacaugucacauuuauucucuuuuuagcuuuaaauaacuguugaaauucacccccuccuguaaaaagaaagagauuuuugguuccagagcaaauugucuuuuuugacaauugacuuuaagauuuaggcuaacauuugaaacacuucucacccaugaguaaagaucuguuuuugccagcagccuacuuuaaagggauuaucucagugcauuguuauagggggaauaugcagacaucugaguuuuaaagcgcaaauagaucuguauuuugaaacuaaauauuugaauaucagcucuaacagcuguucuagaugacuguaguauggucaguuuuuccugggacuuggcaagaaaagauguggaaagcccacaugcuccauuuaugcauugaaaccaaauauuuggaaguauuuaaaauguuauguuucuaugcuuauuugguaccuucuaugguuauuuuucuuacgcuguuuguuuugggguuuuuaaguucuccauuugagaccuuaaauuccagagacuguugguuugccauuguuagagcccccuguuauuuaaauuauacccaaaauaguagcucacacuguucagauuccugacaaaaaaggguuuaaaauucaguggcuacacaucaguauauuuaugagauggaugauagguaauaaauaucaguauauugagauuaucccuuauuaguauacuucaguuauaaguaauaucggagcuagaagaagcuuuagaaaauguugaaguagcaaauacucauucuguguuauagaauauuuauucuucaaaagauauaugaaaaggaucaguaauccuggagcagguaucucugaccuaguaccuguugugagucaguugauauagccauuauaaaauaugcacauuuaaugugacucugggcuauuauugaagugcucagaaauuuaaauacuauugaaaauaagauucuugccaacccaguuagauaagaaugucuucaugaguuuccaaagucaacuuuuagcaaacauuuagucauucauucauccaaucagucugucagucagugaauauuuauggucaauugcuagacauaaugcccugcauuauguaauauuuuggcaaauaauaggcauugucuuugccuucaugaaacuucaguuuuuuuaggugagauagguaauaaaucaguaaacaaauauauaauucaaauuccguuaagugcuaggagagaaagagcgcacugauugagaauacuuaguaagagaaauuuucugaaggucucuccugagaucugaaaacagaacgauucagccauuugaaaaaccgggggauaaaaaauugggggaugaacauuuuguggaaguuaaacaguguaugaaagacagagaccaaaacauagaguacuuucuagugagggacccacaacauagcauaaagaaaaucucucggccaggcgugguggcucacgccuguaaucccagcacuuugggaggccgaggcggggagaucacgaggucaggagaucaggaccauccuggcuaacacggugaaaccccgucucuacuaaaaaaaaaaauacaaaaaauuagcugggcguggucacgggcgccuguagucccagcuauucgggaggcugaggcaggagaauggcaugaacccgggaggcggagcuugcaguaagcggagaucgcgccacugcacuccagccugggagacagagcgaaacacugucucaaaaaaaaaaaaaaaaaaaucucucaccagagugcagagaaacuugcuacuaagagcccauuuaccuggauuuuaauaucugcuugauuguccgacaaaagacacaaaagacaguuuacuucaauugggcaagcccauaaagaauugccagaauuuuaaaacagugacugaaauaaaaggauauggaaaacuuauuguacagaagaauccaacuuuuaaaauaaacauuuuuuuccuuuuuaugaaaauaauauaugcucauuguauaauaucaaggaaaaaggcauauaagcaauaagaaaauacaaauuaccuguaaacucaccacucaaaagauaaacacuuuuuuuucuuuuuuuuuugagagagucuugcucugucgcccaggcuggaaugcaguggcgcaaucuuagcucacugcaaccucuggcucccagguucaagcaauucuccugccucagccucuggaguagcugggauuacaggcgugcgccaccaugccuggcuaauuuuguauuuuugguagagacgggguuuuaccauguuggccaggcuggucuugaacuccugaccucaugauccacccgccucggccucccaaagugcuaggauuacaggcaugagccaccgcgcccggccucucuuuuuuaacuaaagaacagggucuugucuguugccuaggcuggaaugcaguggugugaucauagcucacugcagcuucgaacuccugggcucaagccguccuccugaguagcugggacuaugagugcaggccaccacacucggcuaauuguuuuuuauucuuuuaagacgugggucuugcuauguuguucaggcuggucuugaacuuguagccucaagcagucuuccuaccucagccucccaaguaguugagauuacagauguaagcuacuacaccaagcacuauuugccuuuugguguguaucuuucuuuuuuuugagauggaguuucccucuuguugcccaggcuggagugcaauggcgcaaucuuggcucacggcaaccucugccuccuggguucaagugauuuuccugccucagccuccagaguagcugagauuacaggcaugugccaccacccauggcuuauuuuauauuuuuaguagagauggggugucuccauguuggucaggcuggucucgaacucccgaccucagugauccgcccaccuuggccucccaaagugcugggauuacaagugucagccacugcgcccagcuggaguauaucuuuuuaacuauucuucauuguauaauauauaaacgaauauauauauacauuuuuacaaaaaugcagucauuuaauaaucuuagucuuuuuucuucacaauaaaaauucauagaguagguuuucaacauguguuucuuuaagccacaagguuccuagcaguggccucugggaguaauuggacagugcuccaaguuccucccucucacuuuaaauaaagagcaccaauuguucuugcuauugcuuuucuuuaaauauagguuguaauuaagauuuaacuugggggauaaaaaggguucuucaacccaaaagaaauuuuugaugaccaccuucuaacuucuugugaaauaauacauacuuauaaguauaaagagaccuaugaaaauaaagaauauggcugggugcagugguggcucacgccuguaaugcuagcacuuugggaggcugaggcaggagcauggcuugagcccaggaguuugagaccagccugggcaacauagugagaccugaucucuacaaaaaauaaaaaaagauaaaaauuauccagguauuguggcaugugccuguaguccuagcuacuugggaggcugaggugggaggaucacuugagcccagaagguuaaggcugcauuaccgcauucccgccuggguaacagcgucucaggaaaaaaaaaaaaaaaaagaggaggaggaauacucauaaguauauaauauauaaguauauauaaaauauauaaaauacuuauauauuauauacuuagaguauuccuucauaaggaaagauguaucaaccuuuaacaaaucucccuuuugaagacacuuagauuguuugcaguugcuugcuguuuuaaauucuaaugauuuuucuuacaaagucuuucuagguacauuccugaaauuggugggccagcggguuucaaaguuucagguguuuuuauauauguugccaaauuuaccuucagaaaaauauuguugguuuauaccuuuucaaacccugggcauuucacuuuuuaaaaucuuugccuguuucacagcuuuacaguuacagaaaaugcaaacauuugguuuuaaacuguuuuaguuauuuuuaugaccacuuucauuuacaguucaccaaaaauagaaaauuaaugacuagguuuuucuugagguuuagcaaauuagugcaauuuguucauuuuagauucaugccucaguguuaaauucgugccugccugcugaugccaucagcagauuaauuuggaguuugcuuuccauucagugggaaauguagcuagccuuauuuccacauguggaaucagccucugucucccuuuccuaaagcuaguguguuuuaaaaagccaauugauuuauuuagcaggauauaaagucaguuuuagaaaaguuaauugaaauggucuugucuuccuccuguuuuaacacuuuucuaaauaucucuguugauggaagagagcauguuauucuagggacuguaaggggucccuagaaugaagaccacauucccuucucccgugcuuccaagguaucagugaaacguaauaagaaaguacagaccagcagacauguuagaaacagacaacccagugcacacagagaaguacaaguaucugaguagucaaaggauaccauuuaaaugagauaaaacagugaguguccauagaaguuaauuaggaaugucacaaaagagguuaguuccaugcuuauuuuaaagacuuugaaggaaauaugcaguaguagaaucugucauuaagaugugaaagcuauauaaagagaucccaaagaauuuccugaguuuuuuucuccauuuuaauguuaccucauuucgauuuucacuaucacaaccaagccugcuugcugucuuucucuuccuuugcccuucauccuuagggacuucuuuucucucucagccuuugaaggugguaucauuucaggaggagagaauauugaugcccugaaaauaucaaaacuaaaucaggaaacaauuaguaaacaguuguauaagcuguguuuguauaaugcuauggaaaaagcaauugcauuucuuugcuggcaucuuugugagacaggagcauuaacccaauuugacaaaugaggacagugaagaucagagaguuuaaauuacuuaaggaaagucacacaguagaauaaccaacaguagaaaauagugucuacuuuaagcuuuguuaagacuucuuaaaugauagcacucaucuaacggauauuuauggagacauagacuaauggaauagaauaaauagaguugauacagucacugacuuacagguaacauugaagugcaguagugaaagaaugggcuuuuuaauaaauggggcuuuaucaauuguauggccauaugggaaaaaagugaauuugaauccccaucuuauaccauacacaaaaaauuaauuugagauggauaagagaccuaaauauacaagguaaauaauaaagcuuacugaagaguaucuucaugacuuuaucucaugcaagucaaacauuucuuauaugagcaaagauuucuaaaacagggcaaaauaaggauaaaauuauuaauuaaagaaaugacaucgauuuucauuaaagugaauucaucaaaagaagcaaaaagacaagacaccaggaggagaagauaugugcaaugacucucuucagaauacacuaaaaaguccuacaaacccauaaaaauaaaaaucagacaccccaauagaaaaauaagcaaagggcguucaggugcgguggcucacgccuguaaucccagcacuuugggagccugaggcaggcagaucacgaggucaggagaucgagaccauccuggcuaacacagugaaaccccaucucuacuaaaaauacaaaaaauuagccggcugugguggcgggugccuguagucccagcuacucaggaggcugaggcaggacaauggcgugaauccgggaggcggagcuugcagcgagccaagaucgugccacugcacuucagccugggcgacagaccgagacuccaucucaaaaaaaaaaaaaaaaaaaaaaaagaagaaaaaaaaagaaaagcaaagggcuugaacaggaacuucacaaaagagauauccaaaugaguaauaaacauaugaaaagguguucaacuuuauuagucaccauaaacaugcauacuacaaccaagaaaucacuacacauccgugagaaugacuaaaaugaaaaaggcugacucuaacaaguauuggugucccuguagagcaacuggugggguauaaauugguauaaguacuuugaaacacuguucagcaguaccugguaaagauugacauauggauauaaccugugagucagcaucuccucucuaggguguauaccuguagauaucaaaugacauguaaaaauuguguucacaucagcacuuuucaagauagccccaagcuggaaacaauccaagugucaucaggaguacagcagauaaguaaauuguggcauauucauacauuggaauacuauauagcagugcuuucuuaaccuaccuguaggugaggaaccagauuuuuuucccuaaaaaucugucaggaugaaacucuuguguaauacaauauuacauacaacgccaaacugcucaaaaguuucuaaauguucacacauaccuucuguacucaugguguugcaggccagugaugaacaggguggggaccagcagugguacacaaacauacuucaaauagcacugcucucaaacaaugacaaagaacagacugcaacuacacagaguagugugaaugaaucucacaagccaacacaagagucuguauuuuaugauuccauacguguaaaguucaguagcaaccaaaauacuaaccugugacauuaacaaguuagaauuacccuugaggagcagaagauggucauuuguaggggguauggaaagaauucugggauucuuaaucuuggcauugcaugauuuuuauguuggcuauauggguaugcucauuuugucaaaauuuagcugugugcuuaugauuugugcacuuuucuguauguacauuauacuuaacauuuacauuaaaauuuauugaugaccuauuaaacacacacccucuuuccucauuaagguaguagauuaguggaggaaacaaaguguaugcaaguaaacaaaugugaaauuacaaauuaugauuucaugagagaaaaaagagucuucucggagaagauacuuuagcugaaaccuggaguaugcaaaggaaccagcgaugcaaagagcagaggcaaacaauccagggauuuugguaguuguuuugaguagagaaauagagcuaauuuaguggauuuagaguaaaagaggacauuguagacaucggguacaacuugggaguugauguuaucaaaacuggaaaagguaaaaaguagaauuuugguuugcagcugcaaauaauggaaagaccaaauggauagauuuccaaaagucugucaacaucagcaugaaaagagaaagauuauuauaucuaaaauaaaggaaaauauaauuuaaagggaaguguauucccuaguuaauuuuuaaaacuaagggaaauaugaucuuaucaagaguuaaguaaugaaugcauuucacauagguauuuaacauaugagauaauuuuuuuuuuuuuuuuugagacggaguuuagcucuuguagcccaggcuggaaugcaauggcaugaucucggcucacugcaaccuccgccuccuggguucaagcaauucuccugccucagccucccgaguagcugggauuaacaggcuugcaccaccaugcccagcuaauuuuuguauuuuuaguagagacgggguuucaccauguuggccaggcuauccucuaacuccugaccucaggugauccacccgccucggccucccgaagugcugggauuacaggcaugaaccacggcacccgacucguaugagagaauuuuuauucaggcguuugagauggauagugaaugggacaacauucauuccaacccuuccagucucagugucucugucauuccaguaguccucuuuguuuuuccccuuucccccuacaaugauuuaucauuuguuucagcucuaucagucuugcuuuuuguucccuuccucuguuacccuucccccaaccuucaaauguuauauugaaagcauuaaagcacuuuuaugcauaucaucuucuuuaauccuuuguaacccugacagaacccuccaguauuuggagauucauguggggaaacugaggcucagagaaacuauacgacuugucuaaagugccaaucuggaguccugaccccaagugcagugccuuuauuucaguuaggccacugaggcccucuucucauccagcucuauacaugaugauguuauauuuaaaauguuaugguccacauuaugaguugugaaagugugcccuaauugcuugcuagauuuuaggagagacaucuuccuagaaggguuaugugaguucuauauaugaauauaggauguauguguauaauuuaugaaaauauaucacuucacauggacuugaaaucgaugauauauuaagaaguuuuggcugggugcaguggcuggcaccuguaaugccagcacauugggaggucaaggcggguggaucaccuguggucaggaguucaagaccagccuggccaacauggugaaacccugucucuacuaaaaauacaaaaagaaaaaaaaaauuagcugggugugguggcgggcaccuguaaucccaucuacucgggaggcugaggcaggagagucgccugaaccuggaaggcggagguugcggugagccgagaucacaccauuguacuccagccuaggcgacaagagcaaaacuccaucucaaaaaaaaaaagaaaaaaguuuuauaauuuuuuaguaguuuuugagguaguuggagucuuccugaaauauggcauauccaggcucucuaucacaauugucucuaauuucaugugucuucuuaauuauuuaaaaucuggaagaagaaagauaugacuuugaugcagauaauuaaagcagguguaauggcccaagaucucacuaaaaaugaagaaguaaaccaaaugaguauucagggcuuaguuuauuuccuacuguuugccuucuugccucuaacucccugugucucuuuaauaccacugccaaugaguaaacauuggagaucacuuguauuucauuacuugcugguaguucugggggaauuaggauauuaagauugauuaaaaugaaguucguggauuuauugcuuugaaaguuaagagaugagacauuuuuauuaaggguguacaaccagucucugaaauaaccugguaacaucacaucuguugaaacuuuuauaaugguuaguaaacugcaacagugcaccauagaaaaaacgaauuuaggcuuuuuggaaaugaaaaaaagucucuagcggaauugaaucuuaagaagguaaaugagaguggcuaggucagcauuucuagaagugguuaugguuguucauaagagauagugacuauuaguauugccucaggaauucuuccuaggauauucugccaucuaaaauguaugguauaagaaugcuuguuuggggugggcaagagauguaguaaaguagcagaccccacuguucaggcauucaacccccaauguuuccucucuuuuuuauuugccauagagugauucucaucaguuccguguaauggcagcuguccuucgucauuguuuacuaaucguagguccaacugaagacaaaacagaagagcuacacagguggguaagcucuguauugauaucccaaugaaggacaucaucaguuguucuugguuuuaugcaucuaauuucaauuguuauaagcacaagaaagugaaaauacuacaguaaaucagguaacugguaggucagaaaucauuaucauggaaaucauuacuaugcccugaugagaaauuuuuauucugcccccuuucacuuuguuauauugaggcucaacaggagaagagaauuuggcauuuguugcaaaugccacaaauaguuacuguucuugguuuuauccagaacaacaauaauaguacacaguuauugaacacuuaacucuguggcauugugcuaagugcuuuauaacgauaacuucuuuaaucaccaugccaacauuauaagguagauucugcaauuuuucccuuuuacuaguugaggaaacugaugcauagaaagaucaagcaauuucucugagauuauacagcccuaacaagugaaagagcugggauuuaaacccugcuuuuaauuacuacacuuaacuaguacucucacuaauuucauuugaagaguacuuaccaaaaaguauauauuuuggcaaugauaguuuuauuuuuuaaaaaaacuuguaagaauuagggcauagugucuagcauuaaaauauauaaaauaggccgggugugguggcucaugccuguaaacccaacacuuugggaguccaaggccgguggaucacuugaggacaggaguuugagaccagccuggccaacauggugaaaccccgucuccauuaaaaauacaaaaaaaguagcugggcaugguggcacaugccuguaauccuagcuacucgggaagccgaggcaggagaaacacugaaccugggagguggagguugcagugagccaaggucgcaccguugcacuccugccuaggcaacagagugagacuccaucucaaaaaauuaauuaauuaauuuuaaaaguaaauaaaauauauaaaauaguucagcugggugcuguggcucaugccuguaauacuagcacuuugggaggcugaggcgggcagaucacuugaguugagccugggcaacauggcaaaacccuaucucuacuaaaaauacaaaaauuagcuggaugugguggcgcacgccuguagacccagcuacuugggaggcugaggugggagaaucucuugaaccucaggaggugaagguugccaugagccgaaauuccgccacuguacuccagccugggugacaaagcgagacccugucucaaauaaauaaauaaaauaguucaaauuuugcgacuuguccguuagaacuauuaacggacugcuguaaaaauuuauuguacucugagaacaacugaauaagaauuaaugcauuuuuccaguucucuuuccauucuggaucagauuuacaauaacaagaguucugacuucaucaugaugcuacucaugaugcuuuauucuauaugaauacaaauggcauuuuaaacaauucaaauaaacucauaucugcaaacaaauuacuuuggcauuaacucuacaaagaauuuaacauaggguuguucuuaauaguagaaauuccuuuuugaacacuuaaaauauucaguuuuccaaaauacggcuuaaauaaaacuauagaaacacagccacaguauaaagugaaacauaugcuuaauuguuauuuuucaauuaaauccauauuauuuuaguuaugaucagcaacuuauuauuugauauuguacugaauuugcugguagguuaucucaguguacucccugcccugcagccugucaaaagacuguuuuucuugauuaaaaaauguaauuguuuuucuguagcuacaaaucaaacauuccuuuaguuuucuuaagacaguaccuuuaaaaaaagucagauuaacugcaauaaaucauauccuaacaagauuuuauuaaacauuuugacccacuguaauuuuuuucguaauuaagagacacuagaaauuuagacccuaaaacuaaaagaaaaugcucuuauaagcccaagaguaaauugauuuuuuuuaagaagucagauaucacaaguuaaauaaucauacaaggaugugaaaggaaggcacuuugaccaaaauugcuauacuagucacaaauacauugccaaagauuucuccgaauaaugaauuuaauaucuugacgcagcacccaguauuuguugaaagagagcaaaacuauguaauagagguuuuuaaaauaaaauuuuuuuaaagaagucguauuuauuuuccuuagugaugcuagcuuuuuuccuuaaauuugcuuuugucuuaaaaguuauuuugauaaaaaccuaucggcuucacuguaaauaaggagcaugccuagagccacagacaggauuuaugaguauuucucagaggcuuuccugggagauugagguugcugcugacuuaacaguuuaucuggaauggccuugcauguuccuuuaaucagaauuagagugauuaguaucauuuugagcaguaaugacuccaggcuaauccauuuaaauucaaugaaaauggcacuaaccucaaagugcuauuuuaggaagcuucuguagugauccugaaaacaauuuuucucuguguguguguuuuaagcauaaaaauuuuuuuaaaggauuucaaaguaacaucucaaauuccauuuuugaaaguuauuuucuaaguuuguuuuugcuuuuuuuuggacacuuugauuugcuuuaaagaaaaguuuaaugaaauagguaacccuggguagcacaguguaugguugugcguuaucaucaaacccaaagaguugugauggugauuaaaugagagguucauaaagcaccucuucccuggcaaugagaaaauacucaguaaauggcacuugcugccgcugcugccaccacugccacugugccacugaugugcuacuucuauuaguauuaugauaaacauacuggauuuuagaauauuuaguuauuuuaaaucuuuuuuuaaaaguuguuuguugauuuugauacgcuguuuaggaacuuaugccuauguucauccugugaucauguaaagacaucuuuuuucuuuuaauccaaguguuucugaagccagauaaguucuaugauauaugcauguuaggagccuauaaaggugcuuuaggagaaaaguagguuaaaaaaaauagccuggcagcuuuuucugauacguugucuuuguaagacagugcaguuuuuucagagaagucaagaggacauggacauagagaugaaaugaguuagcucguaaagacagcagaccuugaccuucauuuccacuaaucaacauuuuauauggcuuuuaaaaucuauucuuucauuuccuuuugucuguacuuaaugguaacagguagguuguugguaugauccaccuuuuuugcuccacugaaggacauccuaauucuguucauuucuaugugccugaaaguauuuucagcacuccaguccauaaucaacaagcuuaugcauaaauacuuagcccaaaaaaguuggcaugugguugugguuuuauuuuauuuuggagagaagggaagaaaucaggauggccuauaugcugaugagaggaggggaggaccagauuugauuuaauuuauuuuaggcucucaaucucguuuucuuuuacucacugaguacauugguauuuauaaagcuuuuuguuacuguuucuuuguuuagacuaauucacuuugucucacauauugaaggggacaauauaguacauaauacaguaccuaauaacaccuuauuacagugcuaaauacaaugccuuaaacauggcagucuuuuuuucuuucaguuuuuuuuauagugguaaaauacaguuauaaaauuugcuaucuuuuaaguguacaauuuggugguucuauuuauaaugugcaaccaucaccaccauccuucuccguaacucuuuucauuuauucauuaagauggcuccaucuucuccacugcacacagagguguuuuucaaaaagcaaaugccugcuuuaaaucuugucauggcuccucuuugucuuaaggaauaagagaaaacuuuuuggcagcaggauuggugggggaucauugugcaaguauuuaugaucuguagucucauguggaaaaucuguuucuccugauuaguucucucuuucauccuguauauaugauucuaccaaaccuuugaauauauauaugugagaguuuauuucugagcucucuauucuauuucauuugucuguauggcuucaggccaguaacacacuguuuugguuacuguagcuuuauaguaaguuuugaaaugaguaagugugaguucuccagcuuuguucuuuuucaagauuauuuugacuauucagagucccuugagauuccauaugaauuuuaaaguggguuuuucuauuucuaaaaaagagugucauggggauuuucauaaggauugcguugaaccuauagaaugcuuuggguuguauuaacauuuuaacaauacugucuucuaauuacacaaggcagacuuuuaauaaauguuugaaaauugauuucauuuguuuauuaauuaagcacuacuauguguuaggcacuauguugaguaacaaaggugaauacagcacagucucuguucuccaugacucgcuaaucaauagauaagacagauuuguaaguaaauagguagaguuguuuugaugagugcgguauuagacaugaauaagcuuauauaguuguacagaaaaggauaauuuacuuuggagagauugagaagggguuuggauugguuuuguuguaaucauaaagcucuuagcucuuuaagcugacucucuguaaaugacagucaucuaggugaacagauguuuucugaacuauagcugaacacuggucuuagaggacuucacaaugcauaccuggaggaacauggagacuaaauucccagacugcccgauuuaaauuaagacccucccucccccucaugcacauaucuugucacugucuuaucaucugcuuuauuuuuuuuauaaggagaaaagacauaaauguuaggaaagcuaaauaacaauucgagacagggauagagagauaucacagauuuuuuuuuaguaguuucccaguaaauuaauuauucaaauaauaauugcuaauagaauucaaagggcaauguaaguauggucugucaugaugaagaaagucuuccuugcucaaaugauaccuguccuggccuuuuccagacuucuaguccucugaugauuccuuuuucuccuaucucuaaguccucuuauagauuuccuuucuuccaucucuauucuaaaacauuuguucaucauuucaaccugcuccacuccauuaccauguccugccagucuuaaagcacucaacccuagaucugucagcccaccuucuuucuccacaggcugcugagcccuaagggaaaguuuuaccuaaccugacagauggcuccaucuucuccacugcacacagagguguuuuucaaaaagcggauuucuacuuuaaguccuuucguggcucuucucugucuuaaggauuaagagaaaaaaaauuuuuuuaaucacuuugcauguguuuaugauaugcagucuuauguagaaaaucuguuuccccuggucaguucccacuuucauccuauguauaugauucuaccaaaccuuugcaacucucuaaaggccuucugcacccccuuguccucagaagauaacauguuuuuacuuaguuuuuauuauggauauuugggguggccuggcaacaugguguagggguugugagauuaugagagagcuuaaagccuucaaauacaucuuagcauggccauugaagccugacaucuggauuaaaucuaaacccuuucaacaagacuucagggcagaauaucaugcuaucaugcuaaagugucagagucucugccuaauaaauugggcaaaaugcuguuaucauggcaauaugccaguaacuucugaaugagggaaaccaucucugguugcguuguauuggaugaauccauggaauuggaucugaggcauuggccuucaccuugggaacucucugccccgagagcauccgucuuucuguuaucaagcaacacauuugcauggcauggagccacuuccucccuuugccuccaggagccuaccauuccacaaucugcaugacuuuguauucaagcuacucugcucuucuuucucuuccuuagacauagauuccuuauuagggccuuuacacuugcucugucuacugcguggaauccuuuucccagaucuuuaagaggcugaguccuucuugacacugagaacucagcucaaaugucacuuccucaguuaggccuucccugacugccuaauuuagauuaagaacucccucccagcccccugccaccacacacacacauaucuugucacuaucuuaucaucugcuuuauuuuuuucaugguacuuaucacuaacugaaauaaucuucauuuuuuauuuuuccacuuguuuauuguuucucuccuucauuaaauuguauguaaucccagcauuuugggaggccaaggcggguggaucgccugaggucaugaguucgaggccagccuggccaacauggugaaaccacgucucuaccaaaaacacaaaaauuagaugggcggguggugggcaccuguagucccaguuacucaggaggcugaggccggagaaucgcuugaaccuggggggcugagauugcagugagcugagauggggccacugcacuccagccugggagacagagcaagacucuguaugaaaaaaaaaaaaaaauuuaugcuuaaaaagagugaagauugugucugucuucucugccauuauauacccaacaccuagaacagguauacuuaguaaaugcucaauaaauauuaguuggaugaagggauggauagauagaugaucuugcugaccucuuaagaggcuaauuggaaacugucaagcaggaucguucuuaaacccuuaauuccccaucccuaccuauaaguguacuguaaaauguaccuauucuuuccuguuuucugccaaucucaggaaauuaaguggcucucucgcugcccaagguuaaugcccacaccuuuuucuucugccucuugaggccuuauuucagcauugaacuccuccucuaguucuucagucucuucuuugggcuuuaucccuucaauaugugacaugcugagaucuaucccuuuugugaggaaaaaaaaaucuuuuaucggaucuuugucaccucagagauaugacccuguuucuucccuuccauucacagcuaaguuuuuugacaguguuuugugugccauuagccucuaaauauuuugaucauauuccuaaucaauaaaaauuuuugaauacacccucaaguauauuuauuuacauauaccuuauauauauaugcugcuaaacugacauacgaaauaaugaaauuauauacaaauaauaaaaagggauaacauagagauuaauauuuuaaaauagauuuuuaaaauuaaccugccacaaacuuucaaaauuaucagcugggcgugguggcucacgccuguaaucccagcacuuugggaggcugaggugggcagaucacuugaggucagaaguucgagaccagccugaccaacauggagaaacccugucucuauuaaaaauacaaaauuagcaaggcaugaugacgcaugccuguaaucccagcuacuugggaggcugaggcaggagaaucguuugaaccugggaggcaaaaguugcggugagcuuagauugugccacugcacuccagccugggugacagagugagacucugucucaaaaaaagaaaaaaaaaauuaucaaauagcagaaguuuuucuuuauguucugcacacuuacuauuuaaguaccuuguuaauugugguggcuuugaacuaucauuagcuaauagcugugggcacauuauauacuugauauguuuggauauuuuguccccaccaaaucucauguugaaaggugaccuccaauguuggaggugggccuagugggagguguuugagucauggggguggauccucaugaaugcuuggugcuguccuccccauaacaagugaguucucacucugugaucacucgagaucuagcuguuaaaagaaccuagcaccuucucccccucuuucuugcugccgcucuugcugugugauacuccugcucucccuucgucuuccaccaugauuguaagcuuccugagacccucaccagaagccaguaagauacaagugcuaugcuuguacauccugcagaacugugagccaaauaaaccuuucuuuauaaauuacccagucucagcuauuccuuuaugggacuaauacaguacuuaaggcaagacuccuaaguauuguaguaguugugaauucauguuacagauaauuuccaguuuuucuaaaacuaguuucuugucagaucuguuuggauuguccuuguuuugacucaugauaauggcauacaaaaggcucugccauuuucuuauccuuugcuuauacuaauuaucuucaauguuggugucuuuguauuauaggaauuauuuaaaacaguuuguucauuuuacaagaauugguuuaguuaaaacuggauauaauauauaaacccaguuaacugggcauauguaaauuguaauaugaccaaugaagaaagcaaaugagugaccaggaaggaaggacaucacugcuacccuucuguaacauggaauuuuaacucuucucucaauuuuaauacuucuuucaaaguaucucaagauacuuugcauuuguuugugacauggggagcauuugauuuaugguucaggucuggguaccaaugucaauucauuuauaaaauauuaguaaagcuuaauuucuuuucaacuuuuuagauaaaaauaauaaaaauaaaacuauuucggccggguguaguggcucacgccuguaaucccagcacuuugggaggccgaggcaggcagaucacgaggucaagagaucgagaccauccuggcuaacacggugaaaccccgucucuauuaaaaauacaaaaaaaucagccaggugugguggcgggugccuguagucccagguacuugggaggcugaggcaggagaauggcgugaaccugggaggcagagcuugcagugagcugagauugcgccagugcacuccagccugggcgacagagcgagacucugucucaaaaaaaaaaaaaaaaaaaaaaaaaaguagaacucuuuucuucccacacccaguagaucaucuuauguaccuccaggguuguaucuaccucacuuugcagacuacugguuuguacuuaccguuuccauggcuuuacccucuauucauucuucagcccacuguaaucaggcuucugcaucuauuccucugccagcacaacucugguuuaaggucauuaguaaguuaccuuaucauaacauacaagacuuuuuauaauguccccaccccauuucauacauacauaaauagaccuuucuggucuuauuaccuacuaagaccccuccuuuagaggccuuaucauuugcuuuagguuuaggaaccuguuuucaguuccccacaaguaccauaaucucucauuccuccaaauuuuugcuauucccucuuauaguggaauaugucugcuguucagaagcuccuuaauuguugacauuuacuaugugccaggcagaaugcuuugcaugccuuucuucauuuaauacccacaucaaccugguaaguuuaagcuccuuuauuuuagagguaggacaaggccuagaagagguuguauaauuugccuaaggcauacuagaauucaaacccagugcuuuacuaauuauguuaugcugccuucccuuacgaaaaggaguuuauuuucuuuuuuauaccuggcaccuagcacaaggcauagcaaauauuauauuuguugaaugaauaaagugagguuugagcuagucuuaaagaaugaaaauguucuaggcaggagaaaacauggacaaauacagaaaagagaguaugucuacagcacauuuagagaacaaugaccuggucaccauggguuaaaagguauuucacugaggguagcauucaggggucuuuccauucaaaguuuucuugaagcuuccccaccuguugcugcuguagucaucucuuguucuuuguagcaaaacuccuuuaagugguaacuaucugauuccucuacuguucuuuugaauccaguucaccgaggcuuuuagccucacuacuccacuuagaauggcuauuguuagggucacuagugacuucuguguugcuaaauccaguggacauuuuucagucaucuuacuugaucugucagcaucauuugacacagaucaucacuccauucuuagauaccaugcugucuugguuuuccucuuaccuaacuaauuguaaauucuuugucuacuccucagccucugaaugauugaucgagugcuccagucucagcuuucauagucuuuuaauccacacucacuccuuuacugaucuaauacagucuucucuuuaaauaccaucuacaugcugaugacuuuucaguuuauaucccucuguaacccugaucucccucccugaacuccagacucaccuagcuaauuuccuauuaacaucuccacuuggaugucaacuagacaccccaaacuuaacauccaaaauuaaacucucuaucaucccccuaaaaagcuucuucucuugcaguguuucccauuuucaguuuauggcaccuccagcuuuucacuugcuaaggcuagaacuuuagauucucucacacuccacacuagccugucaggaaauccuucauuauguaucgaaugaaccacuucacuguuaauaccuugugcacucaccugaauuauugcaguaacauucuaacuauucucccuuaccuuugauggccuacugacuguccucaaugcaguagccagagugaccuuuuuaaccuaaguuaagaggaucucaucaugcaaaacccugcaaugaaugauuuuccacuuccaucagaauaagaucuaaaguuauaauauccuacaagaccaaucuggucuucucuguuaucuaccugaugucauauccuacuccucuuauguauggugggucagccacaccaacuucuuuacuguucuucagacaugccacugcuccugccccagagccuuugcuuuuacucuucuuccucugaugcuccuuccucagucacauuacucucucucuaaucccuucaagucauuuaaauaacucaucucagugaagccuucccuaaccauccuauuuaaacguauaacccggccgggcgcaguggcgcacaccuguaaucccagcacuuugggaggcugaggcaggcggaucacgaggucaggaguucgagaccagccugaccaacauggugaaacccugucucuacuaaaaauacaaaaauuagccaggcaugguggcacacaucuguaauuccagcuacucaggaggcugaggcaggagaaucgcuugaacccaggaggcggagguugcagcgagccaagauggcgccauuguacuccagccugggcgacagagcaagacuguuucucaaaaaaaaaaaaguauaacccauacauacuaguuuacccucauggguuauucccccagagcacuuaucaccuucuagcauauuauuuaauuaacuuuaaaaaaauuuuauuuacuuuucuguccaugccagagaauaaguucugugaggacaggaauuuuuucuuuauuuucuuugugauaccugccugaaauagugccuggcauaaguaaauaauaaauaauuacuggauugaguuagauuaaauaaaauuauuuauuuacaucugaaaaucuuuuguuuuuuuuuuuuuuuuuuuugacagagagucucacuguguugcccaggcuggagugcaguagugcagucuuggcucacugcauccucugccuccugggugcaaccaguucuccugcuucauccucccaaguagcugggauuacaggcacgcgccagcaugccuggcuaauuuuuguauuuuuaguggagaugggguuuuagcacguuggccaggcugaucucgaacuccugaccucaggugauccacccaccucagccuccugaagugcugagauuacaggcgugagcaccacaccuggucggggaucguucuuuucguugccugaaucauuucagaugguuuuauugugguuugguugauacacaaaaagcuguacauaguuaauguauacaacuugaugaguuuggaauucuaaguaaauaccugagagguauuaccauaaucaaggccauaaacuuugucaucaaaacaguuuuuguauuggcauaaaacagacauauugaccaaaagaacaaaagaaagaguccagaaauaaacucaugcauauauaguuaucuucaacaagggugccaagaauacacaauggggaaaaaaauagucucuucaauaaaugguuuugggaagacuggauuucacuaaaagaaugaaauugaauccuuaucucacaucauacacaaaaaucaacucaaaauagauuaaagacuuaaauguaaaaccuaaaacaauaaaacucuuagaagaacacuuaaauuagccaggcauggugacacaccuguagucucagcuacuccggaggcucaggugggaggaucacuugaacuugagagguugaggcuguaaugagcugugaucacacuacugcauucuaaccuaagcaacagaacaauacccugucaaaaaaaaaaaaaaaagagggaggaggagcaggaggagcaggagcaggagacgugagagaaaaagcuuacggacauuggucuuggcaaugauuucuuggguaugacaccaaaagcacaggcaacaaaagcaaauauagacaaguagaauuacaugaaacuagaaaacuucugcacagcaaaggaaacagucaacaaaaugaaaaggcagcuuaagaaaugggagaaaguauuuucaauccauauaccucaagagguuaauaucuaaaaccuauuaaaaaacucuuaauagccaaaaaaaaaaccugauuuuaaaaugggcaaagaaccugaauagacauuuaaccaacgaagacaugcaaacagacaacagguacaugaaaagguacuuaacaucacuaaugcaaaucaaaaccucaguaucaccucauaccuuguuagaaggguuauuccaaaaaaaaaaaaaaaaccucaaaaaacaaaagauaaucgaugguaaggaugugaagaaaaggaaaucuuuuuacacuguuggugggaauguaaauuaguauagccauuauggaaaacaguguggaguuuucucaaaagaugaaaaauagaauuauuugauucagcaaucacgcuucugggaguauauccaaaggaaauaaaaucacuguuucacagagauaucugcauuuucaucacaugguccuuacagcacuguucacaauagccaagauacugaaacaaccuaaaugucuaucagucagaugaauggauaaaaugugcguauauauguauacacacacagagcagaaucaguagaguauuauucagccuuuaaaaaaagaaggaaaucccaucacuuggaacaacauggguggaucuggagggcauuaugauaagugaaauaaaccaggcacaggacaaauacuccaugaucccacuuuuaugaggaguuuaaaauagugaagcuuguagaacuagauaguagaauagugguuaucuggggcuggggagaggaguaaauggggaggugucagucaaaagauacaaaguuuuaguuaugcaagauaaggucuggagaucuccuguguagcagagccuauaguuagcaauacuguauuguauacuuagaauguugcuaagggaauaggucuuacguuaagugcucuuaccacaaaagaaaaaaauacuuuucaaagauuuugagggguuugggugcaguggcucacgccuguaauuccagcacuuugggaagccauggcaggaagauugcuugagcccaggaguuugagaccagcuuggggagcauagugagaccuugucucuacuaaaaauuaaaaaauuagcaaggggcaugguggcgugugcguguggucccagcuacucaggaggcugaggugggaggaucauuugagcccgggaagucaaggcugcagugagccaugaucaugccacugcacucuggccugggcaagagacucuaucucaaaaacaauuuuuuuuaaugaauaaagagggcaaaaggaaaaucuuuuggagauuuuaagauucguuuacauagacuuuacagccuugaaaaaagauauguaagccccaaauauaaagaagauacauuugaccagcaagauuuauuaacagcuauggaucuacgugugccauaucauguucuucaguguaauuucauguuuuuguccagcgauucacagaggacuagauuuuagauugccuuuccucucccacaacugacaaggcuuuaaucagggcauuaaggaguucuaaauaggucuugcuuuugaaucugcauaucaggagggggcugggagcaugagcgggaggaugucaugucucagugauuaaugaucucuaggaagcugaaaaggggaguguaauauacacaguauuucuacccccuggaguaggaaugcaaacacuauugugcagaucugugcauagucacugacuuccugguagcuggagaauuucauacacucuucuaccacaaauaaaacugucagagaagugacagagcucaaaaagcuggccuuccuuacuuaaaaagaauagcucaaacacagugagccagaaaaauuaauuuuguaguuguuuggaaaccaaguuguuaaauaagaaauaagaaaaugggaacuuuucuugaaaagccuaaaaccuccaaauauuuguugaaucaaacucuacauuugguuucuuaaauuuacugaauuccuggaaacugcuuacuuuaaacgaauuuaaaggggaaacauuccuuuguaaugaaaugacccaucugaaacuuuucaaucuggucucugguagguucagagcaucauacggucaguguauuuaagagccuauugccugauguuuagggaaaaaaucauaacauuucagaauggcuuguauacaguuuuugaaaauaauucuaagguagaguuauuuccccccuuuuauucucaaugaaucuaugguauuauuuaguaacaauuucuaagugcuuaagauagaagcaaaacguucugaacuauagauaagauaaacuacagauauuugcaaaaaaaaguuuuaagagaaaguuuuggggaaagcuuauauuucagccaccuuugauuauuuaccaauaaccaaauauagagauuuugugcauaacaccaguagcagcagcaguauuugguuuuagugagggcaaucaaauaacuuguauuuuacuaggaaccauuuauucauaugacuuguuaaauuauuuuuugcucuugauucauuuuuuugaugcccuauacauuaccacuuucuguucugcauugucuaacuuuucaacugacuuguuacugguuuuuauuuuuccauaauauaaaaagaaaggaaauauucauucuuggggaaguggagcacaauucaggguagaggaaagaaaaauuuuuguauuucuauuucuuuguuuuucuguuuguuuugcuuuauuuuuuagggugucacuauaaucuaaaguagaaggagcuacuggucuaaauuaagauaguaucagauagauuaagcucuaaauuugguuuccaagugguuggacuuuuaaauugcauuugcaggaguuuauuuuuagucaggaugugguuauuuuuagaucugcuucucugucacuaggaaauaaaaugccugucuuuccauuguugaucaggaaguucuaaggcacaggcauauaagagccaguuagcccagaacaccaccacuccuuuuagaugaaagaauaugaaauaacucauggaagaaaauauguuuguugagaacauaucuaauuuugaaauuguuagugucauuuuaaucuuuuguacacugaacaacagaacaagguuuuuagggaaugccaaaaauauaagguuuggguucccccuacuggugugcaucccagucucguguauucauuaauacacagcugaaaggccuaggggcuagagauuagaaauagcuauauuaacuucauuuagagaccugaugauaagaaagagagaaaaaacuccauuucccuuuuucugcauaugucuuacaaaaauugggaugauuuuuaaauuguauuuucuacauuuagaaagaauaaaacuuaauucuaccauauuugguuuauuguuguugcuacugauaagcugcuuauuuucaguguuucucaaaugcuuuauguuguaaucuaaggaauaauaaaacaccaguggauccacaaaaggauuuaaaaucccagggaagaaaugcaaagcuagcauuguugccauaauaaaauuaaggagcuggcauuaaagcucacuaauuccuauuuuagcauuucagaaagugacaugacaucaugugauugugucugucuauucaacauuuguuuuuuuucuaauuuguacaacauauauuugaaacaguuuuuuauuuccuaucucauaguaagugucaaguguccauaauggcucauuuuuggaaaagaaauauuuuaauugacucuuaaaagucacuuuugaacuucuuauuauguuugcauuuuaaaggacuauucaaucaaguuaaaauauuguauuuuuuuaauugcuuuucagcaaugcagucaaccuuuuaagcaauguuccagucucuuguuuggauguucucauuuguccguuaacccaugaagaaacagcccaagaggcaacgacucuagaugaacugcccaguaauaaaacagcugagaaagaaacaguuuugaaaaacaauaccaugguauacaaugguaugaauauggaggccauucauguuuuacugaauuuuauggagaagagaauagacaagguaaggcugauaaaauggaagcccugggaagaugcuuccaaagaauguaaaugugccauacauacagacacacaucacagagcaugauuuuuaaaucuaagcuuuuuuucugacugaugugcugcauaauuguuuuuacuuuggaaagcaguuuauuacaauauaugauaaauugcugaagccauguuaauuuauuuguuuaaugcugaaaauuauguucaugcaacaccaaaauuaugacuagugcuugaaaacaaaggaaaaaguaauuacuguuccauuuuguuacuuugugaguccuagaaauaaaaaauauccccccaaaaacuugcuaaauacucuucauaauaccuaaaagacaucuucccaaaaaaaagaaaaaagaagaccuugucaauuucccauuuguugugagcuguuuauacauucucuggucuaucacucacuuugucagguaucuguauuaaaaggcagcaagguagcauaguccagucaccaaaauuuugcuucauucaagcccuuuggcuaagcccaugggaauccuagaaaauguaggaacauccaggaaggaccaaaaaaggcaauaguaaacaugaagaugauaaaauggaaauguuuuuaggaaaagaauuuuuaaaauaguuuguaagcuuagguaacauaagauguccccaccucguggaucacgaggucaggagaucgagaccauccuggcuaacauggugaaaccccaucucuacuaaaaguacaaaaaauuagccaggugugguggugggcaccuguagucccagcuacucaggaggcugaggcaggagaauggcgugaacccgggagguggagcuugcagugagccgagauugcgccgcugcacuccagccugggcaacagagggagacucccucucccaaaaaaaaaaaaaaaaaaaaaguccccaccucaaaaacaaauugauauccucaguuacaugaaggaaaguaauacuguuagaaacaaaacuaacguauuucaaaaacauaugguuuuuuuuuuuauagggaagcagcuauagagagggucuaacuccaguucucagcuuauuaaccgaauguucccgagcccaucgaaacauccgaaaauuucucaaagaucagguaacugcuuaaugcauauuacauugcaaaguuagucuuuuuaugugcauuuuaaacauagaauuaauugaauuuucucacaaugauuuuguuucagauaaucagaaacucagucuuaaucuuugaaaucuucuuaaucaagaaguguguauuuuuugagucauucauucagcaaaugcuaccgagaucugcugugugugcuguguuuugggcauugaacaacagaugaagucuuuccccuugggaaguuuauuuuguagagagggggacaaaaaguaaacaaauuuaaaauauaauggcagguggugauaagcauucugaagaaagguaaagcauuuuaagagagaggagacacuuuaagggaacaagggaggaccucucugagaugacauuugaacagaaagguggaaaaguaagaguaucucugagaaugauuggaaaggaaugucccugagagaacaaguucacaaucccugagacaagaggaugcuuugguacacuuaaggaaaagcaagaaggccugugugacuaggccacaauaugcaagggggagagugguagauaaagagagguaacaagagccagauacagcaggcgguguaggacuuuccauucucuucuaagugagaugagaagauauuggaguguuuuaagaggggaagugaugugaccuuauuuaugcuuaaagauauccuggcuacuauuuguaagauugacauaguggagcacaaauggaugcaaggagacaaguccaaaagauaacugauguugcauguuuggaguaggaugguagugguuagaguucauacuuggggauauguuuuaaauauuuuaauaugucuuaaaaguagcucacagaacuugcugauagauuggaguauggguugaaaaagaaaaaauaagggugauuuuuaaacuuucagauuauaucuuagacuacaaguguaagacuuugauuguaacaauaccugaaacuagccuccucuaaaaucccaauuucaagcaccuucucuuauuuaguacccucaauccaacauucuuucuuccucggaggauugucagucugucauuuuuucccacuguucuucacucacuugugccuucucuccuuacccaggcuagauuccaccugagguucauuacuauaaucacuccuuuccauacaucucuaacuagcaccuugugcgcucccucagucguacucaccuggcaaaaccuaacaaacuggcuaacuccagcuuucuuccuacucugggucuccaccaagcacuugaacaugauaagagaaaaugacacaaccauuuugacgagucuacuuuaaauuuaagaccaccagccccaaccgguuccuuagcaaacuccaagaugacuauuucacagcuuuucuucacaccuccaaugcuuacugcccucuccucacucucauuucuugacuuuguuuccuguuucaucaugaaauuaagaaaaaacuuuaucuuuccaccauugcaucugcuaucugucugcaucuauacugccauaucccuuguauucccaucugucacaauggaugaaucauugcuacuucuguggccagcauuuguccuggaucucuuucucucucauuaacuuugcaccugcauuuauuuccccucucucucuucuuauauuaaucauuuuaaaaaauguauuggaucauuuaucagcacccaaacacaucuuucaucuuaaaaacaaaaacaccuucccuuaucccacuucucaagcugccuuucuauuucuaugcuccucuuuaugcaguguccucagaagaguucucuguacucacucucucuauucuuuuuacucguuuuugacuccuaaacccucuguaggcuacaugccuuccgccccacugcaaagguguuuaucagagucaccaacucaacuuugccaaagcuaauaguucucaagucucuuuuuuuaaauucuccaauagaauuugauguaaguauucccuccuccuugaaauacuuucuucacuugguuucuaggacacaauagagaaccucuuuguugaucuuccucguuuuccuaacccuaaauguuugagugccccgaggcaauacuaucuugucucuaucucugcugccauggugaucucauucaagagucaugguuuugaaaaucauccauauaugcugaugacucucaaauuuauaucuccagcccugaccugucaccuaagcucuagacuuauacagugaacugccgacucaucuccuccucuuggauguauaguagguaucucaaguuuaacauaccucaaacuaauaucuugauuuucaucccuccaaccuauuucuuccccuucuuuccacauuucaauacgugguaccaccauucacccaauuguucauuuaucacuacauagaaucuccccuaauaaaugaaccagauucauuuuuucccucuguauuuauggucaagauuuaguaagcaccuuacuguaucuagaaacacuaauagguagugcugauaaggagagauuagaaaauagagaccaucuuugaggaauuuacagucuguugaaagaagagaaauacccagaaagcaugaauaaugauuuaggcaagauuaauuaauuaauuaaggucauuuccacauuugauuauuuuaagacauucucccuugacuaggaggaguuggugaagcacaguaaaugaaaauacuuuuuuucugcauuuucgcuuuuuuccacaagggauccagguacaccuaaacuguuuagauuuugcuaucucuaaacagaacagccaaaaaaaaaaaaaaaaccuauuaguuaaauacuucuuaauaugaaggccuugggccacauauugugucauuauaaaagauuaugugacccacugucugucuucaagaaacauuacaguagagguauggagaugaaacaugacagguaaaaagauaacuaaagauacaaggcauaauacagaaaucaacuuuccuucugaagaggaugcacuguagacuguuaugaucaagaaaggcagaacuuaaaguacagaugauuaacucugauaauaauguaaguggaaccuugauuuauuauuaugcccuguaguaaauaccugguuaaauccaacucaugccuauccaaaggaaauuggucuauauucuguguuugggagguagaaaagaaagcaagugguagaaauuacugacccagguuguauuauucuggagaggcuuauagaagcaaugaguauuugggggauuugaaaaagaaacuggacaagauuugucaaagaaaaaauuuguuggagguaguauucuagggggaaauacauaggcaguuugggagugguauauaacaauaacaacaaaauuuuguuaaaaauuuguuuuaaggaaccaaaaauguagcuaacaaaauuuuuacaugauaaccuuuguucauagauucuguacucgagguacuauagacauauacuacaugaaaucauuuguuacauguuucauucuucuagaaaugggagacguacuaaguaugguucaauaaugguucacaguaguaaggauuuguugugcaauuacuuugugccuagcauuuuguucuacccagccagagacugaaauauggauuccauaaacacuuuagauagguuacucaauuuugugagauuuaguuuccauuuuuguuuauagcugugucuccccugccucugauaucuccugauacaugguggauacuugacauagaaagagagagagagaagaaagucauuugaguggaucaaguaaaauuauauauacauaaaggaucugggauauaauaggugcacaguaaguucuuauuugacuucgugucugcccucauuucuuagcacagugccuagcuuauauaauagaaggcacuuaauaaaagcuucuugaauuaauucauuuuuccuucaaccagcaaauauucauuaaacaccuguaauaugcuagacacugggaagaaagcaguaaacaaaacaaagaaaucucugccccaguggaacuuggucuuguggaaggaggcagacaaguaaacagauaauuauauacuacguccgguggugacaagugcuaugagagagguucuggcagaguaaggagguggagguguugcaaaaagagagggcuaaagguuagugauauggaguggucagggaaugucuccuguaagugacauuuuggcaaacaucugaagaaaguaaggagagagccaugcaaguuucuagaaaaagaguuucugggcagaaggagaagcaaauucaaaagaccugaggcaggaaaguacuuggcauguuuaagaagguccauggaggucugugugucuguaacagcauaggcagggagaauaguagaaaugaagucagagaaguagcaggaagccagauuauguggaauccuguacggaaguuguaaggaccuugccuuuuacugugagaugagaagccaugggaacuggagaacuuugaggagugacaugaucugacuuucaaaggaucauccuagccacuauguagaaaaugaauuagagagugaccagcauggaagcagagaccacuuacaaggcuuugguauuaguccagagaaauauugguaccuuggacuugguaauacuggaggagguggggagaagugguuggauuguggguauauuucagagguggagcugacauaauaugcugauggauagauauuaaagagaggagucaaggauauuuccaagguuuuuguaccaagcaauugggagaauggaccuaccauuuaaugagauggaaaacugaugaggaacagguuuggugggaacuucaagaguccugcuuaggacccgcuaaauuuaagaggucuauaaaagccuggaggucagaaacacggaguagaauagugguuaccaggggcuguggagaagauggggaguuauuauucaauagauauaaaauuucaauaauguaaaauuauuaaguucaagagaucugcuguacaacauuguaccuauagaaugaugguuaccagaggcugggaaggauaaugggggaguggcgggagaaugaggaguggggauggcuaauggguacaaaaauguacuucaauagaaugaauaagauguaguauuugauagcacaacagggugaugucaacaauaauuuguuguacaguuuaaaaacagcuaaaagaguguaauuggauuguuuguaacagaaagcauaaaugguggauaccccauuuacccugaugugauuauuauguaugguauaccuguaucaaaauaucucauauaccccauaaauauauaaccuacuauguacccacaacaauuaaaaaaauuuuuuucuuuuuaaauaguuuauuuauuuauuuauuuauuuauuuauuuauuuaucuauuuuuuguagagacagggucucgcuauguugcccaggcuggucucgagcuccugguuucaagcgauccuccugccuuggucuuccaaagcgcugggauuacaggugugagcuaccaugcccggccaaaaauuaaaaauuaaaaaaaaaaacuacaaaaaaaaauacuguaugguacacauacaaauuuaagaagguuagaaaaaagaaacaaggaaucaguuaugggucccaccaagacuuaacugaaucagaaucugcauuuuaacaagauccccagguguuuggaaugcacauuccagucuaaaaucacuagccugaaaagcccuaguuaacaggaugacuucaggacacuuuaauaugcucuguaaucagucuguaaguguaaguaaggugguggcaguguauuuaauauuguguuagauugaauauccucuauauagaucuaucauagauauaauuaucuuaaaaaaaugaaagugaguccauuuuaauauauuuucugcccuuauuuaaaucuauuaguuucuauagcucuuuguaaaauccuauaauuucugugauuaaagaaagaaguuuggaggucagggaagaaaucaacaauggagauauaauuuagggcagggguccccaaccccagggccugauccauggccuuuaggaacugggcugcacagcaggaggggagcagcaggcgagcauuacugccugagcgccgccuacugucguaucagcuggugcauuagauucucauaggagcacaaacacuauugcgaacugcacaugcaagggaucuagguugugugcuccuuaugagaaucuaaugccugaugaucugagguggaacaguuucaucuugaaaccacccaccaagccccagucuguggcaaaauuaucuuccaugaaacuggccaagucccuggugccaaaagguuggggacugcugauuuagggagucaucaggaugcagagacuauaaaaagccauaaaacuggauuagaucacaaauugaguaaaaauaaugaaguugccuacaaacucaacccuugaauauuccaacauuaacaaaacaggaauagaaaagacaauuggcaaaagaggcugagacaaagcaaccaaugagauaggaggaggaccaggagaaagguauguggguggaugaaugggugagugagugagcaaacuaacagacaaacuaagaaaguuucauaagcccucuggggaucagucuauuugccauuacuuuuaaaagcaaaaaccacaauuacuuuugcaccaaccuaauacaaaacagggaugagagugauguuacuaucuccuuugcgggauuacugugaggauuauaaauaauguauauauaucaucuauuacagcaacuaaugcauagaaaguacuaaaaaauuaauagccauuuuuauuauaaaauuaaauagcuagaaaacauaaguacaguuuuuuuaauuaaauaaagguugagugucccuauguagaaguccagaaugcucccaaaucugcaacuuuuugagcaccaacaugaugcucaaaggaaauggucauuuuggagcauuucugauuucagauucuaggauuaaggaugcuuaauccagauguauguauaacacgagauauuucaaaauccccccaaaauagaaguccgaagcacuucuggucccaagcauuuuggauaagguauacucaaccuauacugaaaauguuggaggacucaagagaagguaaaaaucaguaugacucgggguauuagggaagucuucauggaagaaagagaaacuugaccuaaacuucaaaauggauuuucauagaggcaaguugaggcauuccagguguugagauaaacaaaaacucggaaauucucuugaggauagugugaugauacagugaagagauguuucuguucaaaugaaaccucaucagaggcaugaaaucacuugaggucugguuuuuguuguuuaguuuuacuuggaagcuaaccuuuuuuuuuuuuuuuuuuuuugcuccuacaauacaaaccccaguagacauuacaagacuggccaguugcauuguaccauccucacucacucuaguagccucgauugaugaugguuuuugcauuugugccaucagguuuuaccaccguugagggaugugacaaaucgaccugaaguuggcucaacugugagaaauaagcuggugcgccucaugacacauguugaccuuggagucaagcaaauugcugcugaauuccuuuuuguccuuugcaaagagagagguagguuaaacucucuuugccucugccuuuuaucuuucagagggacuuugagaaauuuaauugauaguguuaguacuggucgucucauuccauucuuuccaaagcuuacugucuguucuauuagagaggcugaggaguuaauaaaaauuaauagccaaaaacauuuguauacgcuucugaauucauugagacaugcaaagacagauacauuaccaaacacacucacauuuaaacuuugccuucuguauccuuaacccagccuucaucuuaauggggcaggacauagagccauuaugaaaaauugguucaguaauucagcggcuacuauuuuaauaagaggcacaggucuggguuaauuccucuuuuuaauuccucuuggaauuaaagcuauaggaguuuugguuucuuuacuacguuuuccaaucaguacuuacugaaugugagcuauauaauauacugaauagaaauuuuuaaaaugcauaauacccuugagacaaaguuaagauagugguagagagaaauuuuaaaauaacuguacuacaguguaauaaauacuacucuauaaguguauauaaagugauugucuacugagauagauccaacaauuaaagauauuuucuaaaauuauauggauuacucugcaaaaggcaaguuuuccaaacaaguaacuuugauuauucaguuauuccuacuuauuuuuucuucuucuacuuuguaagucugcuaguauaaaaucccaucuaagcagaucuauguucuacuuuuuuaaaguaccccaguuuuauaagauagauaauuuggagauggaaaaguucacuccuccuaaaaucuuaagucaauuguuauucuuaaacuucauuucugauguauugauccaaccacuuaaguucacauuaagaugguauguuaguaaccuaauuugaucauuauuauaauggugauuaugaauugagagguaucaugugccugacauucuauguauaaucucauuuaauucucauaaugacucucuaagguaaauauuauauuuugauuucauaaaugaagcaaccugccaccugagagccuuucaauaacaugucacacaguugcugagggcaugagcccaaauuuggguccugucuuuucuuucugccauauuuccucucauaauaauuauauuaacuauuaucauagacuguuuagcaucuguucuuuuagacaauuuacuucuucuuuaaugacuuugaaaaaagauugauuuagcaucuuggaauuaagugguuagcauagugccuugcacauaguuaucuguaaauauuggcugaauugaauugauucgagaucggaaaugaucuguuuuuuaaaguguaauuauacaugcuuaugcauaaauccaaaaucacacauauguguaucuauucauuuuaaaaaguuugucaaaauauauaccaaaauauuauuuauuguuaccucugaguaauaagagaacuggugauuuuuuuaguugucuguauaauuuuucuauaaugaacauguauuuuuuuguauaccuuuaaaaaguuuuaaaauggggaaaauaaaguuuauuucuccuguaauuacacaccuaaguguauaucuaaauauauaaaucuaaauaaauaauuacauaucuaaauaauuucuaaauguaaucacauuaccgaugaguaucauagcaaauaugguaaauugcauuuauaagugaauuuuguuaacuuuuuaaauuuaaaaugguugguuuugcucccucuuggacccaguauuuaguuucauaguccugucuuugagcccaaagcuaaccuccauuagcagauaauauauuuuuaauuugaccucaacaauucugcuuuauagucuuuuuuuuuuuuuuuuuuuuuuuuuuuuuuuuugagacagagucucacuccgucgcccaggcuggagugcaguggugcaaucucggcucacugcaaccuccgccucccagguugaagcgauucuccugccucagccgucugaguagcugggacuacaggcacaugccaacaugccuggcuaauuuuuguauuuuuaguagagaugggguuucaccauauuggccaggauggucucgaacuccuguccuugugaucugcccaccucggccucccaaagugcugguauuacaggcaugagccaccgcaccugaccuauaaucauuuuuuuccuuccaauuugauuauaaguuuaguaaauguauucuuccggaauaaacagacauuuguucaacaaauguuuuugaacuagacccuggaauuacagagauauauaagauaaacaguguuucugcccauguauuacuuacuuuuuuauuuaagggucacagacucaaaugccuacagcagccaggcugguaauaaaaguaagucaaguggacuagauguaagaugaacaaaugaaagcugacacuuggcucacuguuggggagacaauuggcugguguagggagacgaagggacuaugggagauuauaaagaguauguugcuacuauuuagcagcgacugaugguuaccaucaaggaacauguggccaggguuagcagauguuccauguuuucaagagaagcucucuguuuuuaaauguugucagcuaguucaaauuuaaaaccuucuggccagaaaaaaagaaaaugucugcaguuuaccuucaacuuaacaguaaucagauuuuggaauuuggguuuggagguagacuauuaaaauaaaauaaaauaaaauaaaauaaauuucaaauaauuuuucagaaugucugaacugucucuuaaggauaugccaaguaaauuugaaagugaaggcaccuugaucaaggcucaaaggucagaccacuaaguagagacagacaguaagcagcaguuauaauggguuaggaacacagagacugcauuaagaaagaggggccaggcgcgguggcucaugccuguaaucccagcacuuugggaggccgaggcgggcagaucaugaggucaggagaucgagaccauccuggccaacauggugaaaccccgucucuacuaaaaauauaaaaauuagcuggacgugguggugcaugccuguaaucccagcugcucaggaggcugaggggagaaucacuugaacccgggagguggagguugcagugagcugagaucacgccacugcacuccagccuggugacagagcaagacuccgucucaaaaaagaaaaaagaaagagguaagagagaaaggacaaaauuuuauggaagacuaggcacagaaagaaccauccaaaggucuuaaauacccaucugugccaggcccaacgguaucuccagcacauaauggcccacagguuaacuuguacucaugccauuaacuuguucaauugagccugaacaugacuauuuuuaucucccugcaaauuguguaccuucuacuaggggccuaaaaauaggccuuacauuguuuaauuaaaagaagaugauuuguaaaauaaucugccuugguagggguuccccccccaccuuuuaucguauucauuaaaucucaguaugugguaggcauuaugauguaggggcugaauugcaaagaaaaauuaggcuugaacucccuuagcacauagccccacaccaauaaauuuacuguaauacccacuucagucucagaggaauagguugucucuuuagcuugagguucacuagucucccuuuccuguugaucauuucucuuccuguguuugcagaaguguugcuccaucacucauuacccuuuauucuuuuguucuuugaacucgcccuaugugcuuuccccaaucucuaugcauacuuauaucacuguccuucacugcuuaacaucuugaaaaacuaguccucaacuugcugcaagucaggcuuuccauaaccauucacuacccaccaaauaccacugaaaaugcucucaauaaggucacaaauuaccugauuuucaaaagcaauggguauuuuuuagucuuugucuuauuacgucucucauaacaguuaaugcuguuguccacuuccuuuguuuguguacuaccacacacuccuagauguccuuugaccucucuucuuucuuugcagucugauuugcuagcuccuguccuuguccacauuuaauugcugguguucccuaaaguaaucuuuuggucccaauccucacuucacauugcucccugaguaaucuuauccucucccuuggcuucuguuugcguagauucccaaaucuauguaucuuuagccccaaccuuucuucugaacccggucauauuuaucuacuugcuuacuggaccucucugccugaguuucucacugguaucucaaacucauagcuaaaguugaauuuaugaucuucauucccaugcccuucgaccuuuucauuauccuucuaucacuuucucugcaaacaguaccacugucuguuuaguuccuaaagccagaaacuuaggaguuacccuagauuccuucuuuaccuguagaagucauaaucaccacaucuguagauuuuaccuccuguuaaauaucuuuuauuuauuucccccauucuguucccacaccaccaucuuagugcagacccuuaaaauuauuuuaacuauuaauaagcuauuaaaauaucucaucucucuguuucuagucagauuuucuucaguuucucuuccacgugguuaacagagggauugguguaaaacacaaauauaaucuugucauuccccucauauaaaacuuucagugauucucuguugccugcaugguaaaaaccaaauuuuaccuccacagagucucuguguaguguauuuuaaaucuguuccccuguuacacugcaugcuuaaucauacuaaauucuuuauucuugccugauuauacugcaccauuucuuggcauaucuccauggcuuggcagaugcuguuccuuuugugaggaaugcucuuccucaucuuuguuaccauggcgagcuuuacuuauccuugaagaccagcuuaagcaucaucucugugaagaccuuccaggcagaguucgucauuuucuccuuugugccauuuuuccuucucuguuguuaauacuuuugacauuugcuauguuguaacucuuuauuuguugaacuuacauucuagacacugaguuuccuuuaggucggagaucauguccuacucaucuuuggauccccagugcuuaacagauagcaggugccccauaaauguuuaauaaaagagcaaaugcuugugcucucuauaaauucaggcuggugaauacagggucccauuuaaaggaguaauuucaguacacuaugauaagugcccuaagaagaaaugugccggugcuauggcaaccuggaagagggaaugcuugggcgguguggaggagaucagagaaagucuucacagaagaggacagagaaauaggaaguagccuugaauguauagaaaagagacugguuuaaugugugaggaaucuuuaggagacaaguuuggaaaagacagcagaggccagaaaacgagcccuuuaggccccuguuuuggaauuugagcuuaguuuuuaggggaagacguuagagauuuuauccaggaagguuguaaaauccuauuuuugcuuuacaaagauauuuugggcaguuguguggaauaagaaauggaggagugugagacuguauggacaccaagacgaagccacuaguugagucuucuaaaaguuacagcauuugacuagaaggaaaaggauuuucacagagaagggggaauggucucuggguagaaucugguucuugacauucuuuguucuugguaaaagagcaaaaacguauugcuuuuauuuuagagugugguagaacccacauuuguguaacugucuauguuauuaccagugcaguucugacuuugcacagugcugcugugguugguuuccucuguucauagugcccucuagcauccugauaaaauaguggugaaauauuucucgcaacuuuuugacugaaugcugaauuguuucauuuaggcagcauuuucauauaacugcauggauaauuacuaugcaaggaacaaauauauuuguguguuuccuuuuuauuuuagaaccacccagaaaaucuuuuguuugcacuagcagcucaccuuaacauccaagugcagucaguuuuccguuuacuacuuucccaguaucaaauaggauauuuuaugguguauuugaaaacagacuuaaaaguagcuagaaacacugcuucaaugcuucucacugugaggauuucguauuucauuugucucaccuucucuaccccuaauuuuuggguauuuuauccuguuaacagaaguucaugugauuuuaaaacucuuggcuauacccuuuaucuacuuugaaagcaaacuaugucuuaagucaccuuuguaacccacacugccugucauagaguuagcacauaagguuuguuccagugaaagaggaguugacacgauuuucauaaaauugccgggggcuuuuacuguuaacuggcuuccagagagauuuucuacauaagagaacaguuauuuaguauucuguuuacuucuguuuaaccuauuuuggcuuuucauaaccuuugcauuuuuaaacucuuuuaauuuuucgccauuuugugucuuuuuaaauuauuguuauuuugucuuuaaguauauucauuuaaacauuuauucauaucucaauuuagaguuuccuaauuguaaugaguauuucuuuucuggauccacuaaaccuccuuguuuguuaaaaauaagcuuuaucaguaaugcuuacaaugauagcaucaccuacuaucuguaaguuacuuuguguggguuuagaucugugauccuuugccuucagucgcuuugugucugaccaugucauuaagaaaauguuugaccuucaugaauauuaagaauaccuauauacacugaacacucauuucuucugcucguacuuuuuaaggauuccuucauuuaucuaaagcacuacaucuuggggaggcacugaugccaagagagagcauaucagacuuauucagagggcuuaccccacccucauucaauaauucuaauaggauucuauccagcacccacugagaauuauuacagagagaccacaguuaccaauagguuuuaagauugaaaaugacuaguuucaacaucauuuaauauacucauuagcccauguuuccuuuugcacaaauuucaccaguuugcuauauuauuugaaaguagggcuuccuuucauuuauccccauaccacuuauuuucggugucgugagaaggacccucuaguucagguauuugaaaauguaacaguaaacucuauccuagaauauauuuauccuguccguauccuccaugauuuuauacucugaucauauauacccacuuuucuuaccuauuuuccuuuccaccaucccuuucaguuccccagucauuuuaauuaccuuuuucugaaucuucuccagcucuauuuugucuuuuuugagguaagugaucugaauuacagauguagauuuuacuauggcuuuauacguggauaagauuguauguuauguuguguuuccuacaguugccuuucagaugacauuuuaacaacauucuguuaaagaccuuaaguaaauuuucucaauucuuaucuuuugauuaaauauucuguuuaccuugaaauuguaccugaagaaaaugaaauacugcuaaacaaagcugccaguuauugcuuaguaucuuccuuaaagguguuuagaaaucacuaaaaacauuacugcagugcaagugucccuugcaaaaguugugugugucugcucaucuuaagagagacaucaccugacccuguuggcaggauaauacuuucagagagccugaaccaaacuuuucauuaggcuuccuuuuuuuuuuaaacuaagauaauucuaaaaugaucauuuuacccacucuucucagagaaaaagaaugauuguuuacuucuugguagauacuuuucauacuuugcauauauuaacuugugagguagauaguuacuauucuguuucuacagauuagaaaacuaggauaaagcugcaaaauaucuuacccaaggucaaccaauuaguaauugguagagccaguauugaaauccagccagucuaacuccugggucuaccuucguaaugggcuucaugugcuuauauaugguugccgacuuuuuauuuuaaaaaagcaguaaguuaucaccuaugcuauuugcuaauauucuuccuuaaguuuucuuuauuucuuacuuccuuuuccuccaauuccaacaaagaaugagagagagauuuuacauuaugugccauauugcuaaagucccaaucugacuuucacucucucuaguuucuuaucauuucuccaaaacuggauuuuuaaauaguaagaucugagaucagaaacuuaaagcgugacccuuaccaaaggccuggcagucacagaggccccacuuuugccauaaaguguguucagaacagcucugcuuuaguuucugguaccucaaaaaaggcucuuaguccccagaaccuaugggaaaauuuguaaguaguucaguauaaccacuaccacauuuugaaauucucucaguuuaaagguuuacugccauagugugugucuucaaucuucuuguguuggugagugguugaugaugauggugaagacccaaggauuccuaucuaaaacccuauucuguuuuugcaguggauagucugcugaaauacacuggcuaugggaaugcugcaggacuguuggcggccaggggccucuuggcuggaggaagaggagauaauugguacucagaggaugaggacacagacacugaagaauacaaaaaugcaaaaccaaaguauaguaucaaauuucuuuucaccuaacuauggcugugccuuugaguugguuauuuccuuugucuuucauuuuccaaguguuucuuuucucuuguggauuuggaaacuuuccauuuaaugguguuuuuagaggcaguuucauagcuagugcuuuagagagugacuucaagugauggaggaaggcuaauaaugcaagaaaugauauuuucaacguacuuauuaucuucucccaaguacuaagagagcugguguguuuagguuguacugagaaaguguuauugcuuacuauuugcuuuccuuuccauagguuaagauuuuauaagguauaaccaagaccacauauuuaaguugauuauuugaugcuuuagucuuucucagaaaucuaaauguagguucugauccucccccuugcauaaaagcccuuauaagucaguaaaauaggcaacaagacacauuaauaucaaaagagaagaagucuggcuucacagugaauuuuaaucaaacaaacauauaagacucaucuuuuaacagauacauuagugcaaugaguaggcaaaccagagacucugugaagucuucucugagucagugcuuaacaaauuaaagacacuauaauuauucucuuuuaucccaagauaaaccaccucuccuuucuccuauucccucucuauccuuuccaucccacucguaacccucaacccauguaaauucuuaguuuccgcuuauuaggaguuauuugagcuauguuuuuucuggguuccauuugaagauuuccaucugaaaauuggaaaagcaugcccuuuccuugugacauggugacauugacaugcuguguuuucugcuuggcaucuucuggagugugauguggaucaugcaauagguguucgaggauagacuaucuuuaucugcaaaauuagauacuuuuaaaaaacauacauugugccuuguugacaugcaaguaauggguugucagaaggugaaagaaaugaucaguucccaauuagacaggacauauauggccuguuucuuggcaaaucaggucugaguagguaguguuacuuuuagcauccccaaugccaucagccuuaguaggaucuuauagaguguguccuagaaauaaagacuuuuugggggaaagcuggcaaugacucuaagcacuauuuucuuaagacugccaccauuuagauauuaucaauuggcuaucucugacaaguauuugaagcuaagauagaggaauccugcuucuuucuuucccgaauuauagaagucaucauucuaaauuagucuuacuagcuuuuuucauucuauaaacuauauuuccuuaucaguuuaauauugauaucucuugauuugagucauuaaaauacaccacuugagaaauuucauauuucuaaauuaaaguagcaauuacauuaggcauuucuuacaucccaggguguguggacacauucaacuaugauagaaaacucaugaguacucauacaugguugauaucuuuguaucucaauauguauuguuaguuuuguuuaguagauaacuucuauaaugguaauggucauauauguagcaagcgccagaaugcuacuauaacaauaggaaaauagaauuauguuacauuguggaagugauguuagauuucaggaaguaccuucuguugaaaucaacagccaugauuaguauuguuacugucuuggcucucugucauggaaaguuucuguacuuaagccuuacaucccuaauuauaauauucagccuuuggacuuugcuuauaauauucauaggaaugguauguuuuuguagucagaauagucaucauugugaaauuuuguuguauuucuuaaacacugcucauuauaaguauaaauguguguuuuucaaguagcaucacaucuucccccuucggauagauuugcaucuguuuuucucuuaaauuuuccuuuuuuaaagugaaaaaguguggugagauauuuaauguuacuuuaaaauauuugugcaaaugaucucuauggaaguggugguaaauaaaguacucugcaagcaggaguacccuuuguacucuguggagcgauccauagagcucaaagaacuuguuuccuaaaaacaguuguaaaaaauuuuuuaccaaucaagcuuauaaagucagcaucugaaaggauugcuuacuccccuacaccugaauaccauucaccagucagaguucccaagaucucagucugcuuuucuugugaugcauuuauucacaacaguugcuacuauuggcagaagcagagaacuuacucuucauccaguuggcucuagucccauugucaaaacuuuaaguggauucugauuaaugcaccaagguaaccuguaauccuuuacuggaaucugaaaccaagaauuguauggagcuuacauucaggcuaugggagacaguuaauaucacaacaaagcuuuuugugucaaaauaaauguauuuaauggacuggaaauggcuuucugcaauuagcacacuuagagaaaauauacucauagaauugaguuacaugccacauaaauuuuugguguaugucuagccagguuuguugaaaguuuucagauaaacuuuaguccugugucaaagggaaaccaaauuucuaaauucuaaccuuuauaccuguuucuuuaaugccucugagaauggaggucccuugacuguaaaggugauauaacuggcugguaugguuuauacauuauucuagacaucaacugaaagaugugugucuaaugacauuuggcuccuuuuagaugaguggcuuucacagggugcauaggcaucuagaggcccaaagagguaucuuuaaaaggcugcuuuguggagggauaggaggaacagauggucaaaagugagcagaacccuagggagccuccuugcacacuuaacacaccacaccaguucauaaucagaucgaaaagcuuaaaaccauuguacuaauaaacucagggguguuuccuucuugaccauauuuuucucagcuguagcuaugccaccagcuguauaaacaguuucuucagcacaaggcaagauacuuuuucuuuuauuugucaagauuuugcuaugcugcuucagucaagucuuuuuauaguugucucauuauauugggcuuuauaaauuuauuuauuuuuaauauuaaauauuuauugaaguaagugacccagaaaccaggacaugaagauuuuucucuuugcccaauuugggcugugaugauguauuuauguaaaauagcauuucugggaacuagaaccuguuacuguaagcagucauaaaacguaucuaaauucagaguucuaaaagaccagagguaaaagaggccaguauauuagcuuaacuacaguacugaguuuugcuccaguguuuauuugcuauggauucacaaucgucaguuuucuauauccuuuaugucaagguuauuacucuuaaucaaacggccugacaugggaaacauuuaaaaagcacuauaauuuaaaaaggcauuuugaggucuuuuuuguuuuauugccuagaugcaauuugguauuccuguauguauauauauucaguauguauaaauuuauguggcuaauacaugguagauacauaguaaauaucagauaaguaaaugaaagaaugacaccauauuacacugguucuuucuauugcaaauguaaugugaaaaccugaauuagguugugcuuucauaauuuacccuauuucuuuuauggagaaucaguguaucauuuauaugguaauucuuaaauuacuugagacauuuucagaaacugguaucucuucaaaauauaucugaauuuaaagcacacgccacaaaaccaccuauuuguugcaugguuuuuuuaguuaaugaagauuacacaugcaucuccauaguaaggauuugacugaauagaguaacuuaccuccuggaucaucugaggccuucuguguugccuauuucuccacaaguggcucccuaacgcuaguaauaauagcugguauuuauugagugcuuaauaugugccaggcacuuuucuaagaacuagacaaauauuauauaaucuucacaacaauccuuugagguauaauuaaucucauuuuauagaugagaaaacuaaaggcaaugaaucgaguaauuuguccagggcaaacaguucguuaaguggucaggcagccugacucuagagcuugcgguuuuugggaauuuuauuguuguuuuuugagguaggcaaagcaaguuuuauugugcucuucauucugccuuuuuacuuuggggauaaaauauguaacaucaaauuugccauuuuaaucagcuuuaagugaacaaauuuguagcauuaaguacauuuacacuguuaugcaaccaucaccacuaucucucuucagaacuuuuuccuuguccccaaugaaacucuguacacauuccccuccuucuagcuccugguaagcaccauuuuacuuucugucucuauggaaucuaagaaucucuauaaauggaaucauauacaauauuucuccuuuuguuauuggcuagugucacuuagaauaaugucuuuaagauucguucauguuguggcacaugucaaaguuucagcugaauaauauuccauguguguauauacauuacauauacaccuuuugguuguugugaauaaugcuggugaacaugugucuaccgauaucugucaagucccugcuuucugcucucuugcguauauacccagaaguguuguaucacaugguagguaguucuuguguuuaauuuuguugccagccugccauauuuuacauagcagcugcaccauuuuauauucccaccagcaguguacaaggguucccuuuucuccacauccucacaacacuuauuauuuucugggguugcuugucuuugggauuuuuaguaauagccauccuaaugggugugaagucagagcuuauuuuaacuucuacuauauucuguuucaaagccaaucaaagagagaaauaaguuugcccuucagauagcuucccuguucucagagcaucuauuauuuuucuuugauauaaccaaaacagaaaacaaaagaaagaaaauguaucuguguauaccccgauauuccugaaaacagaaaaauccauuugauucauucuaaauugguaaauauucacauacaucugucagguaguucugguccuaucuucauaauacauucugaaucuaauuacccuuuuuauuugucaucgcugcuaccacucugguccaagcuaaaaucucucucuccaggaucauucucaaagccuucucacuggucuuguugcuucuaccuuuguuccucuucauuuuguucucaaaacagcuguuagugggauccuuuuaauauguaaaucagacuagucaacuguucagacguccucgcagugguauacuugcacccuuucuugcuauacuauugccacacugaccucuuuacuaugugucaggcacugcagacacacuccugccugaggccuuucuguugacugcuguuccuucugccuggaaugccuguccuccagauagcugucauaucgcucucauucccucaccaccuucaagucuuuacucagguaucaccuguucugugcccuuguuaacaguugcugcacuccugccuuuaccacuccauaucauacuucuuacauugcucuuuuuuucucacagugcuauucaccuucugacauuccauauaacuuacuuauuaagucuguuuucuccuccaaaaaguaagcuccaagagggaagaggaguuuuuguuuuuuuguuuuuuggucuguuuuuguucauguagauguccccagaauagugcccagcacacaguaggcagucaguaaauuuuuguugaaugaaugaauuuuuugaguuagucagccccuccucagcauuaggauaccaagaaaauugaguucccuuuccucgucaagcuucuacaucuaguugaggaaugggagccagggaauagaauucaagaaaauucagauaugguaaauuuccauuuuguucuuuauauuguuuuuugggggagcaguguauucuggguuuuucccccuggaaaguuguuuuaguuucauucacauauaacaucuccuuucccacccgccuguccccuucuuuccuggucuuggcuuacaaaaugcccuuuccuaaaaacccugaucccuuucguagggguugcaaauugucuagauuuagcccacaaguauguuuuguuuggcuugcuccauguccuauugguuauuugguuugugguuuugcuuguuuuacacaguguucuuaaaauaauuuaauuacuuagcaacauuuagaauucagauauuuuagaugaaaaucuugauuucuaacuucuuuugaaaaaauggaaguucuguuaacauaucccauagauauuuagaugaaaaucuugauuucuaacuucuuuugaaaaacuggaaguucugguuacauagggccugcauucuacgugacaaccaguugauggaauugaguagcugugguuuccuuccuacgagguauaagcuccuuugguuugacagauuauccuauucacuuauguuaccuguccaacuccuguagguugacuuuagaguuccuuuuuuaaccacaaugcuuugaaugaauuuaagccacacauuguagauugaaguuaauuuucauauagccgaauuaaguuuuaauggaucuuuuuuguuaaaugaccuaguacuguugauguuggccaaagguagcaaaaauuugaagaaagagcaaaagacuugaaauacaguucagguuuuauaccuguguucauuuguccauaccuuuuuagugugucuuaauccuuuugucuccaggcccauagcuguugucaguucauauaauagucuuauacaaaauuuaugaugaaauaccacagauaagaauuuagacacuucuugucaccuaauuggaagucacaagauuggagugcuacaaaaugggacagaggagcagagacaagguggaggagaucaugauaaauauaauuacccaauaaaauguccaccacaauuaguguucuuaaagcaucuuaagacuccaaguuuuggaaugaaauaaaacuaacuccagaauuucauagcguuaagauugaaaccuggacuguggcgucucagacuguacuauuugagguugaaaggugucagguauuuguuccaccaaaaguaaucuauuuuaugaaaucucacgucuuuguugucacaauggcuauuauuuguuuucucuuccuuucuggguagggaaacuacaugagacucugguuugaaguggggagcgggagaagagacaguguucaucugccuucugccacagcacacuggcauuuuucccauaagagagugcuacgcuauacuucagugcccuaacuuguguuuucuguggcuuuuguuuacauucuuccgaauauccaggggaaaaaugucuuuuuaaaggaaaaaaugaaacccaaaucccuagacugacuuuggaggguuggaauguuuuacucuauggcaaaaaaugaguucuuacucuguaagaaugaauuucugccuucugcuuuuauacucagauagcaagaauuguguuacuuuaguagcuaauuucagagcaaaccauuauaucauuuuagcagccaggggacuugagguuaccuuauguaaaacagacuuaauuuccaccaagcucuuaagagaaccaagaaaaccaucaaacuguguccuaaucugggaauucauauagugacuuuguaugcuguggugcccacaauaagcccacagcuuaccaguguguccuccugauuucauuuuuuucccugaagcaugugaucaugugugcaaaugucauuauauccuaaaagugccuacaggccugauuuuucaaauuacagcuccauugaauuugaggagagaagccaucucucaagaggcaaauaagcaugaucuacauaguuaauacaucuaccuucccuuauacuuucuucuaaggccugauuuucuuugcuugggaagugguauguaucuauaauaagcaccuuuauucauuuauaagacuaguuguuuuucuaauuuaacagguggcagaagagaaaccagugaaaagagaugucuuguuauaugccugagcaaauaauggaugggugguggaauuguauuuucaguguggcaucuggauacgucuccauaguucucagaagccuugucugggucuucuuuguucuugacuuuuaggaaauacgaugacccauucagcauuuuuguugauggccucuaacuggaggccuuuuucucuucuuuuaggagcaccugauaaaagaggaaauagcacacaaugagugucuaaagcaggcacucuagacacacacacacacacacacacacacacacacacacacacacacacacagauuuauuaguuggucuaaggugaggcccaagcuuuuuuuuuuuuuuuuuuuuuuuugagacggagucucgcucugucacccaagcuuuuuucaaaguuucucaagugauucuaauguacagccaaggcuagaaauaaaugacaaggcuauggguuuucagguugccccagaaccuuugaaaguaccuuaagagaaaacaaguggguaggggacaaauaaagggacucuacgccccuaucuacuuggcuauucccauccccuucuugccugagcaguucacuuuugucuauuuuauauauuggguuucuaaugggggaaaaguuuuaaacaugacucuagauguaggucuuacgcaagaauggcaagauagguuuugaaucagguuuucgaggauggugagcacugaguccuuccauaagaauugguaugucaugcagccucugaggaagguagaaaagaaaaguaaaucuaauaguaauagauaacaguacguaguaagcaagccuuuaccccagaugagaaaagcccuagucaguaaagaacuugcccaaccgaaagucucaaagacggguugcaagcuggcuaccagaagauuuaauuaaucacugugucuuugucuuggccaguaucuuuuuuuuuuuuuaauuuaaacugggcaccguuuuccaguugaucucaaucucccaacacuccacauuguguauauuugacccucucacucacuugcuuaucuuaaaggcguggcuucugaaagcguuuauguucauagacccuagaaagcaauuuauuagcaauugcuauuugcagggauauuuaauuugaucauuaaaaacaaacuaucugcuaggcgccauggcuuauggcucuaaucccagcacuucaggagcugaggcaggaggaacacuugagcucaggaguuugagaccagccaggccaacauggugaaaccccgucucuacuaaaaauacaaaaauuagccaggcguggugacacgugccuguaaucccagccacccuggagguugaggcaggagaaucacuugaacccaggaagcagagguugcagugagccgagauugugcgacugcacuccaacgugggugacagagcgagacuccgucaaaacaaacaaacaaaaacaaaaaaacaguauguacuuggcugguacaagauacugugaucucuugucugcuucuccagaaaaauguuuguuguggauauuuaggagccauugaaagaguuaucuuuuauuuccuguccucaaaaaaaaaaaaaaaaguauggcuuuucucuaagagaauaguuuguuugguauuauaaccucauacaaaguuuaugcaaaguauucauuuuaaguacuguauuaaaucuauuuccagauagccaggaugauauaccugucucuugguaggcuagauuucaucccuuuuuuugucuaggccagaucaaaccuaauuaaaauuguucuucugcuuuaucuuuuauuauuuaaacacucauugcccucuguggucucacuaauggacuaauuuccugagauuauaaauuggcaugcuuucauuuccagauuguagccucucugucaucauuuuuccaauuuuuuuugauguuuguuuuaugcuguaucacaaaauggauuuccucauuucuucuucccugaaaucauguguccccuuagaauuaauggauaagcugugcauccacggauauccuaacggcacuaaucaaauuuuguauuuuuaaaaagcaaccaugccucuaaaaaaaaaaaaaguuggcaagacaguuuucguuuuuuaaaaaaaguauagcccauuucccaaagcaaauuaguggaaaaguccaguuuuaaaaauuccuauaucaguucuauaccauaaaauugaaauuauugccaauuuuuuggcuauuauacucuuucuuauuaucacuuaaaaguuggaccagaaaaguauagaaagagcauaauuuuaaaacauacagcauaacuuuuuuuucuuuuuguagcauuaaucuuaucacuggucauuuagaggaaccaaugccaaaccccauagaugaaaugacagaagaacaaaaagaauaugaagccaugaaacuugucaacaugcuugauaaacuuuccagguauuguauucccauccauuuuuugcuugguuucuaaaaauggucuauuucuuugucucucucacugagaguuaccauagaacagcaacucuggaaauccauguugauuggaauaggguggcccaggcagcaguaguucagauagcucuuggcuaccaugguuuuucuacaugugccgcuucuggaugugcauuccuaaacauuuaaacucucaaagcuaagauaguaacuaccagagcacuguaauaauuaaccaacuaaccucccugucuucaaaaagaugcugugaguuagauucagugauuuugcugcugcuuguauuuuuguuuuagccuguuuuaguuuuuguuucaaaucaugaugcuuuuauuuuuucauuuuugauguguaaguuugcaauuacgccuuuuuggguugcugcugaaaccaagaauucuaaaaugucaugcacccaauaagaaaaagugaaaagaaauagcucacaugaaggauuuucugaaaacagggacuuguauuaauuaggaguucuaaaaaaaaaaaaaaaaaaaaaaaaaaaccaaaaaacuccccuuccccucuugcuucucaccuccuuccccuucaaaaauaaccaguuuugaaauaauuaaaucaaguauauacuaaucagcaacuagucaucuuggaggaguuauuagaaaauaauuccuuucauacuuggcugagucacucuauuuucuagucauacauugagucacuaucuucuuuaagccaucuugaaugaaugcuucuguguguugguggcagcugccacuuaaagaugcauuucuucuggccauccccuuuuucacaguaacuguguaaaggcuaguaucccucagucaaaagaaggagccauuggaauggaaaagccagagagccaaccaugaaagggaaagguggaacacagaaacgagcagagauuaagggcacagcagaggcuuagggguagaaauggacaagaacaagagacugacauggggagugugacaaguauggauauuuauccacgcugcagaguaugaugcugguagugugguagaaguuguuuaggaguaaauagcuuaauuaucuacaaagcuaauaagacuagaacucaguaacuuccagcuagcccuuuuaaauuuucauccuuucucaagguuagaauuuacagcuaacugacuauauucacaaucuucaaaagacauuguugccucuuugcaaauuacauucuccauaccuuuguauagaacagaaauguucccucccagaagggauuaauagucacagagaagauaccgauagggcaaaccuauaggaggcagaauaagaucaaaaugaauauauaaagauaagaugugugcuuggccacuuccaggaggagcugauguagcuaaugaaacacagggguauaaaaacaacaggauaagaaccaacagagucaggccgggcacaguggcuuaugccuguaaucccagcacauugggaggcugaggcagguggaucaccugaggucgggaguuugagaccagccugaccaacauggagaaacccugucucuacugaaaauacaaauuuagccgggugugguggcacaugccuguaaucccagcuacucaggaggcugaggcaggagaaucgcuugaaccugggaggcggagguugcggugaaccaaggucgcaccauugcacuccagccuggucaaacaagagcaaaacucugucucaaaaaaaaaaaaaaaaacaaacccgacagaguccaucugguagaaacuggagaggaaagguuagcaaggaccugaguagaacacauuaguguguuaggacaguaaaccaguugcauaaauuucauauucugaccaacaacaugaguuuuuaaaguuuaacacaaaugccauuuaacugggccaucuacccuggaugaguaaacuccagguagggaaauggaagacaggggaaauaacugccuaagacuacacaguauaauccagauacuuggcuuacuaauagaggaacuaccauuucauaaggcaucucuaucacaggcacagaaaacaaaggugcuagguccuucuccuuuuaaucucaggggaauccacauauucuagaagcugccaacaaauaaauauacaaacgucaagucugaaauaccccagcuuccaccugauuuaaacuaugccucaaagaagaugccuacuuauccggaaguacccagcagaugcccaacugaaggugacacugauuuuugcauguuuaaagcagagcaaauaugucuuauguuggcuuugaugguaucaauuuugccauuaaaguugaagcaaaaggcaaccuugagaauaguucaaaucauacagaauuuuugcaugacguguguugggcguuuuacauugucugccuuugugugcuuucuaacauuugcucucacuaaauacaaucaaugacaaaacuguauaaagaucagcagugggcauuccaaagcaguaaugcaaagaaugaagucauucuuuaugcgucuuacaugucuuuugugcuguguuccucauuagucuuaaguuucuucucucuuuccacuuuuuuuugagguaaaaaaagaugccauaaagccaaaauagacuaaacucaguacaauucagggaacauuuacuaagcagcuacucugugcaaggcaucgugcuaggaaccugaggaagauucagaggagaaugugacagucucugccuuuggaaaacucacauucuaguggaagaaaugacuguaaucuagucuagaauacaagguagaaggaaauaaugacaaaaugaguucuauguugaaauguaagcaugcaggaaaaggaguaguucauucugucuggaugauucagggacuguuucacaggaaagcuagcauuugugcugauccuagaauuuugauguauuuaauagaaaaauggaaaaaugaccauucauuccagguggagagaaauuuaaucuuguuaauaagucuuggauagucacauacuacuuauuucuucuaaagagcucagguuguuuuaucauuauuugauuaguacguuaucagauuuaucauugggggaagcaaguaccaaagaauugcccaaagcauuuccaagcuaaugacugaugauaauucauuuccuuuuaacaguuuauaaaacacuuucacauacauccucuuucuaguuucauuuuaaaaagugagacuagaccuucauuuuccagaacucaagacguuugcucuguccacuguacuacggugucugucuguuauaguaaguguuugccagaacacuuccucaucacccugucagcauuguacuauugguuaguucccucccuuucacucuaggacguucugcauucaaccaagucguuauugugcuaagaguguaccauagcuuugucugauuaacuuuccuucucaaaaaugaaaugguuuucuccugcaccugaauugaaaggcaugugaguaaaggauaggguuggaggugauguggccaaugaauggacacuagacacuuccuuuuuuccauccauaggagagcagaugugaaggaccugcaccaggauggugguuagcaacaguggcccgugccaaagcacuuaccaaagugaugaugacuaagguuggucaugccaaguacuguuacugagccugguguaggguauagauguuauucacuaccaaaauuguaaaaccaccaauguaaaaguuaaaauuacauuucuauuuugccuccaugcuggacauagccgcugccucaaggagcucaucaccuuagcagcuuucucucaacuagauuuccaaagauauuggagagauuagugcucagauauuuucuucccauugaauaccagcugacuuaagaguauuccaagugauuuuuuuuuuuuaguauaaggauuauauuugugauagauguagauaaggugauuggcagugcaccuggaggucuaaagaguuggaaaagaaucugaacccuauaaaucccaucaugucuagcuaguacagugccuuguacccugugguuuccacaguaugugaugaugaaauaaugaaaauagcugauccccaaauuugaagggcaguuuuuugcuuuaaaauaccuacauggcuuaagacuuuaaaguacacucugucaguuccauuuuuuggccagaugucauaaaauucagggccagaaaggaauuccauaaaguacuuugagccaugacuggcuuauuuaaauauugggguccauaauuccuuuaauauagaaugauaacuguaauauuuaucaaauauaaacauuuaaggccugaggcaugaaauuauagaaagccucauuugacauuuuuuaaugugagggcagagauggaaaagcggaugaaauuugccugccucuucaccuccucuuuccuucccugacuucggaaaaaauaagccccugcaacucaagcaggagaucugaaugggaauuguguaguaaaagcaagcccacugugccuaauacaauuucauuugccuuagcuauugcacacaacuuguauauaauaguggugccuccucuagaaaaggggagagagcauugacuggcuuaagcuuaaacuaaccaagggaaauaauauuucaaguuacaguuuuguuuugacuucucuaauccccuuuaguuucuacauuggaaccagagcuaauuaauccucuacucacccuuaccccaucacugucuaacaagauacauugccuuuuuacuuauauauucugccaucaaaaucuauguuuuaaaauuuauauuuauauaaauuaaagauaauuguucuaccauuucuuccuuuucuuacuccuuagccaauaaguguuuuguuuuuuuuguuguugccagucauuguguacuauuuggaacaugacuuuuauaauaaaugcaggcaccagauauaggauuaguucccuuuaaucaaaagauuaauuuuaaacugacuaaggcugagauagguaguuuauaacugaaaaauaacaaauacauaguuuuuucuuaaaaauaaguuauuuuacucuccuuacaaaaauaucaacgacugugauuauaccuaccuuugugauaaguuaguuaaggaaaugcuuuucagguacauuucauaaacaugaucuaauuuuuagagcauuguaagaucuauuauagauaugaaaauauaaagaucuuguuuucaucagaauauucuuuagacuacccuguccagaguaugguaaccacagcuauauaugacuguugagcacuugaaaugugguuaguccaaauugggauguccuaucaguguaaaauacucacuagauuucagagacuuggcacaaaaaaaguaaaauaucucauuauuuguuuaauauagguuacauauggaaaugauaauauuuuugauacacuggguuaaaauauuaaaauuaauuuuaccuauucuuuuucaauguggcuacuagaacauuuaagaguacauacacuuggcuuacauuguggcuuacauuauauuuuuauuagacagugcuguucuaccucauuaaaauauacuguaagguugcuuggaaauugaauuaagaggacuuggauccagcuaaauuaaacaccuuaaggugucaggggaggauuaacuugagaagcuugauauuaucuauccuuagguuauauaggaccuuuccaguagcuagacaccuuuaaguaggacgucaugcuaccuuuguauugccuaucuguagucauuguucuuuagaucuguagugggacuaacuacuuugagcucuugguuaaaguacucucugaaaugguuuuugacuaguagaggaacaucaaauaagaaucaucuccacuggcuguuuguucucuuaguucuccucauucuuuaacuuuuaauccuuccuuauugggaagagcguuaagaacuucuguuucuacuacuuuauucuacagugucaguuggcaugcugaccuauuaauauuuauuuuguuaauuuggacaacagauaagaaaaauucuguaaauaaauuaccaagaaauaauuuuuaaaaccacuuaaagauaaaacugcacuuuauucuucuaguacuauaccugaucucuuuuucucuauauuuucuuaaccaugcuguuuacuguggguaaauuagguggguagcagauuuuuagaagcuuugcaugugaucuaacagaaaugugaacagugauuuaaaaaaaacuaauauuuauauagugcuuuaagguauaaaaaaugcuuccauauacguuaucuccauugauuauuaaaacagcccugugaauuaaauagcgucagguauuuuuuuaaggauuaaaugcaccaaagauuaaguaacuaacccaaguccaguuuucagucuugagacuccagauugugugcuauugugagaaauuaccaacagcucucaaaaguugucugauuauuuuuaaauaagacauucuaaauuuuaaauaaaugaaaagcacgaaagacagauaauaagcauauuuacuuuagaagagaacuaagauuuagaggacaugcauuacugcuuuuucauuccacaguugagcucuucguagguaucaggucaaauacuaaauaaauagcuuauauuuuaaaacacaaaacaaagcaaagcuuuuugaagggaacaaguaaaauuucuaugauucuauguuaauacaagguuuuuaaauuguuuuaaaaagagaaugauuauggcucuucugacaaauuuucauacaugugaucacauuaauaaaaccuaacuuaaaaaaggcuucccuaugggacuauuuaccaaaguugcucaacccgcagcccaggacgcuuuugaaugcggcccaacacaaguuaauaaacuuucuugaaacauuaugagauguuuuugcaauuuuuuuuaagcucaccagccaucauuaguguuaaguguauuuuaugugacgcaagacaauucuucuuccaguguggcccaggaaagccaaacaauuggacaucccugguuuagacaauucccaauuaccuuuauaaaguggaaagacauggugauguggggacuguacaccauaucaauuugucuuggguaacaauauuuuuauguugcauauuuuacuuucccaauuguacccaaucccaaagcacaaugaugagggcugagggaaggaucucagaauccuuucaaagauguagccuagaccucaaauuugcuauggaaaagcuaccauaccacucauuccuaccaaguuaguggcuuaaugaaagaucgguguaaccagucagcucuaggaagucauuagaugaaagaugaaggaucaggguucaagccuaaaggacacuuucacaguaucuaacugaacauguuuaccaguccaaagguuauaauauuauugcugugagaaaaaaagaggugaaaacauuuauaagaauaucacaaguuauugggaaacccguuauacuucaguggauuaugaacuauccaugauacugaaaucuugauauaagaugcacgcccagacuuuaaaagaacuacagagcuuccuucucagggcuaucacaggcuccauccauuuuaacaggcauuuuuugaaaagcucuauguuaauuaaaaugcuuuauuuauauacuaauuucucaucccaucuuucaaaugugaaaaggaauuaaauaugaaauggcuaauuuaaacugucaggauucuuuuuuccaagucaaccuuacauuaagagcaggaauccugugcuuaagaaaugguucccaauuauccugucuuggguuuuguuauacauuguacagaagucaacaaaacaaguauguaacagaaccugccuaaauagcagccgcccucauuaaaaacagagaauuaaucagggggugauugaaggaagcaaugccucauguucccccccccuuuucuucuuuucuaaucauagaacaaaauauguuacauaaaaggaucggaacuauuaugcaguacucaauuagagggaggugaauaggucucuaacaugcuguuuuaucaaaagagcagacugguguuugcaugacuguuguuucauuacagacccugucauuaauuccaugugucaauacugcccuguaguacacagagcagacaagaaagaagagcccuugaaaacaagggaaugauuuuugagucguuaucaagcuaaguggcaagcgggaagcugaaacucguauagguaaauucgaagggacucuugggagaucugcaagugggaaacaagaaugcauuuuaccaacugcuuaauuauguccuguuuuucaacaaguacacuugaauugaauguuuuguuuguauugcacaaaaacaugugcugugggcaagaguauucucuugcuuucaggucaaguaaaguguuuuauacacauacacgucugaccuauucuauauugugcgauuggguauguuaguaucugaaccccaauuuugcacugucauuuuugggggaaagagucauauaggaaccagaagcccuaaaaagcagaaccuucucuaaggugcugagaagucauauaagcccaggcauccuagaguauaccauacuuacaggcaaacgguggcucaggaaaauguuaaaauauaucuggaaaaaaaaaacagaccagaauauuuuaaauaugguguaaauuccguaucucccaucccuagcucuuuaagaaauuauuuuuuugguuuccauuagcagucccaaggguuaggcuggggcaaaauaggguuuccuuucuuggacgugcuuuaucuguguccucuugccuggccaagcccuuguagauuaugguuccuuaucguuuaguaagaucaaauuucuaaaugauguuucguuccaguugaacauucuuggaggcuuaucucuucccuggccagaugccugaucagaugagaagcccgccaugauacugucacagugccuagaaugggcucuuuauccaguagacaccacuguacuuuuugauacgagggcagucuuaacuuguguuaaggccuguguguagcauugaagguaaguaugaaggaguuguugcuaugugaauaucuuaauccugauacacauuucaauauacaguaucuccguuuuaccaugauauacauguaucugacacauagccauccuuuuuagauaggaccuucauaauuuaggaucaguaacucuuuaugaaauggccuguuuauugagggccaugauugaauuuggauccuuuuuuguagcacuugccauugcuuugguuuuccuuuguaaucauuuuaaucauaugcugguagucuugcagaaagggcuuguggucuugguguaugucugugacaauuugguaggaugcuguguuugacucuuagguuuagaauaucugcauuagaaacaaaggcuuaguaauaaugaguuugaguaucuuuaaaaaccuagcagcuuuuuaaauagaucaaaauuauuucauagcccaacacuuagccucuugaaauuaguauagaauauuggggaucaucuuguccaaccacucacuuuauagauggggagacucaagcccagagaggcaagugaccugcccaaggacaccuagcaaguuaguggaacaucugagacuagaaucuaggucuucugaugccccauauggaagaagcucagucuauaccaguuaguuaaugguugggaauuccaggcugucuggugaaaagggggcuugacuucugcugaacugucagaaugucugaugauauuaauucaucaggaaaauaauuacaguuaaaauaacaugagaaugauuccugacaaauggucucccauuuaugccacguuuacugagcaccugcugugugcuguguucuauacuagauacuggcaaaucacagccugagaagacauggacucugcccucaaguugcucacagucuaguacagaacaagaaaucucuggaaagcauuauacagaauuuccuguggaauguuaauccuguuucuaacccuguaaaucuucgugaugaaagugaauguguacccagagauuuagcuuuucucuucaugguuuagucauuaggagucccauuagacaccauaccuuuucucuucaggaaaaugaaagauaauaucaaguacaacuaaauuuaauucacaaacacuuauugaggaucugcuaucugcaaggcacugugcuagacacauagggauaugaaaauugaguaaagcauagacauucucuuuuuaaaauaucagagcaguaguauuucauagcucucaaacuuuguaaugacaguuauuuuuaauauccuuagaaguugggggugggggguaugcuccugaaauagaaaacaagaauaccuuuguacucaaguccagacuugucagccuaggauucaaggucuccauucaaauccucuuuuauaccgcaucucuuuugaguuguuuuuuuuuuuuuccuuuaucucagccgagccagccugcuugccagucccugcacacaacuaacucuugcuucugugccucugcuugacuaauucuucugcuucugggaugccuuucucccugugaauccauguccaucacugccauuacagucuggccccugaguccaccuacugcaaggagccuguggucagcaucccugucuccuccugugucccucucacaugugcauagccauacgacuggugaaggaauauuucugugguguucauuaaagcuucccauucucuguccacaucuugcugaucuagauacaacagauugcaaaugaaauagucccagauuauaaaugagacaguccaauauaaccaggucauuuaccaagccuuuuaggagugagucucuguaccaaauauuucauuuugauauuugugggccacuaguugaaggauagaggaagaagaugagaaaaguuaggauggggguaugagaaauaagccuggggucaauuagaacaaacagucacacaucuguaaaugauccucuccuucuacucccagacaggacaagaaaucuccuuuaaaccaacuucaaauacaguaaggguguauugacaaauuuuaaagcuuaaagaaagcagggcucucugccuguuaaucaucucaagcuuguugaucugcuguucuguaacucuuucaauauuguuuaauguguguguguuuucugaacugacuaaaagcuucuugaggacagggaccaugucuuuuauuugccucugcauauucuucccccacuuaaucccuaacuagcaugggaaaaccuucuguaagcacuuaagggacaggaacgacaauuuguggguucuaacuacauuccagccuaauguuauacuauacacuuuguauguauaguagccuuuugcccucaucacaacuuagugugagguauguguuccuguccuaauucuacagagaaggaaauuggaauucagugaguucauguucuuacagcuagugacuggucgauccagaauuagagcacagguccgucugacuccaaaaccuauaugugcuuuucacuauaccacaauaacaacgaauauuuguucuguacaauucacaacucuuuggucuaccuuauuauuauuauuauuauuacuaccacuacuuacaucuucacuagucaguagguacagccaagauuaucacgacccccauuucacugguagggaaacugagacucggaagcuugcccaagaucacacagcugguaaguggaggagaaccaggacuucagacagacuuccugacuccagaucuuuuuuuucuuuccaugacaucacauugcugccuuaauucauuugcacaaugcaugauuguauggccaguguucacugacaccuuuccuacagaaguaucaaugagcccaggcauuacguagagccauguggagaagaaaauaauucauaccuucagaggagcuuccauuuuaguggggguugauacaaagcacccagaaaguaaaugcuugagaauaguucacaaguaagaauuaaaauauaggcccguuguuccauaaugaaauccuauaauuuggccauaaaacuaauauuuuuaauuauuugcauaauuggauuagggagcaaggguaaagcugauagacuuauuugaaaauauuacuucuggguuuagaugagaaagugcuagauacuucacacaaguuaguagcuagccccagaaucaucuuuuuaucaaagagaugcaguaguuuuagucucaggagugaugguauauccacccagcaguuuaucacucagucccaucugccaauccuacuuuuaccuaucccuacccuucaguccccaccccacaccugaguuuaccaaccccuucagacccucaguguuucauucccagcagguucucccucuucuccuuuugcuucaguuguuaauauguaguguccaacaucacaaaguccuuuagcacaaucagaacuaggaauuuauuuaaaauauagguauguaauuuacgucagugcuagagagaaguuuuaauggaaacguuguuucuagcucuccacugaacauuucuacaugguugucauguaggcaccucaagcccuucaaguccuaaaauauaucagaaucuccccaccaaaucuccaucuccuauguccuggccccauugaauagagucaccauccacuuggucaucugagcugaaacaacaggaacucucuacuuacuacucucauucuccaaccccuuuuccucccagugagucaugagaucuaccucagaaauguugccuuuucuucccacaaccucagacuuaauccagcugucugucuccucccccacacacuauuaugaugaccccccuaaugacuugucuaucugccaccaauuccaaugugucuaucaugcugcugccagagguacuuucuuauaaaacaaacguaaucaaacacucuuuauaggguaaaaucuaaacuccuuauuuuggcauuuaagacauuuuugacuauugcaucccaaacuacccuugcagccuuaccuccugccccuccuucauugaaccucaccauuccccaaacacugggcccuuucccggcuucaugagagcacagagauagaaaagaugagcugacacaauccaaaaagguuuaaaaagauagagaaucacacacgucagugggaccauucagagcucuuuacagucucuuuuaucugaaaugcucugugcccaucugccuagugcagggccacucacugacaccucacuugacagugcccuccccaggcagccuggucagugcuucaucucaggagcugccucacuucuuuguucauaauucucuuacagcauuuaccucauucugcucaaaaugacuuuugcauauauuuguuuuccgugcuccucaaaggcagcagcuguacccagucuuccuuaccucccaguauaugacauaguuccugucacauagucauugaacagauguugaagacaugaacucagugugcuccuccaaugcaguuagggcaauuaauccagauguggugggcugcaaagaucacuggacuaggauucaggagacccaugucccagguccagcucugccacuagauaagugaccuuggaugagucauucagucuccuuuauuaaagaaggggguuggacuaaaugaucucucagaccccuuccaacuuuaaguucuaugauucugaccccauuucuuggauugggaaacacauuuccucccucauaguauucaggagccucaauuuagccugucagacguucacauuucccaagcaaagcuuucaaacacuucgaaguugucuacugagcuagccagagcucuucauuaggcuccuguuggcuuauccauugaccacugagcuguucucacuccuccccaggagauuucacugugucuguaacaccauuacacuacuguguggcugccccuucccaggagggagcccuucuuucuguuggccuaagggacaacugugaggagggagucauuuccccuccauccaaaucccaccaacauuauagcugcugccauguggguuuuugcuuauggacauguuuuuggggggugaugcccauuucugugauaaauaaguuuuaagcaguucauggggcucuucaaggccacucuuaaguacacugcugaccuuucuagggaugggaggacuggaguuagcaacucaacagguacauucaccauaaucuccauguaauaaauaagagccuaugaaaagauuaaauaaaucuuuccuaaugcuuuuugacuggcuuaaucaauaauuaaucaucuuuagaugaggcuguaacuuguggaguagauauaauuggauuagcugaaaagcggcaguugcggagcuuugaagagauuaaaauggcugucaaucccauaauuaaacugccacaaacaaaagcaaugguguuuuuuagaaaggaggaggaggaggaaagaaagagugaaagagagagagagaaggaaagaaaagucggggagagaguuggggaaggccaacuaauuugaaaugaaucaacauguacuuacauaucacuagagacugaggcaaaaucaaaaccgacagauuuauuccauugaaugaaguguaugcauaucaaaucagccauuuaauuguaugcuccaaccacuggggcaggugaaauuuuggcagcuucaacuugucuaaaacaaaaccaauccaccaaaaaaaaaaaaaaagguuaauuauucaaaacagaagagaccugcuccuuguccugagcccauuuagaccuugacuuuucauacuuuuaauuggcuuaguagguuuggccugugugaaugaagucuuuuaucucccucuucccucuuuuucuuuccaugccccuuucaucuuuccuauuacaaacacacagagaaagcucaagggaaaauacuuugguuuuuaaagacuuuucuuuuuaaaagguuguggauuugggugggggggaggggugugugugugaugcuggugaauacuuuuuuuucucucucuuuuaucucuuuuucuagagaggaguugcuuaaaccaaugggacuaaaaccugaugggacaauaacgccuuuggaggaagcacucaaccaguacucugucaucgaagagaccagcucugacacagacuaaaagcaucaccugcucaacucucaauauugcuuuaucagcaucuuuucucuguagcuccaggggaaucuuuucucuaaaacauuuaugcccuugcuuuggcuagaaacacauuaacugguuuacucauugagaauccagcauauuuaagaggugacccuguguuuuuugugauauugaggcauucauacagagcugcaguuagacgggguuacgggggcuaaaagcagaaaaaaaauuccauuucaucgggauggaacugaaggauuuuauucuauaaagcggcccugguugaaucuggcaauucuuuuugccaagaucccuagcagaagauuuagccauguccuuccccucacuugugugaguggccccuucugaaucucuccagcagccagaggcacgugagaagcagaaagagcugguaaauaaagccuugggcaagcgacuucuuagaucagaacucaccaaauggaagccuagcagcugcuccauaaaccuagccccauucuucauaucaauuuuguauaaauauauagaaacacacacacagccucagacuuacaaacugauuauacucuaaaaguuuguaugucaguuagcuaaaacuucagaauacauuucucccuauaaagaguuauaaaugaugguuuaguucucaggcagcuacaaaugccuauuuauucccuaauguaccugaacacuaguaccauagaacugaaccaccaucuguaucagcgcauggggagugugcauucugaggucuaacccggggugccaggaacacacacauccuccaucccagcauagagaauggggacucccugaguaaugggaguucuuucauggccucugcuuggggugggggagucagcagcacccauuuguacauauaggucauucauacaucacauuuuaaauuggggacugugugugcuggugugugugugaguucuacguuucuaccauaugugaucaguuuaauaguaacuuuauuuauuuaaaaaaaagaaacacaauuaguuacuguuaaacugauaaaggguguuuauuuuuacuuuuagaauugguccuaugaagaaguagaaagugagucaugcacuagacagugggccuagcucaucaguggcuaaaguugaaaagggguugguuuccuguauauauauguauguauauacacacguacauacauucauauauauacauauauacauaaugugcuuaaccacugccuuuuaaaacuuuaaauuaaauaaaacauugggguugauucaauuuggccaucuguguguguuucuuuauagauacaugggcuaaacaauacuauuucacaguuuaugcuuuuuuaaagugcuuuuacauccauggucccacuucuaauagccuuuuuaaggacagguagaguacauggaggguuacugaaaaggucauuuauccagaaguuaccucucuggcaaagcaaaaaaaucaggaauuacgucuuaaaggccuuucagcugccagaggagaugucacaaaguuucuugcaacuuacuuaugggagagaucuucaagaauaucacucuuagacucugaacugaaauuugcauacgcuuccaacauguuuuauuagcuggcuuugaagcucacaaaagaauggcaaagaaagaggcugcuagauugaaggcaggcauacugaaagaagaaaaaggccaacugaaaacuagauagugagaugagaagaauaaaacuucaagacauagcaaaucugggacugucuacuuaccaaaggauacucuaguugacccagaaaauguguguacaacaguauggcccguagacuacuuccuauaauggugacccugaguuuuuuuaaaagaagaaauuaaauccagaacgcuuuauaaaaggguaggaagaagacaauagauguuagaauuucauccaaaauguuugagggagaggugagugacccagguuuuaaccaacagcaaaagaaaugggcaauucauaauuuuagauuaagugaaaaguuuagaaaaaauuuaaguauuuuuguuauucuacaaaugcauuuuuaaaguauuuuuauaauuucuauaaucaaauagcuuuggcaugcaugucagcuuaccuaaaugaagauguguuuaaugaaaugccaucuuaccagcuuucuuuaugcagaguaaguguuugaacaguccuguuucaguagcugugcucuucugcuuucagugaguucuguuucauuuugcauuucucugcacugggcacuaagcuuuguuuuugaaaagagaguuugcggggaagaagaugagagugucuucaucuggcacacagaaagagaacuaauaucuguuaagugcuuacuacaugcugggcuuuugauguauguuaucucauguaaccucaccuuaucgcauaugaaagauccucuccagaaagcuuaugaaaguuaccccacgucacagcaaggaagaguccaacucugguggccugacucccagcaccacuccuuccuuuuccccacagcacaccugggcccacacugugccuccuuagggcucugaaaugcugggaacagaguggugugaggaggguggucauucucaggccauuuuaagcaauaacuauuucaacagaacuaguuuaaagagguuuuuaagcagggaagugaccugaaguggaaguaugagugggaaacuugcauggucagcacuggauuuccaaugaagaccuggaauccguuaggauaggccagggaccaaggcugcaggcuggccucucugcccacaacucuccugaccuuggaagcaggguacggaggcguguguccuaaaauaaagcauuugagcugcugcuacagaggaacaaucaccagauauugugacccuuucagaugcccaguaguccugggaggcaggcagggcagguguuauuaucccuucuuuauaaaugaggacacagaaugaggcaguacaagugacucuaaacacccccuuagugccacaucagucucgccaccucccaggacuaggugucaccuguauugaccucuuccccucugauuauaaaaguaauauauguucauuguggaaaguuuggaaaaugcagaaaauaaaauuaauaauuuaccccaaaucccaccauccugagaucaucacuguuaauguuuuaguguauuuccuuccuguauuuuuucuaugcauauauaauuuauuuuacuacaagauugggaucaugcuguauuuacagauuuguauccugcuuucuuuaacauauugugagcauuuucccaugucaauaaauauucuucaaaaagua

SEQ ID NO: 16343 - RNA, 13520 nt, Homo sapiens
cucuuuagcuugguucuacagccauugggauccagacaucagagggugugugccuagcuguggagaagagaauuacuuccccacugauggagcccagcagcauugagaaaauuguagagauugaugcucacauagguaaggaguggaggaaagcuguucuguaggaucuggucuggguuaauuaguccucuaugauguuccaaggaagguuuaugaaaugaacacguuauccccuuguuagcuauuauuuuccaggcaguaggccagaaugcguaaauguaggaguaggaggcuguugcaggacucauuuauguuuaaccuacucccauaaguuccuuuccccucaaauuuagacuugguaaaugugaugguuguugaaauaugcaaagguugagaucuuugaagugacuacaaguuauaagaauaauauagacuugccuagaucagucuuccuccuuuguuuucagauuaucuuuguauuccuuguugccucugcccacuuuuuuggucuuuaauuccccugccuuggcuucugacaucauuguauaauaguauuacagggugaguaauucuacuuauuuauagaauggcauuuuauuuggcuauccaaauuuucuuaaccugucuagucaucuaauuaaugaagcauuggcaaaauaauuaauugcuugaaggcaucagaaccaaaugccauggugacucugggagcuugauauuaugucuuucauagauauagaaacugaaauuuuaucuuuuaagauuggaacauugugucuucuuuaacucaagucacuuggucuuuugaagguagcucagugucacuguguucaacaaauugagagccuacaaugugccagaccuuaugcuagauaccaggauauagaaaggaauaagacauaguccuuguuuuacaggagcauacagucuaauuguggugguggacauguaaguaagucaaugcaauuaagugacaaaaguauuaagaaagacuaguguguucuuaguaggaguacaagggaagaaauaauuaguuuugccuggagucagcgguaguggggcuuucagaaaaggauuccaugaaagugauuuugagcugaguuuaauucugaaagauaaggaaguguacacaaggcaaacaagugucuggguauagcaagggagagcauucuagucagggggaauagaaaugacugaagccaucgugguguaaaauauaaaauaccaugucacaagcaguuuuguaggccugggccaugaacugcagcagcagagucggucagagagcggaauuccuuuuuuaccacacugaagggcuucaauguaauccuuuugcaaggaugggaaagguuuuaagcaaugagguaauaggaucccauuauaauuuuagaaaggccauucugauaaugauauuaaagauagacuaaagagggcugaaacuggaggcacggaggccaguugaaaaauuuguaauaguccaaacaaagagauggugaagguuuuaaccaacacaguagccagagaauggagaggaagauagaaauugacagaacuugugaucugauugauugugagggccaaggaagaagacggggucuggaagggaaaugagugugugauauguccaaguagauauauuaaggaaguuauuuggcuuuauaugucugaaacuugggagagaaacuuaggcuggagauuuagauuugagccauggcauguacaauaacaguuauagccauaaucgugacagcuugggccaucaggcaaacucucucugauauaacuaguugcuuuguguuugggacagagaggcaaaaggcuuuugauuuauucgagaguccuccacuguaguccauagugaggugauuuucuuuuccuuguuucccagguuggggcauuaguauuugcuucguuugaaaauguaucaucgucuacaaagagugcuaaagggaugcuuagggauguaauauguggaaauucauguuugguuagcugcuuuucucugggcuuauuuuuaucgucuggacuucugugucauuguggaugguuuuuuguuucuaauaucauuaauacuuggguucagugcagaucauuuccuaucuaaucuuuuggguauaaaaugccaugggauagcugaauggcugccgugguuccaauccagaauuucaggauuuccugaguggaugaaagaguuuuacaaggauuuggccacugggucacugucgcuuuuacauugcagguugugccaugagugggcuaauugcugaugcuaagacuuuaauugauaaagccagaguggagacacagguaaaauuggcauuaucuccuuuuuaccaggaugcuugaguuccuuguuuagugauuaucuagcugccugggcuauacugcagguaccugugucaauauuagauguggcucuugggaguaauuuuggguagaauucccaguuagaacuuccuggggcuuggaguuuagcuguccaaucauugcaguuuuaaagaggcucuggucaguagugcugacagugucuuccuuuuuuuuuuggcuuugccuauauauaaagcaugcauuguuuccuaauugacuuugugugggagcaucauggcaggagguggacguaguuaaaggauauucuccccucagcugccuuugcugccaggcuuguaaauaacagcccgccuuuggugaguaauaacuuguaccaacugacaaauacuggucagggauacuguuuuuuuuuuuuuuaaacuuuguagcugcugcuugaagauaggcuaguaagaaaaauacaucacaugguaaaauuuuuuguacuuauuugcaaguuugcugucuguacuuauguaagaauaagucauuugaacaucaacagaauaagcuagagucuuugagggaaagaggcacuuuuaguuuuugaaagaguaaacuuggugcuuugaggcauaacccucuuuuucaaggcaguaauucucuuguccgucguugcguagaguccuugugauauguuuauuuccagagcuauuucucuuccucucauguacucccaaguacucaggguuaauguuaauuaagaaaaccacauuugagccuucaguuuucaaucccaguuuaaagggaugugcguagugagauggugggcugcuuuaauguccuuauuagaagguuguaccaugcuuugcucuucuucuagaaccacugguucaccuacaaugagacaaugacaguggagagugugacccaagcuguguccaaucuggcuuugcaguuuggagaagaagaugcagauccaggugccauggugagugugauacuucugucgaguuuucuuauuguucuaugggacuuaggacauuuguccugugaacauaacauucccagccccucucaccuccuuacuuuauagccauuuaucuuaauaucucuuauuuuuugguucuagucucgucccuuuggaguagcauuauuauuuggaggaguugaugagaaaggaccccagcuguaaguaccauuuuguaauuuucccccaugcuuuugcagggaauuauuuuaauuugggguggagacugagaagauuauuguagacuguuagccagguauuagcacacaccuguagucccagcuacuugaaggcuaaggcaggaggaucucuugagccugggaguuguuauccaggcuguagugagcuaugaucaugccacugcacuccagccuggauaacagagccagaccccaucucuuuaaaaaauacauuaaaaaaagauuauuguaaaaagggcuauuguagaguguguguguguguauguauauacauauauauggcuucuaauacuaaaguuuagugauucuauaccguuugcacaaauuuggggauuccaugaagaauuccccuauuggaaccagugcuaauucuggaaggaauuagaaguaacuuguuacuauagucaggguauguuuuagaacuuugcucuggaauguugaucugauccucauccucaaauauuucuaagauaggcauaaacaaguaccauauuuauacauacuauacuucuaaaucccuaaggaagguacuaauuuucuuaaacaguuuuuaaaaugucugguuucuccagacauagaacaucuuuuagaucugugccucaauauuucagugguguuuccuggcugcagggccaagcauuuauacuuuguuuuagugagacguuuguuacauaaagugccaccacuccugagcauuuuaguccucauuuuggggguuuugcagguuucauauggacccaucugggaccuuuguacagugugaugcucgagcaauuggcucugcuucagagggugcccagagcuccuugcaagaaguuuaccacaagguaauuaaguauucucacaacucuuacuauuuuuuuaucaugguauaauuuacauauaauaaaaugugcaaaccuuaagaguucaguucuguuuugacaauugcaaaacaagauaaauaacacuuucaucaccaccagaaaaaugcucauccacauuccagucaaucucuuucccucccuugcaaccauguuuaccaccauguuuaccacucuccauuaguuuugucuguugugcuuuguuauaaauggaauuaaacaguuagucaguuuguaucuguuuuguuuaacacacuguuuuugagauccauucauguuguuccaguauuuccguuugauggcugaguaauauaccaugguauggauguaccacaauauguuuauccucuauauucacagcuuuacuuagcacuuuacaauuggcucuugaagcaagugggcauuugguauuuucuuugugagaugggaagauuugguuuuggguaacucauuggugugauugaaggcugcucuacuuauucaggugguucauacagggaugccugcucacauuagcuccuaaugguauugcuuuuacauguggaagaaauuagguacaaaacaggguaaauuugaauuuucuaaaccauugggcuaccucuuagaucauuugggcauuauuguucauuggauauuaccaauaauauuaucuucuaaauuaaaagaggaauucaaauguacacaagacuagucuaucccuuuccccuucuucaaagauuacuuugguuggugacuuuauuguggcucacaauaagguuuggggguuuuuuuuccugaaaaaauguauucuacuuauuugccauuuacuugaguucuggagauacuuguaaugcaccauacuaaguaagauguuugacauacuugcuaaauacuuuuuucagugagauaaagggaaaaucuuugaaggaaggacggauugugcauaauuaauaggcaucuucuugccuucuuuguuucaagucuaugacuuugaaagaagccaucaagucuucacucaucauccucaaacaaguaauggaggagaagcugaaugcaacaaacauugagguacuuucuguuuuauuguuggauuuuuuucgguuuuuuuuuuaagagaugaggucuggcuauauugccuagacuggucuugaacucaugaguucaaguaguccucccaccccagccucucgaguagcugggacuacaggugcacacaccaugccugguuaauguuuuuuaauuuuuuuagagauggggucuugcuguguugcccagacuggucuuaaacuccuggccucaggcaauucuccugccucagccuacugaguaccugggacuauaggugagagccacugcaccuggcuguuuuauuguuuuuuauucagauaucauagcuggcauugcugaagacuacauagaucauggaaaugacauuuuuguauguuuaguuccuaagaaauuauuaacagccuuugaauaauaagcagcuucaguaaaguggugcuggcagaagccagaauucagugaguuaaagaaugaggccuggcgagguggcucacgccuguaaucccagcacuuugggaggccaaggcaggcagaucacuugaagccaggaguucgagaccagucuggccagcauggcaaaaccccgacucuaccaaaaauacaaauacuagccagguguggcggcacgcaccuguaguuccagcuacucgggaggcugaggcaucagaauugauugaacccaggauuuggaaguugcagugagcugagauugugauacugcgcuccaaccugggcgauagagcgagacucugucucaaaaauaaaauaaaaagaaugaaagggagaugaugaguggagaaaacaauaguaugcugcuuucucaagaaguuugauuagugucagcagaagauagcauuaaagaaaaggauugugucuuuuuuaggauguggaaaagucuugaaaauauaaacggagaugaaacuaguguauagaaaaauguugaaagaguugggcgcaguggccuguaaucccagcacuuugggaggcugagacagguggaucgcuugagggcaggaguucaagaccagccugcccaacauggugaaaccccaucucuacuaaaaauacaaaaauuagccaggcguggugguggacgccuguaaucccagcuacuugggaagcugaggcaugagaaucacuugaacccgggagguggagguuacagugagccgagauugcaccacugcacuccagccugggcgacagaacgagacuccgucccgaaaaaaaaaaaagcugaaagaaauaaaaggagagguuaggauagugauggaaaaguuauagaagagguaaggcaugguacacaugaaggaguugguuuugaaaaguaaaauucauucagcaucauauugaguacccauuauauagcagguauuaugcuagaugcccaggguuacagacacagaaaauccaauuccuauucaaguaguauacuguguagugcagggaacauauagauaauaagaaccuggggugauacuucuauaauagcaguaaaaacagauuccugugaguauguauaacuuagacuaaagcauuagggaagcuucuuggaagaggugaugucuggaaaagggagcagaaagguauuccaggaagacgggacaacaugugcaaaggguucaagauguaaaaauaauauuguggguaaaggaaacuuugagguuuugucugacugcugaggugugggauguauauaagauggugggggacgguaagggaugagacuggagagguauggaccagcuugggaauguccuuuuuuaguaugcuaagaguagacaggagcaaaggaaguaaugacgaguaaagauagguggguuuggcgguaaaccuggagagaugucccacauuuccccagauuuuuccuagugauuguaaagucaucugccgaggguaggugaaugcaacaguaaaauugagaaugggaaauauuuggaaaaguuguuaugagaagacagggaagaguaaaaggauugcugggccauauuaaaaucguaguugaggccaguaaucccagcacuuugggaggccaaggcaggaagaucacgugaggccagaaguucgagacuagccuggccaacauagugaaaccccgucucuacuaaaaaaauacaaaaaauuagcugggugugguggugcgugccuguaaucucagcuauucgggaggcugaggcaugagaauugcuugaaccugggcaguagagguugcagugagcugagauugcacuccagcugcacuccauccugggcaacagcacgaaacucugucucaaaaaauaaauaaauaaaauuuaaaggccaaccaaggcuguaauuauauaucaguaauuaaaccaaucaguacuuaccaggauauuuguugaccacacucaugagaaaauggaugguuggauuaauccaugguaggggauugacuaguuaagaacagaagauuagagaggacuggagaguauuguuggugaaugucucacccauagaaccagcuuucauaggcugcugugaaaggucagucuaagaaggacugacauuugggagccacugcgcuagagcccaucugcuuuaaguucuuaguccauuaguuguuccuuggagcuccagccucccuacaugaacugcuuccccuaagaaaaggaaaauauccggccaggcgugguggcucaugccuguaaucucagcacuuugggaggccgaggcuggcggaucacgaggucaggagauugagaccauccuggcuaacagggugaaaccccuucucuacuaaaaauacaaaaaaaauuagccggguaugguggcgggcgccuauagucccagcuacuccagaggcugaggcaggagaagugugaacccgugaggcggagcuugcagugagccgagaucaugccgcgccacugcacuccagccugggcgacagagcgagacugucucaaaauauauauauauauccaaguuacaucuuacaucuuucuuuuuaagaaaaucuuuauauguaccuccuucugucgaguguccuuacuuucaaugaacuuuuuugagauauaauuuauauacaguaaaauguaccuauuuuaaguuuacaauucagcggauguugacaaauguacaacccccaguaucugucaccccagucauuauauugauccucccaaaaaguucucucaugucccuuuguagucucuucccccacauugaucuacuuuuugucacuauagauuuguuuuguguucuagaauuucauauaaauguuuuuguuuguuuuuuuaagagaugaggucuggcuguauugccuagacuggucuugaacucaugagcucaaguaguccucccaccccagccucucgaguagcugggacuacaggugcacacaccaugccuggcuaauguuuuuuaauuuuuuuagagauggggucuugcuguguugcccagacuggucuuaaacuccuggccucaggcaguucuccugccucagccuccugaguaauugggacuauaggugauuauagggacuauacuucuuucacuuggcaugauuuugagauucaccuguguugcaucaauucuguuacauuucauugcugagugcuaucucauccauccuauuuuuucaccuuuauugccaagucuccuccaaacagaaccuguauuaucuccacugcuucaccucucauuuacuccucaaucacuacuauuuguuucagcuuuuauuauuuccaugagacugcuccuugcuaagauaacucuuauuugucagauuucauggucacucuuuggaacuaucauuugacuuuuuugaaggauucaccucagauuugacaguucuaaaauuaaaaucauuaucuuuccuaaaaaccauuucaucuucccauauuucuaaucuugguugaugacacccccaggguacuugucauucacacgagaaaccuggaagacuuugacuuuccuucccuuuuacucagucauuucuuugcucccuuauaaauaacucccaaauccaugucccuucuccaucccuacuuccagugccgccuuuuguucagguucccauuuuuccccuaccuuguauauuuucagaggcuuccuaauuaaucuugcccuccuccauuucaguccauuuuuuccucauugugcuacuauaguggauuuucuaagcuauaucuaaucuuaaugguucuccacuuaaaaaauauuuucuggcuggacauguggcucacaccuguaaucccagcacuuugguaagccaagauggguggaucacuugaggccaggaguucaagaccagccaggccaauauggugaaaccccugucucuaauaaaaauacaagaaauuagcuaagcacggugacaugugccuguaaucccagguacuugggaggcugaggcaugagaauugcuugaacccaggaggcggagguugcagugagcuggaaucacgccacugcacuccagagcgagacucugucucaaaaaaaaaaaaaaaaaaaaccuuuucugacuucuauugucugugagauaaauuccaaaauucuuuucauggcauaauucacuacuucuuaagucauuuguuuaaucuauuagagacuuugcuaagcauuuuacaugcaauuacaucucuuaaucuucacaacacuucuaugagauagauauuccuauuccgaaaaucuuauuuuacagaagaggaaacuggcuuugagacgguagggccaacagguaaaugguagagucaggauuugaauccaggucuggucuuaggucuuauacuuuuaaccacuuuaacguacugucucccaugagcucugacccccuacucccucuccuuuucacgucauauuccaugugcaagcuguggucuagccauacagaauuacuuucaguuuugcaaauaugucguguucuuuugugguucugugcauuugcacauuguuugcccuuccugucuuugacugucugacccauucuugccaugcuuuaauacacaacucaaaaguugcuucucccugaagccuuccugggcuccuccagaucacucuuaaacauauucuuaguucuauuacaacacuuaccugacauugaacacauuuggcaucuagcacuuaguaaauaaagacuuucuucaucuuuggauccuuagucacaaguacauguaacuaauacacaggugcuuaguaauuaauuauuggugaaauaaauugaaagaaaauaucuguucuaccugccucauagagauguuuuuugaaagugagauaauaaauagaaaaguaucuuucauauuaugcaaauacauuuauuauuaugcaaauguaagggauuauuuuuacuuaucuagugaugagcaacuuccugaaggcaguccuuggcucagacgcuauuauuaauaguauugauuugcguuccaguucuucuguaggacuguuccacucagaguuuucccaguuucugcuuuuuagccccuguaauguuuugagaaggcuagccugagucaugagugaaauucuuuaggcccucacucuuuagauuauugcucuuauauuucucuguccucaugucauugaucaucaaguaaagauauaucuuaagagaagcaguaguaacauuuuuauuuauuuauuuauuuauuuauuugagacaggaucucacuuuguugccugggcuaagugcaguggugcgaucucagcucacugcaaccuccacaucccauguucgagcaauucuugugccucagcugggccuacaggcgugugccaccaugcccgacuaauuauuguauuuuuaguagagacaggguuuugccauguucaccaggcuggucucgaacuccugaccucaagugaucugccugccccagccucccaaagugccauaauugaaggaauuacaggcuaccacgccuggccaagagaagcaguaauaauauuuguauguuuaaauauccuuggaauggaacucauggucuacaugguaaacuaauuguuuaccuauauuuugcagauauauuugggacuuuucugacauuucauguaauuagagauauaucuuuuaggagaaucuagaggagacuacaagcuuugagaggagaacuuuuuuuuuaagucuguucccagauaucagaugucuuaagacuugcagcagucuuucugaauuuuacuuauagaugaggcagaggauacuaaacaucauauaacuggauuaugcugauucucucuagcaacuuucaaguuacauuaaauauuaguacugaaaauuacuuuaaaaugcccuacuauauuuaauuuuaaaaaauuauuauuaauuaauuuauuguuuuagacagagccucuuucugucacccaggcuggagugcagugggaugaucacaacucacugcagccacaaccucccaggguuaagcaauucucccaccucagccuccugaguacgugggacacaggcguuugcuacacccccugcuaguuuuugggguuuuuuuuuuuugguagacacggggucucccuguguuguccaggcugguuuuugacucucgggcucaagugauccucccgccucagucucccaaagugcugggguuacaagcaugagcuacuguuuccagccauguguuuaauuuuaaaaauugaagaaaaaagacacuaugaggaaaugacauguaaaacacaaaucuuuugaggcaaaugugaaguggcaccuauugcucaguauugcccaaaacugugggacaugaucaacagagagaauggaaaaccuagucaugauaguuaaauuugaaauuaaccaucuucugacccuaguuuuuuauuguuguuguugcuuuuaaauguaaauauaaucuggauuuccaguuauuacugauaucuucagcagucacaacugguuuccuaugccaguguuaaugaaaucuuuucuuggccaguucuuuuaaaaaaacguaacaggccaggugcaguagcucacaucuguaauccuagcacuuugggaagcugaggugggcagaucaccugagguugggaguucgagaccagccugaccaacauggagaaucgccgucucuacuaaaaauacaaaauuagccgggugugguggcgcaugucuguaaucccagcuacucgagaggcugaggcaggagaaucgcuugaacccgggaggcggagguugcggugagccuagaucacgccauugcacuccagccugaacaacaagagcgaaacuccaucucaaaacaaaaccaaaaacaaacaaaaaaaacuuuuuuguuaaguuuugccacauaaacaauuuuagagaaaauaccugacaauaguuaaugauuauuuguuguaggcaauaauggucuaagcacuuuauauauauuaacauuuaauccucacaacuacucuaugaauuagcuauucuuauuguccucauuguacagaugaagaaauagaggcacagaguggccaaguaaccucaagucacacacacaagcucaacuuuuaaguauuuaaauauacuucaaauauauuucuaaaggagucuuuaacagaaaaaaguacugacuccauguacuuugcugcugcuuuugugaucccuguugaagugacuucaagaagugacaaugaugccaggcauuugguuaaguaugauguggugaguuaaccuuaaaauagaaaauuuggucaauaagcauuuuuauuuuggagccagagagcuauuuuagggaccugcugccuggaaaggauauccuugggacagcagaucccuuaguuccuaaugaauagcugcaucaccaacacagcuucuccugaccaugguagggccaucagcaggguaacucagcccagcuuauuaacccuucuguuuucuuuccagcuagccacagugcagccuggccagaauuuccacauguucacaaaggaagaacuugaagagguuaucaaggacauuuaaggaauccugauccucagaacuucucugggacaauuucaguucuaauaauguccuuaaauuuuauuuccagcuccuguuccuuggaaaaucuccauuguaugugcauuuuuuaaaugaugucuguacauaaaggcaguucugaaauaaagaaaauuuuaaaa

SEQ ID NO: 16344 - RNA, 26811 nt, Homo sapiens
agaaugacgucugaaaugagcgccgacgcugcccaaacaggagccugcgcaugcgcucugcccuggcagcggcccugugcagaucccugagcguguggcagcagugcggucguggucccucccuaugcagccugguuucuagcgugacacgcccuugacuugaggaccaugaaccgcagccgccaggugacgugcguggccuggguccgcugcggcguggccaaagagacaccagacaaggugaggccuggucgcugggagacaaggggagcagcgucuuuacggcacuggggguccgcccagcugggggaacguggacccggaacucggggcguuggcuggugcgacuggcuggggugagggcggcuuugcccggauugucgcgacuagagcugcaguucagaaggucugguucgccugagccuggagagucaagggccgcgccuucucacuguucccacccucaagcccaaccccacucccaaauucgcacgcacauggacuuagcgggccggaaaggggugggcugcuguuuuugguggguaauaccccaaaaggcuuuuugacaacaccacuagcuucacuagcacccaagugcauuuucaagcauaacugggaagagagcaugaaaacuccacuuuccacucuugugcuccgugucugaaggagugaggaugaaugugguguagaaaaacugguguggaggcuaagaugucgugaggcugggagaugaauagggaauuucuugcaguaauccaagugagauguugaugguagcagggaggaugagagguaaaugucuaacacaugaaaaaccuacaagaguuggagacugagacuguagcagaggugacgauuacuuaaguaauuuccucauuggauacuaagugcuuucuguaggccaggcauuguucaggguccugggauaggcaugaacaaaauagaaaaagucccgccgggcgcgguggcucacgccuguaaucccagcacuuugggaggccaaggcgggcggaucacgaggucaggagaucgagagcauccuggcuaacacggugaaaccccgucucuacuaaaaauacaaaaaauuagccggguguggugguggaugccuguagucccagcuacucgggaggcugaggcaggagaauggcgugaacccgggaggcggagcuugcagugagccgagaucgcacagcugcacuccagccugggcgggcaacagagugagacuccgucucaaaaaaaaaaaaaaaaaaaaaaaaaaaaaaauagaaaaagacccugccuuuauggagucgacaugugcacauauaguaugucagugggaguuaaguucuaccaaacaguaaaagggguugauuugaauguacuugaccaagauaaugaugauggugauaggaaugugauuggcuuggacauggaguuaacaggaaugacggauuggaguagucccaguaguuguaaauuccaccugggcacagacuguuuuauuuacuguuucuccaggguuugguugaugguaggcacucgguguuacauuuauagaauagggacagaaaauuauuucauauaaaaauuguuggaggaaacaguuauuaaaaagagacauauagccuuucaaauacuugaagacugauuuccaaaugaaucuacacauugaaaaucucacacuuggggagguucaaaaaauacugauguuuaugucccacucccaaguauuguguuguaauuagccuguaguguagccuaaauuauuuaagauucccuaggugauucugauguacagauaagucugggaaccacuauuugaagaguuuauaggaaaaagagauugaauuuaugaaauccuagaaaggaaaacuuggaccaaaugagagaaauuggacaagccaguugcgguggcucgugccuguaauccuagucauucaggaagcugaggugggaggaucgcaugagcccaggaguucacagcugcagggagcugugaccaugccacaucucuuaaaaauuaaaauuaaggccgggcacgguggcucacgccuguaaucccagcacuuugggagcccgaggcagguggaucauuugaggucaggaguuccagaccagcccggccaacauggugaaacccagucucuaccaaaauacaaaaauuagcugggcgugguggcgcgugccuguaaucccagcugcucaagaggcuaaggcaggagaaucgcuugaacccgggagguggagguugcagugagccgagauggcgccauugcucuucagccugggcaacagagcgagacuccgucucaaaaaaaaaaaaaaaaaaaaaaaaaaaaaagaacagaggacucauguaagggugauuuguuaaggaaugcccacagggaagagagggagaggugcccuagacagagucagagaugguuggaagaaaaccagacgaguaccacacagccacuuuaccaaaaccagucuuuggaguuuuaagacuaagagguggaguagaaugagcaugauuuuugaaguuucagguagcgagagaucuuauuuguaagaaucuauaaaaucuauauuuuuuaauauagagucuggauugauguuugauucuuaucuugaugacauugcuuggcguuacauuuuacauuuguuugcaaacuacuuuuuaauucaaauaauuugaugauuuccuuacacauauuguaaugaaaucuuugcucucuuacagguagagcugaguaaagaagaaguaaaacgccucauugcugaggcaaaggagaaauugcaguaaguuuaggaccagaugaaaucuauaucuuaaaugaugaugaccauguggucuuguuauuagaagguagcauuugggugauucucuuuuucuuucugugcucauagagaagaaggugguggcagugaugaagaggagacaggcaguccuucagaagauggcaugcagagugcacgcacccaggcacgcccaagagagccccuggaggauggugacccagaggaugacaggacgcuugaugaugaugagcuggcugaguacgacuuagauaaauaugaugaggaaggugacccagguuaguuuauccacuucugaugguuuguaauuacaagcucaauauguuggaucauguuugugguguuccaaagcuuuacucuuagauuuuauuguucuugacaucaguaagauaaucugguugaagacuugggcagacagcaugauuccuaaacuaguuuagaagauaaacucuaacccacuaagauacaaaucuaggaucuaaaaaaaaaaguacuguguauuuuauugcauauaucagguuuaauaaucuguaacccacuugugaguuuuuguaugcaguuauaaugcuauggugugcuugaacuuauauccauauaccuuuuccucaacugcagucagucuucucacaauacaguaguccccccuuauccacgguuuugcuuucuucgguuucaguuagccacagucaacugcagucugaaaauaagugaguaaaguacaguacuuugggagagaugacuuucacauaacuuuuauuacaguauauuaucauuauuugauuccuagguacauauaggaaaaacauaauguauauaagguuugguacuaucugugguuuuagaccaccacugagggucuuggaauguaucccccguggauaaggggggacuacugccugcauuuugagaugcuguucuuggagauaauuagaaaaagaggccaggugcacgugacucacgccuguaaucccagcacuuugggaggccgaggcagguggaucacuugaggucaggaguucgagaccagccgggccaacauggcgaaacccugucucuacuaaaaauacaaaacuuagccaggcgugguggcgcacaucuguaaucccagcuacucaggaggcugaggcaggagaaucacuugaaccugggaggcggagguugcagugagccaagaucgugccacugcacuccagccugggugacacagugggacuccaucucaaaaagaaaaaaucaugggugggaagagaaaaaggaaauagaacagaagacagauuagaaguagaaguuuguauagaaagccucguggggaauaaagugagcugagaugacaacuaccuauauugcucuucuggggaaaguagguauaacgauaaauggaaaaggagcugacaaagcucgcuuuguuucuuuuggaaugugcuacccuagguggcacuaacuccuaaucuugggguuugagaaauaggcauuuggcacacugagcagguuaaguaaguuauuuacuuaacuuguaaaucccaguuagucugcauauuugggagcugaagggacuccugacagcuagaaucagcuacucccaaguuauaaaaucaaaauguagaugaucggaaacaaaaauuaacucuuaauacaaauguuaucugcaacaaaguaaaaucacaacuaccuguuaaauugaugguuaaaauauuacauaagacauagcagagcugagcgugguggcucaugucuaaucccagcuacuugggaggcugaggcagcaggaucgcucaagcccaggaguucaaggcugcagugaacuaugaucacacuguauuccauccuggaugacagacaccaugucuaaauaauaaaaaaguuuaaaaaaguuauaaucaggcacuuaaaaauaucaguaucuguuagaauaucguugaaaugcugaguaaaauaauauacuuuuuuuugugugugugagacggagucuugcucuguugcccaggcuagagugcuguagugcaaucucggcucacugcagccucugacucccuaauucaagcaauuuuccugccuuagccucccgaaugcugggauuacaggcacaugccaccacgcccagcuaauuuucguguuuuuaguagagacaggguuucaccauguuggccgggauggucucaaucuccugaccucaugauccgccugccucggccugaaaaacuccagcaauggggagagggagagucgaaaaugacauugaggaaauaguguuaacuguuaaagcaagguaauucaagguucgugaugcccucuccacuuguguucauuuuucaaaauuucuauaauacaacauuuaaaaaaaaaucagacauguacggguugauggugagcacugugggguaucuggaagagcaguguaguuggaguguggaaagaauaggacaugagacauggucuguguugggcacaggaagaucaguaaacaacagacaggcaaugagaaaugaguaaguaggcucuggguagagaugggauugaccaaagucaauuagcugucuuguccuggaugccucaggcagggcauguuugagcacaguagauaacauuguggaggcagaacugagccaaguaagaggaagauucaguggaaugugacaaacuauaggaagccuuuagugccagagcaauauugagcuugaccugauguaugugaugauacagccuggaaaaagacccaaaggaggggaaaugcucggcaaguugaucugcaugagugaagcacagagaagguggaugggcaguugcugggaagucuggaagaaagacuuaauugggucccaguaaacuuagaauaccaggcuuagcaaucuguguguucucugugcgagaggaaaucauuaaagguuuuugagcauggaacacauaauaauggaacauacacuuuaggaaguuaacucuggcaacaguggagaacagguuggcagauagggugaaucucuuagaggagcagaaacuuaagauaaauuaggccagaagcaaugagggccuggcuuggggcacuaggaaugaggaggaggacauggaagaaagggauugcagagguagcugggaguuuagcaucauccuaguggaugaacucucuuccagaauugguacgucugguuuccaucuuauuaucgcugguguaccucuuuucuuucagacaagaaguaacccugauuuccucacuccaucugaauugauuuuuauugucauuuauccauuuuuccaucuagauguucauuccuccguuuuccucauucgcuuggccaucuguccuauggauuacuauuaacuucauuuuucauuaucugcaguacuuagaaaggaaucauuaccuccauuuaccagcggcacacagcuggugaaagacggugcugaguuuugaccacucucgggcucuaaagccuucauucuuuucacugcaucuuuucuauagauacaguccagcagaggauaguuuuuucuauuggacucuggguuaugggcuccaaccuuguuagggacagagugccauagaaauacagagaaacaaauaacccagccuggagagauggcauucagaaucagcucuuucucguguagcagaaauugcuuucucuguugcauaucagauguuuaagaccuaucaguccugccuccuuaaaguggcuuccucuaacaauucaguguaucuuccuuuuccugaguuauccuuuguuaccaucguagaugugccauaaaagaauaauuuaaguucaguggaaaaagcauacugcauuucuuuuuucauaugccaauaaggcauauuagcauaucagaacacgugcaguagagcaaccugguuaauuuuuugaaaccugucauuucucaauuuuauuugaccaggcaacccuuauuuauuauguugauuucaguguuucagggucauuuuauuuccagguccucaaggcugccucuccguaucaccuucaaucaugaaugcagggagcuagcuagagaaucucaagagaguucucauauuuucuaaaagggucuaauucccugauacaguucuuucauuggaagauugugaauuccaagacugucugaaauccauuccaaaggucaaauacaaaaauggcuuuuaaauuccugcugcugcuuacguaguuuccuuucccaacucuagaugauccagaguuaguuauaaaauagaugauugcaucuaaguccaagaauggaugucauaggaaauauguuuuugucaagaugacuauuuuauuauuguaguuugucaauuuuucuuacagaugcugagacucuuggugaaucucucuugggucuuacggucuacgggaguaaugaucaagauccuuacguuacucugaaagauacaguaaguauuuacaucuuuuuucuaauuaugcucuuaaguguucaaaaaaccuuacuggcucucugcuucuagucaaugacauuuuuuuccucucacuuaggaacaauaugaacgugaagauuucuugauuaagcccagugauaaucuuauaguuuguggccgagcugaacaggaccagugcaauuuagaggugcaugguaagugauaaaucccuuauuaaaagauuuucuaagugaugguaaaauaauaagugaaauaguuaccauuucauuuuuaggugccagauccuauuguaucucauuuaaguugguuacauaguuaacuuuuacacagguggccaauuucuugguuauuguucuggguauguguaguccaguacaucacuuugguaucugaauuuucuauggaaauaaauccccuggaaauuuuucauagggguguuuuuuuuuguuuuuauauauaaacagggucucacuguguugcccaggcugucucgaacuccugggcugacguaauccugauuuggccucccaaagugcugggugcuggauuacaggugugagccaccacaccuggccucauagagguuuuuaaucuuuuauuuaaaugugauugccuguuuuucacuccucuccuacuccugcuauaaaaaaccuggaaguaaaauuauauauaaaaauacaaggcugggugcggugucucacaccuguaaucccaguacuuugggaggcugaggugggaggauugcucgagcccaugaguucuaggcuacagugagcugugauucuguuugcuccacuguacuccagccugggugacaaagaccccaucucuaggggagaaaaaaauguauaaucccauuucccugaguuaauaacuugccaccuugguuuuuuacucaauuuuuuuuucuggcuacuuuuucuuuauguggauuauacuggauagacagguuuuucucauguuuuuuaaauagaguuauuucagauauuuccccuuugcaaaacauuuuauuuucuuccuaauaauucaacacaaagggccacguuucuuuuuuggaaccaaaacaucgugaucaccuuucuuacuuaaggaauauuuguaucaaagccagaagcggaugcuuugcaguaaucagaaguaggcaugaaaauaggaauuuuuaaauuguauuuuuaaauguuguuuuugauuuaauauuaauugaauggcuugccucacuuugguguuuuuaauguaaaaucuguuuuuuauaugcuaaaaguagacuugcacaaugucuggcgcacucugccuacagauucuccguuuuguuuuucuugucccuuccacugcgcucauauccucagacaaguccauccuugcccgauacucuccucccccagcagucuucagaucgucuugaaacuuugaagauucgaagagauuauuaggcugauaaguccuuuuguuauaggaaacacaguugcacagcuugaaaaaauaaaacccuuaggcuuaauguuuaucgccaucuucuagguugcuucaucauggcuuccauugauuagcuuggauuucuguuaccucuucagaaucuuuaaggcuguccgugggaagccuauagauuaggcccauuuuaucucauggcucauugugaucuguuuaugcauagcaggcacuuuaaugugaaauuauucuuucuaacucuugauaucuuugaacuuuuacauauuucaaaugaaaaccauuuguuuacuuugcuuuuaagaccaauucuaauuucaaaaaauugagaaccuauuagaguuuuuuuugucaucaucgauuuuuuuaugcauucuuaccugagaacuuaacagucauuccuuugaacucaggaucaaagaggagcugagaaagaaguuaaagcuguuauauuuccauuuccuucucaguuagguuauuauagauauacuuuauuauuuggguuuggaaggaaucuccaaauugcccaguaugugugugcaagaauaacuucaaauuuauauucuaaaacugauccgaauauugaucucacgugguuaagaguauauuuuaaaguauuauuaccaguugcugggcguagugacucaugcuuguaaucccagcaauuugggaggccaaggcgggcggaucacgaguucaggagaucgagaccauccuggcuaacacgguaaaacccagucucuacuaaaaauacaaaaaaaaaaaaaaaaaucagccaggcgugguggcgggcgccuguagucccagcuacucgggaggcugaggcaggagaauggcgugaaccugggaggcagggcuugcagugggcugagaucgugucacugcacuccagccugggcgacagagcaagacuccaucucaaaaaaaaaaaaguuauuaccaauuuuauguaaaauguaagcugaguauaucgaacaugguugagguuuuuguagaaccacagucuaauaauuuugaacaugaauucucaucacagggaugugauagagcauuacacaaaucugcuaaucccaggaucuauuccagaagcagcaaucugaggaauuaaaaauaaaauccuuaauuuauuauauauuuaccuccuucuuaauacaaagcauauggggagggguucugacuaguggguucuguuuuaucaguguuucacuguguaauuuuuaaaagacuucuuacucauugauuuuacaauguuuuugcugcuuaacauuacagcugugaauauuaaggagcuguugccauauuccaaaaguauguccucaggagcuuuguuuacauuguucaucuucauaaaccuuuuuuaaaaauauuaagaguaauuuuugauaagcauuuagauuuccaaauaugaauuauuucucucccaugcuauuuuugguuuguucuuuuugacuuauaaucagcuagaccauuaaaagauaaaauaauaacuacuucuuguaguuaugaacauuaugaacuuaugaacauuuguuuucuaugaaugaccuagaagacaggaccauuuaucugacaaggaugcagguggacuaucagaugucaguguucauuuucuccugugggguaugccacaagauggcacuguauuagacaugcagaauuuuugccuagucaugauauuggaaucuuuuuuuuuuuuuuuuuuuuugagauagagucucacuaugucgcccaggcuggagugcaguggugcgaucucagcucacugcaaccuccaccucccagguucaagcuauucuccugccucagccucccuaguagcugggacuacaggcacguaccaccacacccagcuaauuuuuguauuuugaguagagacgagguuucauuguguuggccaggcuggucucgaacuccugaccucaagugauccgcccaccuuggccucccaaaguauugggauuacaggcacgagccacugcgcccagccuggaaucucuuuauaauaucagaugucucacuuuaaagcacauggcucacguacauuuaauagaauuuguuuuuuugagcgggaugugauuuuugaugacucauucugauacauuaaagucucuuuucccaaucuuuucaguuuauaaucaagaagaagacucuuuuuauguacaccaugauauacucuugucugcauauccucugaguguggaauggcugaauuuugauccuagcccagaugauucuacugguaauuagaaaacuuaagguuguucaaugauuuccagucuuauguauuuucuccuagcuccauaaauuauguauucucuugaauguuuucagaauuguugcugauauuuucugaaguuacuguuauuuuaugaaguuauagaguucuuaacacaccaucacuuuauuguuugggguucauaaauccccagacuucagguaggcuaaggagguagcugcucuacuacaggcugaaggacagggccugaagccuuuuggacuguagaacuguaaaggucccauaaagacucaguauaaauggccugauaugugagauguuaccagcuagaguucaguggcauaaccuguuuuagaaaacauaagcuaaaaccgaaaugaagaggcuugucacaaguaauuagguuuucauguuagucuuuguaaccacaucugcacacuauuaguugccccuguccguacuuuuuaauaaagguaaacacuguuuauacugucuuacgucuuguuugcacaccuuguucacauucaugaucugaucugaucuucauccccacagcaccccaugaaggaggacgggaggaggguuauucucguuauauaaaugaaaacacuggggccaagagauugagccuuuccuacucaaauuguggcccaaagaccagcagcagcacagcaugguuaucaccugugaccuaguuagaaaugcccacccagaaccaccugaaauacaaucugcauuuguaacauucagaugccgcauaugcauauaaguuugagaagcacugcucuaaagcauuuuucaguuaaucuacaguauaauguauuugauuagaaguucuguaugucuuuuuuuguguaaucauacaugcauuguuuccucccauaggaaauuacauugcuguaggaaacaugaccccuguuauugaagugugggaccuugauauaguggacucuuuagagccagucuucacacucggaaguaaacuuucaaaaaagaagaaaaagaaaggaaagaagguaaagaaguuaauaaauauuuaaacucuaaugacagagguaaguuuacucgggaguaggggugaaggguaagaccguacacuuuuucaaucagguauucuuggugagaugggguagguaguuaugaaauuauuguaauuuuuaguuuugaaaaggccauccaaagaaaacuuauuucugauuacauaaaaccuccauuaucauguuguucuuucuuacacaaaacuaguucaaagcuaguauauuaauaugaauagcuacuauagaugaaggacuuucggauuaugagccuccuccaaauacaguagcuauuuauacagauauaccaaccuugaacuuuaaaaaaauuucuguuaucauguugaauucuaauuauccauguauuaacuccugcagcuuuuaaaaucguuagguuuuaugaggguugggagcuauauugauacuuguauaauuacaguaccuagauuaagaacugcuaggccaggccacgcacguggcucacuccuguaaucccagcaguuuaggaggcugaggcggguggaucaccugaggucaggaguucgagaccagccuggccaacauggugaaacccugucucuacuaaauauacaaaaauuagccaggcauguugguguguuccuguaaucccagcuacuugggaggcugaggcaggagaaucacuugaaccugggaggcagagguugcagugagcucacaccacugcacuccagccugugugacagagcgagacucugucucaagggaaaaaaaagaacugcuaggccagucauaguagcucacgccuauaguccuagcacuuugggaggccaaggugggaggagugcuugagcccaggagguugagguugcagugagccaugauugugugccacugcacuccaaccugggugacagagcgagauuuugucucuaaaaaaauaaacuacuauaguuucuucccuguuccuuguaaugaaauuuuuuucuuuauuuuucuuuuuuaaagagguaaggucuugcucugucucccaagacuggagugcaguggcacgauuauaguucacugcagccugaaacgccuaggcucaagagauccugggauucuccugccucagcuuccugaguagcugggacuauaggcguaugcugccaugccuggcuaaguuuugacuuuuuuguaaagacagaguuucgcuauguugccugggcuggucucgaacucccggccucaagcgauguucccacguuagcuucccaagguccugggauuacagugugggccgcugcacccagccccuguaaugaaauuaaucaugagucucuaacagggagacaagguuuuauuuauuuuauucuucaaaaguuuauauaauaucaaaacaauaggucgggugcaguagcucacaccuguaaucccaacacuuugggaggccgagaguggaucaugaggucaggaguuccugaccacccuggccaacguggcaaaacccugucuccacaaaaaauauaaaaauuagcugggcaugguggcaugcgcguguaaucccagcuacuugagaggcugaggcaggagaaucgcuugaauccaggagguggagguugcagugagcugagaucgugcaacugcacucuagccagggcaacagacaaagacuccgucucaaaacaaaacaaaacaaaauaaucuuaagguuuaaagaauuuugcagauuaauauauucaguuuuauuaugagggggacuuuaauacaaaaaauaauuaaaacaauuauuacagaguuccucagcagaagggcauaccgaugcuguccuugaccuuucauggaauaagcuaaucagguaaaaagaaauaacauuugaaugauuguaaaagacuguagccauugugaucuuaccucaugccuacacucaucucuuuauuugugcuguggaccuuugugucuaucuuccuuucuuguaggaugcccugcuugcaggcaggagcucugucaucuguuucuuugcauccuccaggucaccugccagcucaucacugugggugcucauugcauguuuggugaccaagugcccucucuccaccaccacuggaaaaaaacaggguguuuggcagugcccauggugcaguaggauuguguuucuucccaggagacauuuuucucuguuuaguuuucacaucucaccacauacucuuuuauucuuuuuucuuuaaauuauggcaaaauacauauaacauaaaaguuaacacuuguauuagucugucuucaugcugcuaauguagacauacucgaggcuggguaauauguaaaggaaagagguuuaauugauucacaguucuguauggcuggggaggccucacaguuauggcagaaagcaaaugaggagcaaagucaugucuuauauaguggcaggcaggagaaagggcaugugcagaggaacucuccuuuauaaaaccgucagaucuugugagacccauucacuaucaugagaacagcacaggaaagaccuguccccaugauuccauuaccuuccaccugguccuucccacaacacaugggaauuaugggagcuacaauucaagaugagauuuggguggggacauagccaaauccuaucaccauuuuuaccauuuuuaagugugcaguucaguggcuuucaguacauucacagaguugugcaaccaucaccacaaugcaucuccagaacauuuucaucuccguacugcagcucugcccuuuaaacacugacuccccauuucccccacccccagcccuggcaaccaccacuccacuuucugucuccaugaauuugacuaagcaucucauaugaauggaaucauacagacuuacuucuuugcaacuggcuuauuugacuuaaugucuucagguucagucauguuccaauaagugucagaguuucuuccuuuuuaaggcuaaauaauauuccauuguauguaauguauguuacccguucauuuacguguggucaccuggauugcuucuucugccuuuuggauacugugaauaaugcugcuaugaauguggguguacaaauauucaagucccugcuuucaguuguuuugaguauguacccagaagcguuauuacugaaucuuaugguaauucuauuuuuaauuuuuugaggagccaccauacuauuuuccauaauggcugcaccauuuuacauuuucaccaacaaugcacacaagggcucuagugucuccaaaauuuguuauuuucuguuuuucauaauagccauccuaauggguaugaagugguauaucauugcgguuuuaauuugcauuucccccccuuuuuuuaagguaagaugggggucuauguugcuaaagcuggucucaaauucuugggcucaagcaauccccccgccucagcuucccaagucacuuggaguacaggggcuugccaccacaccuggcuuaaucugcauuucuuaacgauuagugauguugagcaucuuuguuuugugcuuauuggccauuuguguaucuucuuugggagaaauguuuuucaaguccuuugcuuacuuuuuuuugagacagggucucacucugucacccaggcuggagugcaguggcacaaucacugcucacuguagucuugaccuucuggggcucaggugauccucccaccucagccucccaaagugcugggauaacaggcaugagccaccaagccuggccucccuuugccuguuuuuuguguuugauguugaauuuuuggaguuaaaacuaacuccuacuaccaaauacaugauuugcaaauauuuucuucuauucuguggguuguuuuuucacuuucuuggugcuaucauuugcagcacagguuuuucaugugauggugucuacuuuauuucuuuuguuguucaugcuuuugauguuguaucuagcaaaccaucgcuuaagucagggucaugaagguuuacauguauguuuucuucugaguuuuauaguauuagcucuuacauugaagucuaugauccauuuugaguuuuuuuuguguguauggugugagguagggguccaacuucauucuuuuucaugaggaugauucauuugucccugaaccauuuguuuuuguuuugugugagacagggucuuacucugucacccaggcuagagugaguggugugaucucagcucacugcaccccccaccucugggguucaagugauucuccugccucagccuccugaguagcugggauuacuggugcaugccaccaugccuggcuaauuuuuguauuuuuaauagagacaggguuucaccauguaggccaggcuugucucaaacuccggaccucaagugaucugccugccucugccuugcaaagugcugggauuauaggcaugagccaccgcgcccagccccauuuguuaagacuuuuuuccccauugaacauuuaauuaccuuaguacccuugucaaaaaccagugacuauaaauguuuauuucuggacuguuaguuguaguccauuaaucuguauguccuuaugccaguagcacauuguugugauugcuguagauuuucaguaaguuuugaugccaggaaauaugaacuugccaacuuuguucuuuuuuucaguacuauuuuggcuauucuagguuccuugcauuuuuagaaucagcuugucacuuuuuuuuuaagucuaauacuaauaauaguaguacauccuguuuuguuuuguuuugagacagagucucacucuguugcucaggcuggaguccagugacgugaucuugguucucugcaaccuccgcuuuuuggguucaagcuauucucgugccucagccuccugaguaacugggauuacaggcaugcgccaccaugcccagcuaauuuuuuguauuuauagagaagggguuucaccauguuggccaggcuggucuugaacuccugaccucaagugauccacgugccucagccucccaaagugcugggauuacaggugugagccacugugccuggcugugaaucagcuugucacuuucuguaaaaagaaagaaaaaagucaucagagauuuugaaagagauugguugaaucuguagaucaguuuauagcuccaucuguagauguaauauuuccauauuaacacuauuaagucuucuaauacaugaacaugggguuucuuuccacuuauuuagauacucuuguuuccuuucauaaucuucgguaguuuucauuauguaagucuuacauuucuuuuguuaaauuuauuccuaaguauuuuauucuuucugaugcuauuguaaaugcaauccuuuucucauauuuaaugcucuugacuuuuaaaagauuaccugauuggauucuucccuuucucagaaauguuuuagcaagugcaucagcugacaacacuguaauucugugggauauguccuuggggaaaccagcagcuagccucgcuguacacacagacaagguauggugauuuaguugaucacagcgguucuuaaaaaucggacacaaauauuggcuaaaaauaaucccaaacguuuauauauggcuuugaaaauaauuuuaucuggcuugcggcaugcuuucacauguuaucucuuaggauuuucacaaagcccugugugguagguauaaugcccaucuuagagaugaaaaaauggguacagaaagguacgguuacuaggaacauuagugcccuguaacauauuuauagaggcuccuaaaaaaggaugaggucugucagucacaaugguaacacccauuacuguguuauuccccaggaaucuaaugcagauuauuuugggacuucuggagcauggggaauucaccagauggguuugacuacuucccuuuuucuucugaguaucuucuaacauuugagggacuaaguauucugccaaacaguuuggggaaacuacauuuucuuuaagugccagccuuuaugugggagcaugguuugcccuuugauuaugcaguacauuuauguuucuuuuguuuacuguauuucagagggacgcauuuauagaaauacugucaaauagauucuuaccacauguuagguaauuuuacgaaaagcaaaccaacagagaucucugcauuuauguuuccucccuuuagguccaaacacugcaguuucauccauuugaagcacagacucugauuucuggcucauaugauaaguaagaaagcacagcaagaaugauugcuacucuguuuuuauccucuagaagucauuuuaagaguaucacuugguacccaggcagaauguauccuugaggccaccuuuauguuuaaauuauuugcacuacuuauuuuuccuuuuaacucugguccuuucagucuacaacggaacaugauucugucauaauaauauaacuguaggaacuagcaacuucuuuggcuuuuagaggcuguacuuugccuuuaugggaagaauuuccaugucacaugacagagggcauggauauagggagacaugaagaacuggggccacuguggucaaccacgggguuuauagcucauaucagugcuccuuuuuacagauugggucuacagguaggagaaacagauaguagaagccaaaaccaacuuugcagucuuuauuuucauuucuuauccucuugaagcaugauauguuuacauuucuugugauucacgcagaauuacaaaagugcaucccuugcuuccccuaacaugauaaacugcuuauggagaguaagugugccuaagacaugaguaaccuggcucugagcucggccagagaaggggaaauuagaaauuguccugggcuuuuggacauagagaggauucuucuugcgaguggaagauuugaccuggagaaggucaaaaccacuguaacguuagaggcaccagugccuucaaguguuaagaucagaauccaccaauuacugaaacucagcucauuuuuuuucuacuuuauuuagaaccuuaaaacaggcuuuaaaugaaucuugauuucacagugcuauuuuauuacuauuucauuauaaauaaaacauauaggagaauugaacucuuaaaacccuaacuuugccugaaugugucuaggucaguggcuuuguaugacugccgaaguccagaugaaagccaucgaauguggcgauucagugggcagauagagagagugacuuggaaucacuuuucaccuugucauuucuugguaagaguacgaauguuguuguuuugcuuuucuagguugcuaaugacuuuuuaaauuccauaguagagagaauuaucugaaaagcuuuuucuguuuuaacaguaugaaguauuuggguuuaggguugaaagcauaagguguuuuuuuuuaaauaagagaacggcucuuacuuaaaaagcagugaacauguaaaugauuuugcugguugccggccauuccaaagugugccacguuuuauuuaaugauuuugaucauuuuauuguaguguuguuugaaauacuaagcauaguuaguauuuuuuguuuuuuuuaauggcuaaaucaguccaagaugauauucuuuucuuuaaauccucaugcuuaaauggaucucuagugaugagaaugcuaaccuguuaauuuguagcacuaucucccaaauaggaaaaaaaguauaagaccucugucuaaauacccuuauuaucuaaggaggacaaugauuuuccacauagcauccaaagauuccacugacauuucaguacauguaaaaagaaaagcccagcuuucauccagagcaaagauuaguuaaauuuguugcccaguuuuccugaaguaaauauguagugcuuugcaaaggugagaaagaguuuuuuuuuuuuuuuaaauuuaaguucuaggauacaugugcacaacguccagguuuguuacauauguauacaugugcgauguuggugugcugcacccauuaacuugucauuuacauuagguauaucuccuaaugcuaucccucccccuccccccaccccacgacaggccccagugugugauguuccccuuccuguguccaaguguucucauuguucaauucccaccuaugagugagaacaugcaacguuugguuuucuguccuugcgauagauaguuuucugagaaugaugguuuccagcuucauccaugucccuacaaaggacaugaacucauucuuuuuuauggcugcauaguauuccaugguguauaugugccacauuuucuuaauccagucuaucauugauggacaucuggguugguuccaagucuuuucuaucgugaauagugccacaauaugcacuauauguaugugcacauaugcacauacgugugcaugugucuuuauagcagcaugauuuauaauccuuuggguauauacccaguaaugggauggcugggucaaaugguauuuuuaguucuagauccuugaggaauugccauacugucuuccacaaugguugaacuaguuuacagucccaccaacaguguaaaacuguuccuauuucuccacaucucuccagcaccuguuguuuccugacuuuuuaaugaucgccauucuaacugguguaagaugguaucucauugugguuuugauuugcauuucucugauggccagugaugaugagcauuuuuucaugugucuguuggcugcauaaaugucuucuuuugagaagugucuauucauauccuucgcccacuuuuugauggggcuguuuuuuucuuguaaauuuguuugaguucauuguagauucuggauauuagcccuuugucagaugaguagauugcaaaaauuuucuccuauucuguagguugccuguucacucugaugguaguuucuuuugcugugcagaagcucuuuaguuuaauuagaucccauuuaucaauuuugacuuuuguugccauugcuuuugguguuuuagacaugaaguccuuguccaugccuauguccugaaugguauugccuagguuuucuucuaggguuuuuaugguuuuaggucuaacauuuaauuuaagucuuuaauccaucuggaauuaauuuuuguauaagcugugaggaagggauccaguuucagcuuucuacauauggcuagccaguuuucccagcaccauuuauuaaauagggaauccuuuccccauuucuuguuuuugucagguuugucaaagaucagaugauuguagaugugugguauuauuucugagggcucuguucuguucuauuggucuacaucucuguuuugguaccaguaccaugcuguuuugguuacuguagccuuguaguauaguuugaagucagguagcaugaugccuccaccuuuguucuuuuggcuuaggauugucuuggcaaugugggcucuuuuuugguucuauaugaacuuuaaaguaguuguuuccaauucugugaagaaagucauugguagcuugauggggauggcauugaaucuacaaauuaccuugggcaguauggcuauuuucacaauauugauucuuccuauccaugagcauggaauguucuuccauuuguuuguguccucuuuuauuucguugagcagugguuuguaguucuccuugaagagguccuucacauuccuuguaaguuggauuccuagguauuuuauucucuuugaagcaauugugaaugggaguucacucaugauuuggcuguuugucuauuauugguguauaagaaugcuugugauuuuugcacauugauuuuguauccugagacuuugcugaaguugcuuaucagcuuaaggagauuuugggcugagacaaugggguuuucuagauauacaaucaugucaucugcaaacagggacaauuugacuuccucuuuuccuaauugaauacccuuuauuucuuucuccugccugauugcccuggccagaacuuccaacacuguguugaauaggaguggugagagagggcaucccugucuugugccaguuuucaaagggagugcuuccaguuuuugcccauucaguaugauauuggcuguggguuugucauaaauagcucuuauuauuuugagauaugucucaucaauaccgaauuuauugagaguuuuagcaugaagggcuguugaauuuugucaaaggccuuuucugcaucuauugagauaaucaugugguuuuugucuuugguucuguuuauaugcuggauuacguuuauugauguguguauguauguugaaccagccuugcaucccagggaugaagcccacuugaucaugguggauaagcuuuuugaugugcugcuggauucgguuugccaguauuuuauugaggauuuuugcaucgauguucuucagggauauuggucuaaaauucuguuuuuucguugugucucugccgggcuuugguaucagggugaugcuggccucauaaaaugaguuaggggggaaagaguuuuuuaaaaacagcuuucucaaaagauguggacaauuuuaguaagauucaugaaguaaugauucugagauacuuaaucucaauucugcacgauuaguagaggugcaugcuguucuagccaggcagccugaagccugacuuauuuuuacaaugaucauuccaguuguacuugaauguuguguuguacuucggcucucacucuucagguacgcaacuuccagagauuauuugcuaacaaauggucauauauauuagaaucccaaauauuuagggaagugagagguuaaaguagaugaaaugguucaccugcuucccucucaucucaaaagaagagccaagccuucucuucccuggccuagcagucagacugccucagccguccuuucuuuauccuuuuuucuuguacuggcuguugcccuuggccuguauacaggcucagguuucugucucccauuuuuggcucuguaucugucucuuaauuccuucauuucuucuuucuuucuugacaguguaacaaugcacucuaaucugccuuucauuccuaaguuccuuaucugauugaauuucucugccacacuggucgauuugacuguuggucacgccuugguuccuugacacucuucccuaucccuucuucccucucugacucacuucuguggaugcuuccucagccugcaacuugaguagccaugcucaccaggccuguguucacguggauguaacuauggccucuuuucuucuacugcucuagccccauuccagaccauucaccacagcuucauacucauauccaguagacaugucaacugaauuagcccaugugagugcaaacucaggucguccaaaaguaaaugauuucuguccauguuaauuuuucauaaguuccaccaguaagucauauagcugauuuucacuaugacuuagacuuuuuacccauuguuagauuuugugacguagcaugaccuugcccaucuuuuacucuuucuaggccaguacagaugacggcuuuguauauaauuuggaugcacguucagauaagccaauuuuuacacuuaaugcacacaaugaugaaaucucuggugagcaagaguaaugcuucuuucauuuuucuuaacuuaugaugaaguaaaucuguauuucaaagcgaaagugucuaaacuuaucuuccuuuaggucuugaucuuagcagucaaaucaagggcugucucgugacugcuucagcugacaaauacgugaagaucugggacaucuuaggagauaggccaagucuaguucauucuagggacaugaaaaugguaagaaucucccuggguaucuguuuuuuauuuauucuguuucugaccuugucuuuuucuggaacuuguguugcguguuuuucuguuggaacuauugcauuaacaaauauggauguguuggggaagugaauuuugaguuuagucaaauuuggugggauuuuaugacuuagaacgcuuuguggggaauucagugacugguucuuuuccaacucacaugauuaacaguugcuugguaaggcuggggagaggguuuucuaggacacaagugaaauggcugcuuuuuuuuuuuuuuuuuaaaacccugaaaucaagaccaucccaagaaaucuugaaccucagggcaccguagcuauuagggucaguuuauguaucuuuaucucuuugcauaacuaguucugacuacacugaaacaaauuacuauauaguaggaaaaauuuagaaauaaccagauucacucaagaaauauuuacugagcaccuacuguaugccaaccacugaguuauauaaguuagacugcagacacaguaacacugcacagcuguugaaaauuguguaugaauaaauauauauaaauauaauggaaaaacagguuacagaagcaauuuuuguaguaccaucucaugcuuauuuuuaagugcauaauugccuaaaugcuuacauuuaacucuaguagauuauaucccagaacauaaaccgugguuaccucccugagagauuuucauauauuuuucuuguucauauuuucuauaacaaauauauauuaccuauuaauaaaaauguaaaaaagaaaacaaaguuuaaaaaugauuuaaacuggcaucauuguuauuguuuaaaaggacagcuaaaguuucuggaaauacauggcacauuagguuuguuaggaaaucccuaagagacagagugauaacgaagaugaguggccugaguggucagaaguugcagauaucauuguggaagaaccagcaugcugcgcuugucuggcuucauauuguaguacuagcccuucugacuugacucugagcuaccuuugcaguaggcuugaaagugagaaucauaaguugguuuugaauaaccauuuaaaucauagauucuuagagacaacagugaggaucuagauauuagcgcuuucugaagagauugaaaucaccaucuuccuguucucucucuagggaguucucuucuguucuucauguugcccugauuugccauuuauuuaugccuuuggaggucaaaaagaagggcuucgggucugggauauaagcacagucucuucagguaaggauuuuuaguucucugcacaccucccccugccccuguaaaaaaaaaaaaaaaaaaaaagacagggucucaccauguugcccaggcuggucucaaacuccuggccucaagcaauccuugguccucagccuucuguauagcugggauuacaggugugagccaucaugcuggccucuccucuuucugaaugaguucuguaaggacugacacagaaugugugacuugaauuguuucucagcauuuuggcuaagaccaagugcagaauguguguccugacuacaucaggaagauagcaaaaguaguguagucuuuuuaggaaagagacaagaucagauguaauugguaauguuuguucauguucacaaauaaguuugucuucacacuuuuaaguguagaucauuuaaggccgagaccagcucgguuggggagacccuaacccaguggcgcuagaggaauuaaagacacacacacagaaauauagagaugugaagugggaaaucaggggucucacagccuucagagcagacagccccgaacagagauuuacccacauauuuauuaacaccaaacuagucuuuagcauuguuucuauagguauuaaauuaacuaaaaguaucccuuaugggaaacgagggauaggccggauuaaaggaauggguuaggcuaguuaacugcagcaggaacaugcccuuaagacacagaucgagaucgcucaugcuauuguuuguggcuuaagaaugccuuuaagcaguuuuccaccuugggcaggccaggcguuccuugcccucauucguaaacccacaaccuuccagcuugggcguuagggccauuaugaacauguuacggugcugaagagauuuuguuuauggccagauuuuggggggcuuguucccagcaauuuaacaaauacauaucuuaaaauugaaagaucuuuggggaaagcuggaaagaaauauagcauggucucaacaaacagcccucucccccacaguuaccagugugaauaaauccaccguuugcucaacuauaaaauucuacaaaauccaacuuuccggaaggggccacuccucucccuucaggggauccuggcugcuuauuuauuacuuugagguagucuggugcguucuacaaacacagagauaauauauauaucuccccacuguaugauuccugcauccucccucccaugcaaaacaaggauccugagauuuuucucuggguuauucugaugugugugaguccuaaguccgaaaaguucugugccgguuaugaucagagaaaagugaaagaaaaaaauaggaagcaaucagaaguagaauaaggccaggagagggucacuuauaaggaaugggacauuuguuaccaaggcggaucagauaaauccaagacauggcaaagaaaguaaaguacaaaaauaaauuggaccauuuaaaaaaauaauucacuucauucagaacauuaacuuggacuucugaguugguuacucacuuuaccauuuauaaaguacuaagugcacaauucugcauuuuagugucuuuuuauauucugacuuaauuuccugaucuguuaguuucuuaccuguuuauuuguauuuuaguaaaugaagcauuuggaagacgagagaggcuuguucuugggagugcaagaaauucaucuauuaguggcccuuuuggcagcaggagcucagauacacccauggagucuuaaugaagaucaucuaauuuccugcuuaccuuaacugggaauuuuaaaaaguuggccuaaaaauguuccaugcguggcagcaaccaugcagagugacugaaacacaauucauuucugacugacauuccuuucugcaacugcgguggcaccacaaauauccggucuuugugcuugcucuucagauggaugguuuguaaggcucuuguugcauuucuuaaaaaagaguaauaaaaaggauuuuuaaaaaguaauuccuuaaacauaccaucugucacaguuaaucuagauuuguaaauagguaguaauuuauagaauuuuuaaagcg

SEQ ID NO: 16345 - RNA, 24706 nt, Homo sapiens
ugcggcgcuggucgcgccugcgcuuugguucuuggaaggcggugcucugagaagccggacuacgcggcagcggcucuucaaagcggagccgggaguuuuugcuacaguuuucgccaccaugagucgcagcuauaaugaugagcugcaguucuuggagaagaucaauaaaaacugcuggaggaucaagaagggcuucgugcccaacaugcagguaaggcaggagagcaaauggcggggccuuccgugcuccguccccggcccggccggcguccacugcgcccucuggaccuccccugaccacuggguccgccccggccccuugcagaguuucccucaucccguccuucuccccucacgguucuggggccgcccaaccuguuccggcaccaccucccgccaggagagguccccgaaccacgaggacaagcuaagugcgguggauaugggaaucuaaauaaauacgaaauugggguuuccaaagcguuuucacagaucagucucauaaacguaucgugagcuguuuuacguucacagaaacuucagugaucuuuuccaggguggaacagccagccccagguucauuugcugggacuggaauucaccuccucugagucaugcugguuauuuaaauaacguuuacaaaccuuuguucacuaaaccagguuuucagcauucaguaucgcauguugguuuuuaauaaagcgaugucauuucuugcaguagcgcagggcagggccuguuugauuuuaauauucacuucacagaaggaccucgaggaucugucggugacauagcuuccucuacccaccuaggaagaagcucagccaggacuugauguccgguuuacuucuuugacgucccagauggagacuugagggcucaggaucaucagauaguuugaaagccugggcucuguaucucucggccuucaucaccaucugugcucauauuuuuauuaaugugaaaaaagaaaacguuuaugaaguuuugcaacguauuuuuaaauaguuuuugaaaucccugaaggugccaaguaaaugcuucaaagguuuaccgucucgucucacgucuugguaaacagcucccaauagucacuccauucuuuuauucagaaucaaagcuuacugaguuucccuuguuggcaagucacuuacacugagggaagaaaaagcgcacggggauaaaucuguguucuguuugcuguuuggccacuuucuuuguguggaaaccguuacccugaaggaaggaauagaaaaucuaacauagggagagcgcagugguucauggccuguaaucccaacgcuuugggaggccaaggcgggaagauccuuugugccuaggacuuuggagaccugccugggcaauauagugggacccugucucuacaaaaaaaauuuaauuagccaggcgggguggugugcaccacagcuacucaggaggcugaggcagggggaucgcuugagccugggagaucuuggcugcagugacccgugaucauucuaaacugcacuccagccuaggugacagagugagucucaaaaaaaaaaaaaaagaaaagaaaaagaaaacaccaugacaugauuaucuguaggaucuaauaacacagacugucauugucuggcagguguucugacucagccuuugaugcacacacugcugcucauucuaucuaggggcaagucucauuuugcuaggcaguucugguuuaaguuuguauacagcacuuuacuaccaccuuuccuuugggaauagagacuuggaauguuaaugcauugcucuuaaaacgcuauugacuucuaagcgugaauugugcuuccauaugagagcagugaauuucacacagauaaucaucuguuacuaaaucuccauuucucccccaagacccacauguuggacuaaaaauuucucuuuauucccuuaaaacacucccuucccaucuuuacgucauuuuugcguuuaguuccuagauguucugcugcgccagugaugucucuugucuucaaagaaccagcucuacaggaucucugugaaaccucucccagcucccuagacuguugaggcacuuccucaucagauucuuccauagcacuguguacuuaauguuauggcacuugcuucauugcacucugauauucuuaucagaauauaagggcuguacuggcugggugcgguggcucacgccugcaaucccagcacuuugggaggcugagaugggcggaucaugaggucaggagaucgagaccauccuggcuaacacgugaaacuucgucucuacuaaaaauacaaaaaauuagcugggcgugguggcgggcaccuguagucccagcuacucgggaggcugaggcaggagaauggcgugaacccaggaggcagagcuugcagugagccgagaucaugccacugcacuccagccugggugacagagcaagacucagucucaaaaaaaaaaaacaaaaguauauaagagcuguauuguguacugggagcuccuugaaaggaagaucuuauauucuuucuaucuccccuagugcccaggacagugcuucaugcauaguaaauccucaguuaauguuuggugaauuaauaaaugugacccuuaagaaauuauacuggaaauauuuuccaucaguggguauuaaauuguuauuuaugcaauggugaugaagucaucuuucugauaaaaacuacauucaauugauuaaguguuaaaucuuugguucuccauuacuggacagcucuuucacaauauuugaccugugauaaaaauguucugcucuuuaguguuacauaaguaugucguccauugccuucugugugcugccucuauugucaagcuuuaaaauuauagauuuuuuaaaaaauuauauagcuuucagaacugagcacacaacuacguagcugcauguuaaauuuuucuucucacuauuuaccuaacuagagauuuguaagucaccacuagagcacaauaaaauguaauuugcuauuggcuuaaacacagaauaaacauacuagguuagaugacuacguuuuauguuuagaauuggacuuuuugauucauuugguuuuuuuuuuuaauuuucaaaaaaccauugauauuuuugaagcuugaggauuaagaccuuugggcuuugugagaguauaguuggaagauuuuucuuuaucacaaaaagaugcugaaucuguugaauucuuaaaugugguuuugaggguaugagaauaaacaaaacaauuugugaacauugcagaauuuuucuuaagguauauuuuccgaugggagcagcucguagucuuugauaggaaguuuucugugugcuuaagguaacgugaaaguguuugguaaagaguaaagcacaguaaauauugcauacagugcauucuguccagugccuacacuugccgcgcauguacucagacauugcuuuucacuuuccuugguacuagguugaagguguuuucuaugugaaugaugcucuggagaaauugauguuugaggaauuaaggaaugccugucgagguggugguaaguacauuagaguuucacuuguguuaguacgguagugccuucccuguggccugaaaaaguggcaacucaaauaauuauaauucugaaauauugucaaggagugauuacaacuuaaaaguaagaccaaaagcacuuacuuauuugugaucacauugucagccaguuggcguuauagaacggauuugaagcuccaucuggaauuugaagcuggguagaacuuguuucucagcuaaccuugaacaauaauagcaagugaccuaccauuuguuuugcacuuacuauauuccaggcauguuacuaggugcuuugcagagauuaucucaugcaauacuuacagugacucuaaaaggagcucccuuccaucuugcaucucaaacauccuucuaggcuuuguugucuuaguagcccuaaugacuaccucuucacguuauacagucuaaaaacaugaauauaauucaugcuaaaaaucaaguguguugucuuuucuaauacccaauuuuugucuucagguguugguggcuuccugccagccaugaaacagauuggcaauguggcagcccugccuggaauuguucaugugagucagaguucagaacuuuaaucauuuauauuucuuaaaguccauugaauggaugaauggccaugccugauaguggugucauuuagacaaugaccuuuggacagccagacauaaccaugaagccaggcucaguggcucaugccacccgcaacacuuugagagaccaagauggaaggauugcaugagcccaggaauucaagacuagucugggcaacauggcaagacccugucuauaccaaaaaaauuagucaggugugaugucacaugcuuguugucccagcuacuuagaaugcuaagugggaggauugcuugagcccagaguuccacacugcacugagccaugaucacgccacugcacuuuuagcguggauggcagagugagacccugucccuaaaaauaaaaaauaaaaggaaauaaccauggaccuaaagaaauaauugaaucuggaugguauuucaguuucugaaugcauuuggcuagaaucuguaaguguuaagaaccuucgaaguaguuuuuguguuuuguuucuuaucaugguaacauuauuccuggaucagugcaccaccauuguaaguuucauuguaaguuucacuucacuguuucaauguaaguuucauuguaaguuucgcuugguuguaaguuucacuuccuaugcagaggaucauugaagaagaaauggcaagaaguuuaaggguuagcacugagggggaggaagagaggacagcauagcccccaccacaguuuaacauucauauucuaucagagguagauguugaaaauggaucuauucggcagacauuuuugaggucuucuuuaugccaguuaccauguugggcacuugguagagggaaugaaaugguauggcuuguguauauaaggaaguuguuagugucuggguaucuccauauauccuguguuugaccugcauucuuccugggucaggguccuuuucuaggcuccacauguaggaagucuacaguauuuauaccaucaaauggauuacauuuggcugugauuacuuaaacuaaugaccuauauaaaucaguuauuuuccucuucuuaaccugacaaaccaaaguuugucagugucuuaagauuauuuuuaaaauguaauaguacauuaaacuuaguauguguuacuccuauaucauguuauuuugaggcuuuucuguuuuguauuuccuuaauuaacauucagaucuuauaaaaaaguuuuuuucucacuguauuuagcuuugugauuaggaguucuuacuauuuccaugcauauagaagauuuugugaaaacacagucuugauuuagggaaagcuucagccugcaaccuguuugagaaucagugucagguccaucagggcauccaggguagcaggucaagacacuuguauuucauuuucuaauucuuuuucagcgaucuauugggcuuccugauguccauucaggauauggguuugcuauugggaacauggcagccuuugauaugaaugacccugaagcaguaguauccccagguaagaucacuguggacaucugcuguuaaguguguagcauuggccgggcacgguggcucacgucuguaaucccagcacuuugggaggccgaggcggguggaucaugaggucaagagaucaaaaccaucuuggccaacauggugaaaccgugucucuauuaaaaauagaaaaauuagcuggggguggugacgcgcaccuguacucccagcuacuugggaggcugaggcaggagaaucacuugaacccgggaggcggagguugcagugagccgaguucgugccacuguacuccagccuggugacagagcaagaccccaucucaaaaaaaaauguguguagcuucucucuauggaccauagccuuugugaaacagagcacuucucuccaugugcaugacucagucucaucauguucugucauuuuucuuugauauuuacuggaaguauugcuuguggauacugagaggcuauuacaacuucaagcaaagcauauuuuuauugaaaauuuugggaggcuccuaccaaacaucaugguauucagacuuuggcuacaaaacaaacuggcaauuuuuuuuuaucuuuguaaaucaguuaccucguggacagaucacgucuaauaauguuaaugaccacacaguauuaguagcuuagaugaguucagcuguguaaaauauuuagaacagugcuaagcagguagaacauauucaguaauacuaucauuguuauucaaugauaacauugaauauacagaagguugcauacgccuucugcugugguuauggggugcuuucaauaaacauucuauaucagaaguaauaucuuugcuguuaaagagugugaauuuagaaaugaaguuuaaaugacaucuugagaguucuguuucuagcagugguggacuagguuguuucagaccaauccccugcugaaaauaauuagaaaggcuggguaaaaaauuuuuucuuaaaucuguuugaaggcacagaaaaucugcuaaggcaguaagaauuugcgaagucaagaucuagaggaaaagaagaaaaaguuccagauaugugagcccuacauguagggcuguuuggaggugacugcaaauuucagucaguaagaauauacaugauuugaaugauccaauaacaaacuugacacgugaccucuaauauacaugugugguuguguguguguaugugcacuugcauuguaguacagccaagcagugcagaguauacauuuuuuuucaaaugcacacaguuuaccaaaacugaccacaugcugagcgguaaagcaggcaucaaauuucaaagcauugaaaucauauagaccagcaguccucaaacuuuuugcacucgggaccacuuuaguaauaauuauugaggauuaaucucagacucuuaucaauguuuaccuuauuagaaauuaaaacacauuuuuuaaagacaagaauauauaaguacaugucucauccauuagaacaaagauguuaugucauauagcuuuugagaaaucucacuguacagucaugggagaauaugaauaaaauagacaaauaaugucuuaguauuauaaaaugaaucuuacacaccugaaauggucuucccccucacccccaccccagggucucuggaccauacuaaagaacccacucauauaagaggauauuuucugaccacaguggaauuaaauuagaaaugguuuaaauaaaaacuagaccuagcacuuugggaggccaaggcgggcggauggcuugagcucaggaguuugagaacagccaggggcaacaugacaaaaccccgucucuaaaaaaaaaaaaauacaaaaaauuagccgggcaugggggcaugcgccuguagugccaguuacuugggagggccaaggugggaggaucacuugggucuaggaggcagagguugccgugagcugagauugcgccacugcaguccagcaugggcgacagagugagacccugucucaaaaacaaacaaacaaacuagaaaaacuuugggaggccaaagcaggaggaucacaugagaccagaaguuugaaaccagccugcacaacauagggagacccccaucucuacaaaaaguuuuagaauagcuggguaugguggcgcacaucuguaguucuagcuacugggaaggccgaauccagagaaccaccugagcccaggaaguugaggcuacagugagcuaugaucacaccgcugcacucuagucuggcaugaucucaaaaaagaaaauccauauauuuggaaauuaaguaguauacuuuuaaguaacccaugagucaaaaacaaaacuauggaaaugagaaaauaacuaauguaaguagaaaauacuugugucuaaaaauugacauugaguuaaguaaaggacacccuucuaugcuauuggagggaguguaaauuggcacagccauuaugguaaacaguauggagauuccucaaaaaaucgaaaauagaacuaccauaugauccagcaauugcaucacuggguguauauccaaaggaaaugaaaucaguauccaaagagauaccugcccucccauguucauuguagcauuguucacaguagccaagauacggaaacagccugaaugcauuauucaaccuuaauaaagaaagaaaucaaucuuuuaaaauugaagggaaaagacagggaauccugccauuuacuacagcauggaugaaacuagaggauaugcugagaaauaggccagacacagaaacgaaaauacuacaugauuuugcccauaugugcaaucuaaaaauguuaaacucacagagagaguagaauggugcuaacaggguggauguuagaguauacagaauuucaguuuuaagaugaaugaguucuggaaaucuaauguauaacauagugacuguaguuaauaauaauguauuguauuguauuacuuuuaauggcaaaaagcacaauuacuuuugcaccagccuaauaccuauagucccaggcaauucagaggcugaggugggaggauagcuugagcccaggacuuggaggcuucagugagcuaugaccuagccugggcaacaaagcaagacccugucucuaaaauaaaauauuguguacuugacauuuucuaagaaaauaaaucuuaaauguucucaccagaaaaacagaaggggaaguaacugugagaucauaaauagguuaauuagcuugauugugauaauuacuucacaauguaaauguacauuguguacaccuaaauauauacagguuuuuuuuucuuuuuuuuuugagacggagucucgcucuguugcccgggcuggagugcacuggugcaaucuuggcucacugcaagcuccgccuucuggguucacgccauucuccugccucagccuccugaguggcugggacuacaggcacccgccaccauaccccgcuaauuuuuuuguauuuuuaguagagacgggguuucacugcguuagccaggauguucucgaucuccugaccucaugauccgcccgccucggccucccaaagugcugggauuacaggcacgagccccugcacccugccaauauauacaguuuuuauuugccauuuauuugccggucaucucucaagcugaggagaaaaugauuuaaaaaauacuuauaggcuggaugcgguggcucauaccuauaauuccagcaucuugggaggccgaggcaggaggaucacuugagcccaggaguuugagacuggccuaggaaacauggugaaaccccaucccuacgcauaauacaaaaguuaaucaggccugguggcacacaccuguagucccagcuacucaggagacugaggugagaggauugcuggagccgggaagucgaggcugcugugagcuaugauuacuccacugcacuucagccugggugagagaacaagaaccugucucaaaaaaacaaaagucagccaggugugguggcucacgccuguaaucccagcacuuuaggaggcugagguggguggaucaugagaucaggaguucaagaccauccuggccaacauggugaaaccccgucucuacuaaaaauaaaagaaauuagcugggugugguggcgcacgccuguaaucucagcuauucgggaggcugaggcaggagaaucacuugaaugcaggaggcggagguugcagugagccgagaucaccccacuguacuccagccugggcgacagagugagacuccgucucaaaaaugaaaaauaaaaguacuuaugucuaaaauuuugaggucacuguuaauguccuuuuugaauggaaacaugcagccuuaaaugcacaaauugggaaagaagaaaggcuggaauaucagugacccuagaaagcacaacaaauuauacccuaaaaaaguagaaagauggaauaauuaggaguaaaauuagugaaauggaaagauauguuauagaaaggaccaagaaacgcaaaaguugguuauuugaaaagacugaaaaaauucaugaaccugugaaaacaguggucaagaagaaaagagaggcauauuuugaucucuguuuuacauguuacucaauguucauugcugccucccuuguccauaaagugccuuuaguguguauguuacuuuagauuaucuuggugucaucaagcuuuacucagcaaagaaccacuuuguugucuacuuuaaaacauaguuaucuuuaaaagaauggguaucuuuauaguuccauauuaauggcgagaaacugcagguaacagugccuuaccagcugguuuugcuaacuuuucucuauuuuguagguggugucggguuugacaucaacugugguguccgcuugcuaagaaccaauuuagaugaaagugauguccagccugugaaggagcaacuugcccaagcuauguuugaccacauuccuguugggguggggucaaaaggugucaucccaaugaaugccaaguaagagcacacguuuccaguacaugguaugggagggauaauaaccacaugaccuucagcuuccuuuccagugcaguacacuugagagaugaggauuguucaguuacuuuucaggaaguaguaagaacuguuuuuuuaagcaugagguacagcccauuuauuggagacauuagucaaccgauguuauaacagccuuugacauagaguaguauuuauaauaacaucauauccaccaacguuuauugagcacuuucuauguguaaggugcugagcaucauaucauuucauccagacaauaacccuauuaucuucccuaacuuacaagaaagaaaacugagguuuagagagguaauaagcuuagugccaggugugguuggguuuacagaaucccaacacuuugggaggccaaggcaggaggaucacuugaguccaggaguaaaagaugaaccuaggcaacauagaucucgucucuaaaaaaaaaaaauuaacuaggcaugauggcuugugacuguagucccaccuacucaggaggcugaagcagaaggaucccuugagagaccaggaguucaaggcggcagugugcugagaucucaguacugcaccccagcgugggcaacagagugacccugucucaauuaaaaaaaaaaaaaaaaaaacuuaguaggugauaucaggauucaaaccaaagauccuuugacuucagaagcuguauucugaauccuacugccuuuugucauuaagccuauuuaaccccaaccuuccucuuugaaugauagcacuggauguguucuuugguaaguagaggauuaaauauaaugcuauaguguaucucucagauggccauagauuuuaccgugucauagcuuaugcaaagcagugcacccuaaacuuugcagaguacuucaguagcagaauagugugcuagcuauguuucuuuaauauuuugcuuuauccuucaaauuuaugugaacuuugcauuauaauuaauagaaaaaaauguuuuuagcuguuacuuguaauguuauuuaacucccccuaaccaaaaaaaauaccuaaguaaaaucaauauacuuggaugaugcguggucugugauuucacaugaucccugacaugcagccccaauuugaaaagcauacguggaacacacaaauuccaaacaucuuuauaaacauuuuagauaggaauuuugucuacuaauacugaaaugggucuacucugggcacacugccuauggggugacccugcucugcaaggagcaguaaaaaauaauaacaaaaugaaauaaugauagugaaaugggcugucaucugggguaguggggagagaacauugaaaaguguaguuuuuccuggcaguguuuuagaagagagcuggaccuuggaugaagauuaaagcuuguacccucuaaggguuuaauguacguguaccucagcuucaaaauggaggugccguaagccacucagaacuucugugaagaugggaaaacagcuuaaaauuuaaccuguguugccugaggaauucuagauaccuucauuuauuugaccguaauucauaaaugauuaagguguguaccugguugaauuagucguuagagagugauagcugauuaagguuacagaguuguuguuguuguuuuuuguuuuguuuuguuuuugucuguuuaaucacuaccucauggaauucaggaucagagaggcaaaacugaauauaaaaaagauuugaaaauuaacaaggagcaguauaaaugucaaguagaacuauaaugaugucuaauagggcauuuaucauuuuauauuggaauuauuuauaugacugcauuccucaaaaaaccaguuacugagagcuuaaacuuuguaucugacucaaggcuuggaacacaggagauaguaaaugucgaguuuuucucugcccuuuaaggauguggucauccuuagguuuugaucugccuuugcugugagaugacuagcaccuuuuauacuuauccagagacuuggaggaggccuuggagauggggguggacugguccuuaagagaaggguaugccugggcugaagacaaggagcacugcgaggaguacggaaggaugcugcaggcugaccccaauaaaguuucugcaagggcgaagaaaagaggccuuccucagguaacucacuuuggaggggcaacauguuaauuuuuuuuucauauuuuguuuuuauugggggaaaaaaaucuauaucuuacauuuagcaaacauauucccagguuuuuuuaugguauaucaaaaaauacaaauuuguuuaugcuucauuuuuauucuaaaaaaacuaucagggcuggaugcgguggcucacaccagcuuugagaggccaaggaggaagguucgcuugaggccaggaguucgagaccagccugggcaacauaagaagacuuagucucuacaaaaauuaaaaaaaaaaaaaauuagccaggcaugguggcacaugcaaguaaucccagcuacucagaaggcuaagacaggaggacugcuugagccuaggaguuugaggcugcagugagcugugaucacgccagugcacuccagccugggugacagagcaaucaggagcuugcaaauguucauaaaauaagaaauaaugaauuagaagugaaugggagaaaaauagaauauguuuaucagguucauacgucaaaauuacauauauacauauuuugacagucuacagaugguauccaugagauaagaauauacuagauguuugaaauuacagcuaguugugaaggcuuugccacuaauucagugugacacgugggcaagacugucuucucuggaucucauuuucuuauggaaaacugggaugguuaaaacuaggcaaccucuaaagacucuuccagcacugacauucucuaguucucuaaaucaucuauuaauauuagcuguaguugugguauauguucuuucaguuauaaauaaugguggauguccaugaacucauagauguuucaaaaucauuugaacuuggaccuugucuaagagucaacauuuaccaacauuuaucccaaaauuugacucuuugugauguuuaaaauaucccaugaaccauuuaaaagcuugauuuuuuuuguuuaugaagcuuuuuuuaaaaaauuaauuuauuuacuuuaaguucugggauacaugugcugguuugugacauagguauacauuugccauggugguuugcugcaccugucaguccaucaucuagguuuuaagccccacgugcauuagguauuuguccuaaugcucucccuccccuuuccucccacuccucgacaggcucugguaugugauguuccccucccuguguccauguguucucauuguucagcucccacuuaugagugagaacccgugguguuugguuuucuguuccuguguuaguuuuuuauauguguauaccaagcauauaaugauauaacaaaauucaggagcuagucuacguuauuuuguuguguagaauauuguaaaugaaacacuucuauagcuuaggaauuuuuuuguuacugaaacacuauuuguauguuuauuuuguuguuaguuuguuuuuaucuuuuugguuuuuaaauagauuaaaaaaaaaacuggaauaaaaacuaucuuaccagacauuuuuacauuugcaguuggggacccugggagcaggcaaccauuaugcagaaauccagguuguggaugagauuuucaaugaguaugcugcuaaaaaaaugggcaucgaccauaagggacaggugugugugaugauccacaguggaagcagaggcuugggccaccaaguagccacagguauauucuagacuuugugcuaaaauguacauuuuaugggcaaccagauagaaauuuaagagcgaaaacucugaaauauacugcauggguuuuauccugaguccucaacaauuaaauaacuuggacaaauucacugggccauaacuuucuugucuaaaaaaaugaguauaauaguuauuucauauagaauuaucauggaaaguuaauaauauauguaaagcacuuaauguuugacauuaguaaacacucaauaaauguuaguugcaguuauuguuauguuuacucuuaugaguuacuaucuggccaagaaagagcaagaaauguguaaagaguggaauuuaugaaauaggcuuucauuuggcagauuauguaucauauaccugcucugcaacaguagaugugaugguggauuugcugaugaaagaggcagauacuuugcacucaaauugucucaugaaguaaaggucauguccauuuaaaagaaaaaauaaauauuaaaagguagcaauuaauuauauaggagagucaaacaaaacacauuuaagaaaaagauuuuggagauggcuucauggacccaguguugagcuggaucucacaguuuggacaauuacacacaaagacuggugacaaaggcagcaugaacaaaagcaggaagcagcgaaauauuggauagguccuuuuggauagcuuggagggugugugaaauaauguaugaauugugacgguuacuacaggacugaaugaagcgggaugaacgcagaaaugaaaacaaaaaacaaaagaaacuuuuaaagaaggagucaggggcuucuugcuucuagugagcuuccacagcccuuuguauuuauuggguagaaagagcagggaggaggagguaacuauuggucagcugcuugauugaucccagguucauauuauugcuaacaggcuucacaugugccugucacaagaaacacuugugccuggggcguggcugcccucagcauuccuucugggcaacagacgcaguugucagcuugccagcaucuugcauucauaagaacaguuugcuguuuacucauagccuccagugguauacugaguuguucacgacccucauucuuucggccuccaacagcgaaucaaugaaaagguauauagaugccuggaaauuguuauaagcuuaaaauuccauguuacagaucagccucuaguccauuuuauugugugagaauuuaauaauuugugccagccugacccucuagacuauuuaaccuagcagauguacgaagugucaacuaguguuucagaacauuccccugaguacuucucugcauuuugucauggauuugauuaaucaugaaggcaacaaaauguauuuugcuacuacuauucccaugcauucacauauugagaaaggaguaaugaagaccaucuuguggcuauuuguuuacacaucccauucucuuucaaguuccuagagggcaaauguugacuuugugucccacaaacugucacugcacucugaaagauucucaaguacgucuugacugagcaaauagaugaacucagaaacacauuaaagggaaaguuggcuuucauuggguuuuuuuguggaaugaauuugaauguagccuaccuuucugcaguaaaucugaacuguucauuuaagggaaagcuaacugguuuggacuuuguggcucuuguuccagaugcgcugguagcuauggagaaggccaugaagagagacaagauuauagucaaugaucggcaguuggcuugugcucgaaucgcuuccccagagggucaagacuaucugaagggaauggcagcugcugggaacuaugccugggucaaccgcucuuccaugaccuucuuaacccgucagguacaguagaaguugcucuucuguuccgagucauucaugaugauguuaagugcuuuaaaacauagugcaguccaggcuggacacgguggcucaugccuguaaucccaacacuuugggaggccgagggggggcggaucacaagguuaggagauccagaccauccuggcuaacacggugaaaccccgucucuacuaaaaauacaaaaaauuagcuuagcuggucgucguggcgggugcauguagucccagcuacucgggaggcugaggcagcagaauggugugaaccuggaaaguggagcuugcagugagccgagaucgugccacugcacuccagccugggugacagagugagacuccugucuccaaaagaaaaaaacaucgugcaguccagucaaagccuaugguguuugguuuuggaaauucacauaguuaacuuucaaaauaccagagaaguguccaagguuuugguguugucuuaaacuaaaucaucagaguaucaggcaugagaaaugagagcagagaaucaaaauuauuccuagaauuugucuugaacagcauagagaauaaaagugccacugacuaagauucagaaggcugagaagaagcaauuuugaaaggugggaucaaaaguugcccagcagcuuuucaacuaaagaugaaaaugaugugguggcauuuccuguguggucuaaaggacagcuuuuguccuuuacgugaagauaaucuuacggcuacuuuugaacuuuuaaaucuuuuacucccuucagaacagacuaccugaaaccagugagaugagucacgaagagcugaacauaaguccugaaguucuggcugcuuuuaucuucuguguuuucuccuaggcuuucgccaaggucuucaacacaaccccugaugacuuggaccuacaugugaucuaugauguuucucacaacauugccaaaguggagcagcaugugguggacggaaaggaacggacacuguuaguacacaggaagggauccacccgcgcuuucccuccucaccauccccucauugcuguugauuaccaaguacguagcucuacguuuguaguuuuaagcagugggggcacgauuuagauuguugcaaaugugaauuacauuuaaaacgaaaagcagcaauugugaaaagaaaauacucugucacucaugagaacagugauucccaaucuucucugaagcaguaacuccuucccccaucauuugugcuugcgguggugccgugugcuauagcaagugcugcaggaaguguauuuuacuccacuaccgugaauugaggccuuugaauuaguggaagacaggaguaacucaguuacagaagacagaguaaacucagucuguuucauuccuccuguccucuuggugucuggcugugguggaguucgaaagaccccauagucugcuugcuccuuuuacagaugagaaacccaaaacagagaagacaagcaccuugcucaggauggugguucuagcaacacuucucuacacuuuuggauuuugcuuugcucuuauuuugacucuucugcauuuuuacugguccucagauuuucacucucguccucuuccuuccccuccgauuuaucaaagaaucaaaguacuaucuuaauauaguuuacuagccgcgcguuuagaagucuggguuucuccggccgggugugguggcuuacgccuguaaucccagcacuuucggaggccaaggcgggcaaaucacgaguucgggagaucgagaccauccuggcuaacauggugaaacuccgccucuacuaaaaauacaaaaaauuagcugggcauggcagcaggcgccuguggucccagcaacucgggaggcugaggcaagagaauggcgugaacccaggaggcggagcuugcagugagccgagaucccgccacugcacuccagccugggcgacagagcaagacucccaucucaaaaaaaaaaaaaagaagucuggguuucuccuacaauccuacagugcaagagaaaauuuaaauuuuaugcauaaaaagccuauguuuuucugaauuuuaacauguuugauuuaugugcauccucagcucacuggacagccagugcucauugguggcaccaugggaaccuguaguuauguucuuacuggcacugaacagggcaugacugagaccuuuggaacaaccugucauggagcgguaaggaaaacagaaacuuccuuagaaaugcucucuucaguuuagcuaugguuuuccauuuugacugguaaauguagcugauugaacauuaacagaguugagacuugggccuaucaugucuuguacuucaaauuguuccccauaauguauacuauuuagugaacugacuggggucaccuaguaucucugccucagugagaucugguaggguuagggaccguuucuuaucucugcaaguccagaaaauccagacugggaaauugucacacuagcugagcuuacugucugguuuauaagugauagaacuuuaacugaugcaaauaucacaguugaucucagcgacugacuggaccugcuccuuuguuuaauuugccccuuccuauuguguagguccacgcaagauuggaaggauaggcccuauuugcaaauuagagcccauguacagucuacacacacacccauuucaaaacacugccucucaucuucuaagcccaggggucaggaaacucuucccauaaagggccagaccguaaauauuuuaggcuuuugggaccagauggucuguguaccagcuauucagcuaugccauuucagugcagaagcaaccuuaaguacuguguaaaugggcaaugcuguguucuaauagaacuauuuuaggccaggcaugguugcucacacuuguaauuacagcacuuugggaggccagggcaggaggagcacuugaagccgggaauucaagacuagacugggcaacauuagcaagacaccgucuccacaaaaacuuuuuaaauuagccgggugugguggcacaccuguagucauagcuacucaggaggcuaaggcaggaggauugcuugagcccaggagauuaaggcugcagugagcuaugauuaugucacuucacuccagucugggugacagagggagacccuuucucaaaaaacaaaauaguuuauuuuaaaaagcagguggugggccauauuuggcccauacaccguaguuugccggccccuuuucuaagccauccagaguguugagccaguguugaaaugggaaagagaaacugucuagaguaccuucuccuaggacagaccuucacaaauguauuuaauccuacuuuuuuuucugauuguuucucauuucuagcugccucccaacuccuaauuuuaacccaguaguuuucaacaaaggagaucccccuaccgccauggggacauugacaauuucuggaggcuuuuuuuauugucaugguuuagugggaguugcuauuggcauuuagugggucuuagaggcgagggaugcugcugaauacacugcgcugcgcugcugaauacccugcauaggacagccucccaacaaagaauucuccgguccaaaaucuaaaaggauaugaugagguuuaaaaggccuguuaccaauucgauaaaguaaaaaagauguuuuuuuaagcuccuuuuuagugugagagaaaaucagggaaagggcuuaucaucuuaggguuuaaaguaaaguucauuccuuucccauucuagggccgugcauugucccgagcaaaaucucgacguaauuuagauuuccaggaugucuuagacaaauuggcagauaugggaauugcgauccguguugccucacccaaacugguuauggaagagguaagugaaauuuugauaaauacaugaauauuuauuguuccccauuuguaauuuguuccagucuacagagacagcaauuuaggguguuacuaacagaaauuguuuggguuauuuuuuuuuaugaccucaauuuuggcuuaucuuccuuggauuagcuuauuucaguuuuauguuuucauuucuuuugguuaaaauuacgagccaaguccuuaagaaugauuuuuacuguucauuuauagucuccaucuacauauuaagcuuuucaagaguaguuugagcugacucuuguuuuugcacaauuguauacuuagguuucaauuugaaagcaaauuugaaaaaggaaggcauaaauguuuggagaaaguuuuauuugauucacaggagaacagauuuuguuuaaauucuguauauauguuuacauauauguacauauuuaaauuaaaagcaauauaauuccuuaaugauuuaagagaaaagaaaaacagucauccaaaaacucaaugcccugacacaguuauuaccuuaucuuuuagaauacuuauuauugucggccgggcgugguggcucacgccuguaaucacagcauuuugggaggccgaggugggcagaucacaugaggucaggaguuugagaccagccugaucaacauggugaaaccccuacuaaaaauacaaaaauuagcugggcauggugguggacacccauaaucgcagcuacucaggaggccgagacaggaaaaucacuugaauccgggaggcagagguugcagugagccaagaucaugccacugcacuccagccuagaugacaaaguaagacuccgucucaaaaaaaaaaaaaaaaaauuuacuuauugucauaguuuuuuccuaaaugcuuuuuuuaaagcuagucuuaauuauaguuaagaaacauucuguaguuauuuuuaaaauuuugcacauuauuauaaaauuguuugugucacuuuuuaaaaucauugcugaauauuccaccagcugaguaccuuacuuucugccuguaguggacauuuaaguagcuuccaaauuuuugcuacuauaaauuaaauuguaaugagugucuucaugcaugaagguuuuuuccaguuguuauaguaauuagaacaaagucucaaaaguggaguuacaugguggcucaugccuauaaucccaguacuuugggaggccaaugcaggaagaucucuugaggccaggaguucaagauuaguuuggccaaagauuagccagguguaguccuagcaacucaggagacugaagcuggaggauugcuugagcccaggaccuugagguuacaguaagcuaugugauuguccagacuuggugcaaagcaagacccuaucucuaaaaaaaaauaaggaaaaaaaguggaauuacugagucagaguaugacaaagacuuauuuuuuuuaauaacaauucauuuuuccccugaucuuaagaauacaugguuaauuuaaaagauuuggaauauacuggccaggugcaguggcucaggccuguaaucccagcauuuugggaggcugaggcggguggaucacaaggugaggagaucaagaccauccuggcuaacacggugaaaccccaucucuacuaaaaauacaaaaaauuagccgggcgugguggcgggcgccuguagcucuagcuacucgggaggcugaggcaggagaacggcgugaacgcgggaggcggagcuugcagugagccgagaucgcgcuacugcacuccagccugggcgacagagcaacacuccaucucaaaaaaaaaaaaaggauuuggaaaauacaaaggagaaaacagaaaacauuuagaauucaaucagccagaaauaauuacaguuaaaauuuggauuuuugguuuuuugguuuuguuuuguuuuuucaccugcaacacgugauuauuugauucacuuacucagcuaacacguacuaaccauccgcuauaguuagguacuguucuauaugcuagagauacugcagugaacaaaagaaacacgagucccuucguuguggagcuuuccaaauaauaaaacauacaguguguuaaugaccaugcaaguucuaugaaauaaaaagcagggaaaggugguaaggaaaggugggaagggguacaguuuuaagcagguggucggagaagacuucagugaggugacaguagagcaaagaccugaagagagagaggaaacaggcuaccugggcaucuggaggugagcuuucgaggcagagagaacagcaagcgcaaaaucugugagcugagguuaugaaggaguguucaagaaacagcaaggaggccaggcaugacaagagcaagccagagggagaugaggucagagagguagggggcgccagagcauuuggacuuuugcuuuuacucugauuaaaaugaaaaaaccuuggaggauuuugagcagaauagugacgugaucugacaaauguguuugcauguugaugagaagaaucuacaagagaaauuaaugaugcagaaaagagggaggaaauugcuggagaaguguccuugaauagaugagaggagauagagucugauguacaaguggaugggguuggucuuugcuaggagcacagauaauucauccuuuauaaaaggagagaagaagcugagcacaguggcucacaccuguaaucccagcacuuucgggaggcugaggugagaguaucgcuuaaagccaggaguuugagaccagccugagcuacaaagcaagaccccaucucuacaaaaauaaaaaaaauuaggcacaguggcacaugccuguagucucagugagcuaugauugugccacuggacucaaccuugggugacagaguaaaaaaauaaaaggagagaagguauagauacagauauguggggaagauaaaguuagcauguuuaugaauauucuggcugcuucuauuuuuuucaguguauuacauaguaaggucagcaagugagagugggaucugagaaaagguaugaaauauucaucuaggggagagacagucauuggcccaguggaauuucaucugauugccaggagcuagaaaucgccaaguaguacuggggagugauucaggcucccacagauaacuacagccaaagguaguuugugguacgauguaaugacugcaagauucaaaacuaggagugccuagggagaacgggagaauagaaacaaccaugaaagccaggagcacaccugucccacuucugggaccaauggcaugaccugauuuggggaaaacagcagucaccauucagaaaguuggagaugaaagugguauccucgggaaagauccguguuucaguaaaacaagaaggugaagggaacauucaaagaagaagggagggaggggauuuugcuccuucuggaaggaguuccagaggccacagugggaaaguuucagaaacuggaagggaaugggagaugggauagaaaaggauauuauguacagaaccguacgggaaucagcauggauggccuaagcuuguauugacaggaaugaagauaaagugagugugugaugagauuagugcuaaugguggcaaggcuguguggguaggauggaauggugggaauguugcuggaaagucacagaaauugucugugaguguagguacacauagauacccacauauacaugugcacacaguuuuacuuuguuuuauacauauaugaauuuuauaacuuacugugaagguacuacauguucauuccagaaauuuugauaacugcagaaauauauaaaggaagaaaauuaaaauugccaguaauucuaccaucaagagauaauuaucacuaacauaugaugguugggugccguuucuuccaaucagguucugguguguguuuuauuuacuuacauuuacuacauuuccuaguuauacaaguaauacauguucuuuaaagacauuuugaaaaauacagaaaaaaaaaaaggugaaaguguuuuggaaaucagcacugaccaacaucaggcuuacuucuuuuuuaaauuuuugcuaauuucauaggcaaaaaaaaacucucuguauuauuuuagugugcauuuauuucaucacaagugaaguuuggugcuuguaaagacuguguuuucaguggacuuguacaauguuuaaauuccucuccugcaggcuccugaguccuauaagaaugugacagaugugguaaauaccugccaugaugcuggaaucagcaagaaagccauuaaacugagaccaauugcugugaucaaaggauagaaccuuggacagcagggcugccugacaccaccaacccucucugaaguggaaguggacugacaugcucuucugacaucagacucaaggcgggacaaguugcaaagugugcagcuguaacugcucacgccaaaauggcugauggggaggcugcugcuuucaggggcccgugcuuguaaaauaaccuuccaggaagaggcacauugcccaccuuuggaaagggaggaauaugccuucuccuugguuguuccacagaguuuuaggaaaaucuguuagggauggguagaugucaaacugccuuacgcagucauacugaucuuuagccaucagauugaucuucuucacaccaagcucuguuuacauuccgagaggugucaugaagaaaguucuguucaauaagguuuuggaauguuuccuuucgucugu

SEQ ID NO: 16346 - RNA, 3099 nt, Homo sapiens
uuauugagaaacuacuaugugccaggcaucaaagugcuuuacauucaauaucucauuuaauccucccaccauccuaugagguagguacuguuaagauuuuccgcuuuacagaugaagacauugagguccagagagggugaguaacuugcccaaaguaauacagcaacaagcggugauguauuauuugaacccagcaugaucagacuccagcaccuccacucuaaagccugcauugcccaagccagagcccuuuuaugucaccaaaggcagggaacaaauagucuaugaggugaggaauuugccuuuggcucuuagauugacuuccuauaaaaacaagacagagagugaagagccaggaucuguggguuuacuaggcgccggagggaugcugaaggggaagauaguggcugcccuagacagauaaaggucuuguggcaauuccuggacugggggccucauugcucaaugcagggguauuggcaguaugugagugggccugcgcccauaucaccaggcaggguguggagcccuggguguuccagcauacacugccaggagggguuggugaaucucccaggacauugcaggcagcagcuuaauguuaggaaaagagacuugaacuggcaaccuggaccugggcuucugcuguccacugggcagugugcuauggcggugagagcucuugccugggcguuuagaaucccagcucugauauuuacuuguaugggaucuugggcaaauuacuuccucuucagggucucaguggcugauccacaaacaagacauguuugugaguggugcaguguuugauaaauccuaaacuaaugggaaguagcccuugaccuuggccgagacaccuucccuuuggggccuucgaucuuucaucugugaacuaaugggagaugggccagagaaucuccaaaguuccuuccugcccuaagguuugaugacugagaaucugcagcuuggugcuuaaagguuuggggcaggaagcuaggggcagagcaaaggcccuguaggcauucaacagcuguuuggcaaucauccuccuuagccuuucccuuccuauuuacuucucagccuggcucaagguuugauuguauuacugguagaagaauuaaccccaaacccagggaaaucgccacuucacuguguuuucuuacugucauuuucuauuaacgugacgcauacaggguuugcaagacccggggaccgccguggaugucuuuggcuucuaauuccauuaguucaucggguaguuauggauaauaacacaaagccugucauuuggccagcacuugagaauuuauauaguggucaagcguguucauuccgaagccacaacccauggguucucacccggcuccuucacauacaggcucaugacguuaggcaaauuacuucuccacucugaaccuugguuuccucauuuaccaaaugggaggaauaaccgcacauugccucauagggcugcuguaaagaugaagggauuugacgucauguacggcacuuagcaccagacucauagucauaacuaaaucaucaguuauuauuuuuacgaaauacuucauauucauuuucugacuugucacacccaucaccuccaucagacugcuuugauuuuauuauccugauuuuugagcggagcaaacagacuccgaggaacagugacuugucccgggucacacaguuaaguggcagagccccugggguucuaaccugggguuccugaaaccuaggauaggccauguuccacugucucccccugcccuucccccaggaccaaauuucucuguggaauaauaagguaauauuggaugaaguacccccaaaacaagguugguccuacgugcguaggcauuaagaaaagaggggaauccuaguuguugggaaggccuuugggccucaggugguacgccgaggacagcagauuuugaccuccgaggcagagggagcaaggaaaggaaaaauaaucuuuuuuuaaauuuugagacagagucuugcuuugucaccuaggcuggagugcagugaugugaucacagcucccugcagccucgaccucccagguccaagcaagccuccuaccucagccucccaaaguagcugggaccacaggugcguuuuucucaaucucauuuuuuuuuucuuuuuuuuguagagaaggauuuuugccauguugcccaggcuggucuugaacuccugggcucaagcaauccaucuaccucggccucccaaagugcuaggauuacaggugugagccacccaaccuggcacaaaaaaaggcauccuaggagggagcuggcaccggcaaagacuugguuuuagaaauggacagccuacuuagaggaccaucaagggacugccacugggacagagggcucuuggagggaaguuguaagagauaaaaauggaagcaauacuugcuaacauuuacugaaugcuuacaagguacugcucugaucacuuuauauguauacguaauaacuuacuaaagucucauaacuguuuuuccagguaggaaccaauauuaucccuguuguauagauaaggaaacuggaggcacagagagguuuaaguaacucaucuguggcuacaaagcugauaaacagccgagccacuauucaaacucagcaggcagucuggcaccagaaucuauguuccgaaccacuagacgauagcaucugacucaauagaagcaugaucacccaaaucaguucaggauucuuggcaucuucugcuacuugcuguggcacugaauucaaauauauguuccuguauucacagaggcaacguagagauagugcauaugggaaugagggguugacggcauccgugaaaaggauucucaguuaagaucuaaaaugcauaucugaccagggcacucuaacucaaaaucacuagacagcucggcaccaccuccagaaauacaagugucugugguucccucccugcgagggguuucauggcuuccuuguuuuuuguucacgcuguuccccuuuuguccucuuccucaucuaacuauuacuucucuuucaggacugcccuccagcaucaccucugccccaggaaucccuucuugguuuccccaggcuggcuucc

SEQ ID NO: 16347 - RNA, 61524 nt, Homo sapiens
aaggaucugaacgauccgggggcggccccgccccguuaccccuugcccccggccccgcccccuuuuuggagggccgaugagguaaugcggcucugccauuggucugagggggcgggccccaacagcccgaggcgggguccccgggggcccagcgcuauaucacucggccgcccaggcagcggcgcagagcgggcagcaggcaggcggcgggcgcucagacggcuucuccuccuccucuugcuccuccagcuccugcuccuucgccgggaggccgcccgccgaguccugcgccagcgccgaggcagccucgcugcgccccaucccgucccgccgggcacucggagggcagcgcgccggaggccaagguugccccgcacggcccggcgggcgagcgagcucgggcugcagcagccccgccggcggcgcgcacggcaacuuuggagaggcgagcagcagccccggcagcggcggcagcagcggcaaugaccccuuggcucgggcucaucgugcuccugggcagcuggagccugggggacuggggcgccgaggcgugcacaugcucgcccagccacccccaggacgccuucugcaacuccgacaucgguaagcgcuccuggugccccgcccgagccccacgcugcagccaggacugcagcgcugcuuagggaggcagggcgagccccacuccuuuccucugccccaggagaggggcagacgggguuggggcggaguggagaaacucgauguccuugggcgggggcgcuggcauagcugagaggggaagaugcccugcagaggaaacucacaguggcugagggagccccuggccgccuuugcuuuccuaacuuaggucgugagguuccuaccgguccuuuugacaucuggaaaauguccccauucacuacuaacggaggaagggcuagaagagaaggguggggaaaggguucccaaaacuuggaaugcuaacuaaagugcugggaaauugaauaguuaaaaaaaaaaaaaaaaguugcccgccaugugcacggaaaguugcaggagaaacuuggaguacuccgagucugcaucaucuccugcgccuaugaaauucauucuuuucacugagacccaacccagcugcaggcuucccaggcaagcgcuaaccgagcuucugggacugccaaguuuggguggauuuaagggggaaaaugaggagaaagcuguggcauugacccacgcccuggaggcacuguguuugagaguguugauagccagcagaaggugcgaggggucacucaccacauagcugugaaaauucacaggaaggcuauuuuuuucccccuugaauguguguggggagggggagaauggguaguggaaaacagauuugucaccaaaagaacaaaccugccaagggucacaucacggugacaguuccagacuggacuuagugucuugaguagagagacccuguaaagagaccuccuacuccuuaguguguauggagggccccgagagcauccugggaggcuugucugggaguguuugggacacuuguguuuggauggcuaaagguggaguggcaucugggaaacaucucucuccuccuuuccagcccauaaagcgugcaaguccaguggcucugcugggagagugugugugugugcacugggcugggcugggcgguggggugggacagccuugccgcccucugccugugucgauucagaggugaagaauggagcguguguguuuuaaguacagucauaaaggagaaggaaauuuuccacugagucuugggugagggacucuaccagcguguuguggugaggagggggaggagguaggagcuuggcaggggaggcagugagggccgggaggggcacugcuggugggcugggcugagccuagaggucagaguggggguguggugaccagaaugucagugcaguuggcagcugaggguguuugugugaccugaggucacccuuguaagaggcucccuggggccugcaugguacauccuccccucuccugggggaacccagcuggcccaggauuuguggauugcuuagaaagauccuuuugggcagccugaagacuggggaggguuuuccucccuccuccaccuccacccacauuccacuuacccuuucccuccucaucccaguugguaacauucccaccugauuaguguggggaguugcugcugcagcugaguucugguuuugcccagcaggaucacacacgugcggccaggaggcuggcagguggaaucagggugugcaggggugcagcccaaguccuuuucugcuggaaaaugggcugggugacuucacuugcguuuuuuugguauguagugggaguagguccccauucuucccccuugcccuuugcuuugggguuucuacccuaaaaauugaccacggaaaagugaaaacaagcaugaguagauccugcuuccaaugggggccuucccgucugcuuacugcuuagguuuccugcggugggucugagcaaugcagaaaguuucuuacaauuucucuggauugaaacaagaaauagcucccucgcuccucuucauaaauuucucagagaaaaucuaaguuaccaggaaguagccaaagaccaggagauuguggaaucaaaaagaaaaaaagaaacaaaaaaucuucgaugcucuggcacggaucccaaauuguucugccuggguuuggugagcugcacuaguggcagggaugagcuaaugcuuuuaaaaugggaggugugggugugagcugcuugccugccgaccucccucgccuugcacagcacccugcuggcguccaguacuuggcucccaaguuucauugcucagagccuuucugguuuccagucuggguugaaacugucuauucucgcccucaaacaaauaugaaggagcuccccauuccuugggacccacacaaccccaccagucaacuuuguagcccccuaaagguguucacaucagcccaucaacuuccuguuuuaaaaccaucauggugguuuucucuucauggcuuggugccauguuggccuagcaaaaggcacaggaggccuggccugguccucuccggggggcugcccgauggccuuuccuccugucucugcucauccacaggugucucuuuuugucuuuuuuccccaaaguccuagggccuggcauggcauucugggggaggaggaguuaaaagguguuucuauggcaacuccaggcccugcacccuauggaaguguuuaggagaagaauaaacuacaugccggcuuauaagacacacugugggggaaagaaagggacuuggcagcaggcaggaugucuguggucccccucccuggccagucauugccccugaaacuccugacaaaaccuugacucuagaagaggaaugggagggggcuggagaugaagaaggcggccucggcccgggcaaaucugcccuggcagcucuguccagcucaggaaggggugggcugugccaagggcuuucugaaaaugugcgugugugcgugugugugugugugcgcguguguggcuucugcaaagguggcuggcagggcugagggggguugcagcagagaaagagaauuuugcuucagaaugccaagcccuucucuccuucucucuugccgccuuugcaugggaggaauggggcuguaggaugaaguguguucggggccugccucugagccuguugggaauuugagcaugaggcucagcuggggggccggcugccagccccagaggauggccccuggauagcuccaaauuguucugacaggggccagugccagcagauucuuucaguaucagaucugagguugucguuuuagcaaagaagccauuuucaaagaaaccagauccauccccucucccucuuacacacaauuacaccucaacacugggcuuugcaacuuaaggaaaauagaaagaaucagacuuuggagaggcgccagcacuugguagggcaagucugggggacccaggcuguggaugucuuggaaccauggaaggaggagagcugcuauccagcuggaggagggaagagacaugucuuaggccccuccugguugcacgcacuucccaaaugccaucucuuucacccccucccccgaccccccacagcaaccuuaagaguagguauugcacccauuuuucagauggaaaacacugaggcugaagagacugugcuuguccaaggccacccaguugcuaaaugauaaagcuaaaacguauuaucaguuauaccaugcuucaaaaaccuuucaacuuucauugacacaugacauucuaaggugaccaggagauggaauggaugguuaacauuugaagaaugcuuuucuucuacaucuggguuuucuuuaaaaauaugaagauagccaaaauggccagagguuuuaauuaaacaucaucuuuagggagggagagcuuauuauuauucuaguguaucauagaggaaaauucuaauguucuuuggcuauuagaucuggaaaagacccuugaaaccaucaagccacaguaauaaaaggacuugguuugucucacuguggcccaaggagaaguaagguuaauagagacaagacauuucagggcuucaagacucuucccuuaaaggugggaucaguuagggcuccccagugggagguacccggucugccagugugguaggaggaaagccagggggagucaggagacugggucccagcuggagaaggugccccucugacaguucugugucccuuucacagucccuggauagauaaggcuagaaaaguggccacagaaguagcuuggguggagggauuuuuguuuguuuugcaugaacagcaggaaccauucagcuccacugcugaauggcacauuccaacagguucauuaauuaaaaacaaaaacaacaacacgauucuccaucgcacuuggcuuuuaccauuccagccaguauggacaaggaggccccuucuucuaccuuuugucauagucuacuccuggguggccuugagaggcaggguggagugguggaaaggcaauggggagggcagaucugagcuccacuccuuccucuggggcuuguuggcugugugugccuaggcacauaugggcuaccuuugagcuuuaguuuucuuauuuauacaaggggaauaacaauuuguaccaucuuggccuguuuuaucuauauuuuaaaagcuacaaguauaugaauacauucuauguccauguauguaucucucuguauaucuaugauauauccauuucuauuuaucauuuaucaucuaucuaucuaucucucuaucuaaaaucggagaagaguaaaauccuuucugauuacuuuuucuaacucuagucccuucuccaaauccuuuucuuccuauacauuuacauacauagguauccauagcaaauuuauaguaguuuuucccuuagaaacaugaauaguagaacauuaaacaucauggaauaccacauaauaccacauauaguauucugcuuguuucccauucaacaaugcguacuagagaucuuucuacuuaauauauauauaaaacugucagaggagcaccuucuccagcugggacccagucuccugacugccccccuggcuuuccucccaccacauuggcagacuggguagcucccccuggggaccccuaacucauccccaccuuuaagggaagagucuuggaaccuugaaaugucuugucucuauuaacuuuacuucucccuggccacagugagacaaaccaaguccuuuuauuacuguggauugaugguuuggaggauauauauauauaaauauauaauauauaaauauauaauuuauauauaauauauaaauauauaauauauaauauauauuauauauaauauauauuauauauaauauauauauauuauauuuacauauauauuauauauauaauauauauauuucuuuuauguauuucaugagguuauaauuuuaaacagcuaauaaguauagagugauuacuaugugccaggcauuauucuaagucauuaacuuacauuaacucauuuaauucucucaguuuuaugagggaggugugcuauugucaucuccauuuuacagcugaggaaacugaggcuuagaaaaaugagguaacucguuuaagguuauacugcuagcaaggaauacagccuguauuuaagccccuucacccuggcucuaaaauauauuuaacaacuauacuauaggucacauuauaccauaucauauuauauauacuacuacauacucuuauauuauuauaauuauauaauaugcauuuucaauuuuaauaguuccugccaauuuggccuccacaguggcuguguuaacacaguucuuuucauauaugcaacaugaggggauggaggaauguuagagcccugugcuuaagagacucccaugcuucucucaaauagaaaaacaauuuauaauuuuuauugacuuacugaguguuuuuuuuccuucuuuuugucucuuugaaagggagcaaaauuagggccacgaagaucaaguuaaugggaguauuuucauagggagaggaaggcugcaaugccaggaaagcugugacccuugacuuguugcaugcuggaguaauucgguugaagauagcuuuauguauuuauuuugcuuucagaauaagcaguggaccauuuauuacaccaaguuguuugacuuugaggacuuacauggacucagguucaaagguauauguggcuguguuuugaacacacauacacaggguuuugcuuucugacucaaagcuguccgcuggccaggcucaugguggcagcaagggcacucacucaucugucucccuucuuguugccuauggauggcacuugggugagagcagugggauggucacaaggaggaggauggacugccgagagggaggcuggguggaccccagccaagaaggacgcuggggucucauuauuaugggagcuagaaggccugguuuaggaaagaauuccuguucugaugaaagcucuucaguggacucuuaggauaaaguaucaucaaauggcuuuuacaagggccaguguggacccugccuaccucauccucauagucucaucacuggucuguccugcuccagcuguucauacucugucucucuggcucuuggcccaugacacccccucgguuuugaacaguccucauuaacuucucauucucuaggucuccuuugguuccuuucccugaucacuccuuggcauugguacagacgaacagucauaaaccuugcccauauuuuaagcaugcugaaaaacaccaucucuaguaaaacccaaauucuccaaagcugcaugggaaacucccagaggggaucauuccugcgcugggagaaagaacuuagggcugcgugccacccagagggauaaaccuaacccacuuuagaggguaagcacccacuaugcucucugcauuacuugauaagucuaguccugucuucugguggacaugauacccuagcacccucccagagaagaaaguggagauuucuaaaugccaacccugcaggagaucacaaacauaauacuguaauuuucauaguaaguuuggugcccuuacuaugugccaggcacuguaccaagcuccuuacuugccuaucagucaucccagcugccugaugagcugucucaggcuagggaagccaaauggcuugcccaagcucacaccacuugcaaccuauacuugcuuagccuaucuccaaaaccuguguuuccaaucagucucucauauagaccaagggcuacaacuuuuuagacuugggaagauucuacccauuuugcgaccucuccacaugagucuuuggcuccccacuguugggguccccgucagucugcuuaucuuugguuuucuuccucuccagacaugccuucccugcugcccccaaauuuuauuacuguauagucaguucugggauccuaacauaaccaagccuuaccuccuaacccagugcccuuucaacucucucagugguucccagacuuuucaacacuauggaauuuuuuaaaauuaauuuuucccuccaauaaguucuguguuuggaacaguuauccgacacaauuucauguguugaguguugauuaacuuuccauuaaaaaacaaauuaaaauauaacuagaacugcugauacuagccagucauuauucugacacaaucagcuaauauacuaauuaauuauagccgaaagcaaggacgguugguguuuucauaagccugggaaguuuucucauggguuccugggugauugcauugucggauuuggguuggcuuacugauaugccuaaaauagcuccuggcuucuuugguauaucgcuguccuuugccccuccugagaaucuuuaguuucaugccagcuuagcaucucuucucccugugggcaggucccaugcauuuacugccauugucacuucucccuguuacccacagugcugccaccaugccugggauagacagcagguaacugauguguccuaguugaggucccuauccuuucagaggaggugacauggguucagauauuuuccuauguucaugucuggcauccagggguacacaaaguauugauucuagcuaaagggacuuacuaaauacuguuugacaggaggcccacaggugucuaugugggcugcaguggaacuaagaggucuuuuuguucagcuguuaaaaaauuaguguuuguagcuucagaggggccccagagaaccuuuccugacccauuuagaggccaucuguguggcuaggauggcuuugcugucacagaagggacaguccacacuacccaacacucaagucugauuuauguucauguaaauccgaucaccuaaugguggcauucacggcuuggagacaagaaacuauaaguguuuccaagccugcagccaccuggcuuuuuguggggguggggaagggaaggaaagcuguacgaucuggccucagagagcccaagguaaaguucaguuaguggaaaaacagagcccuagaugauugggcgggggguggguacuggggaguggagaggggaaguccugagcugaccaagccuccaagagccauuccggaacuagagaucuuaaauacuacaugguaauuauccccucugccucugcccaugagggugucaggcacagggccgccuggcugccugcagagaagagcuguuucauucagaaacuucagagcuccugcaaugccuggauuaggauguggggauggugaguuucgcaaccagggucagauuucaugaagacuugguuucgugacuugagguguuugacuaagguguuugcaucucauguauuuaggaagggcucccuuuugacuuagacuuuaucaucaugaauaagcucccugccuuuucgauuuggaaacaugauagcucuagugagcucugcuacucccaagcuugggcagguucuuugccucaguuuccucaucucuaaaauggggggaaauauauuauguaccacgugguaacuucauuggcaauuaagugaaauacuucauggaauguuuagcacuaaauauuccuuaguguugaaaaggcugggaaccacugagacaguugaaagggcacuggguuaggagguaaggcuugguuauguuaggaucccagaacugacuauacgguaauaaaauuugggggcagcagggaaggcaugucuggagaggaagaaaaucaaagauaagcagacugaggggggccccaaaaguggggagccaaagacucagguggagaggucgcaaaauggguagaaucuucccaagucuaaaaaguuguagcccuuagucuauacaagagacugauucuuggcacagaauagcucaauaagaauaagcaugagcuuuuaguaguaguguuguuauagagcagagcugauauucucacuucacuuucggugaggaaaauggcgcucuguggugugaugugauguuuuccagggucauauagagagagcugaguuucaauucaaaaucgugguuugauccccccgccuccaaaucuaauguguuccauuuugucacagugcuucccacagggcagagaaagaaacaacaaaguuccuacucuauuuucacaacucuucacauuuuagagucuuaaguccauuugaucucauuugaugacaacuucgcaacgaggaaagcaggauggugauuggggggucggucauaguuccuaguuaguggaugucaguauugagaauggcgggguucuguggcuuagccauauagccaauacauggaaugggauuggaacccaugucuucugagggcaagcccaacacuugucaaggaucuggugcugcccuucccucuuuagacagcucccauugauaagcagagguagaagucacuaggguagccaaagagagggcccuagaaauggaauggugacaaugaacuuggcugaagagucagcaaccgcuccccuauccacugccagggcuaggaggugcaguguggcauggaggaggagcacuggcuggaguuaggaggccuaaggucuaguccuaguucaucaucugacucuggaguccccuuggugauacugaccucccuggguuuggucucuuaucuguaaaacagcaggauauuggcucuaugugguguguauuucacugaaugccuacuauggucaaguuuuucuggcucuaaguucccuuggaaagggcucucuacuuuagcugaauaacucagcaccuaaaucugucaaccacacccuucaguagguaacuuuguuagaaauauggucuauuaagguaagagccaggauuucugugguugcaaaaguggaugcgggcucugaacaaaaccucuagugagcugagauacuuuaucagaugacauauuugaccaccaaacuucuguuggagcagggcugauuugccaaacagacagcaaccuugcagacuuagucgauggcuagaauuaagacucaaggucacuucagggccugucacugauugugggagggcuugguaaaaauugaaccucauuaacaccacugaagaagcugauagacaagaaaugggauuaagacucaauacucaucaaaauaaggcuuuccuuauccacagccuaccugagcagugccucacucuggaaaaugugguucauggcucggcucaaacauuuucuguugcugagaggacuucucucauggaagucuggcucagaugaacacaugugugaucugauggaaccuuuguuuaagugaaugaggaggguauuuggaagacuuagaucaaacgugugccccauugggcagucacuaucugcuccccugacagggagaaaccccagugacaggauagaaagcuccaaagauccugaggaaguuuggaaggucaaacuucaccacugcaaggacugagagauccaagaaucucagaauccagguuggucuccagggugcaguucugaacaaaugagugcaguggauaaaaagcuuauacuuaaggugggaagguggguguggguuccaguuccuucuuuggcugauucucuuuuggccuggauuuccucacuugucauccaugccaugucacaaacccagugccuacagggaccaggcacagaagcuggauauuugaguaucagacauauuggaauauuacucacuccuaccaaauauguuuaugguuccccauucucuugguuuccauuuuggagagcuaaacagguacuaaaaaugauuucuuuauuauaagacaagcaauaaaacagugggcaagugugaugauaaacagcaucugagcuuuggcuuuggaguuggggagacaauagagaguggcaguaacuguggugaaccguacaguccaggucccuucuggaggggacagcugcuguccagcuccagccuaucaggaugugagucuagugaugccagauuuccagucucuuaggacaagcaagaaauccaaauuuuuaauguaacaucuucugaaaagauacacacacacacacacacacacacacacacacacacacacacacacacacguggaccaaacaaaacauguccaugggccagauucagccuugugggucaccaguuuugugaucuggaauccauuuuauuucuagaaucuccuuucaauucucggaucucugagugaguaacacccaauuuuuuuuuuuuuggcaaaauguguccugcauuucccacacuuucugagcuggagcacagguucuggaguuagaccacuuggcucaaaccuuggccucguucauggcuaguugccugucccuggacaaguuaauucccuggucucauuuuuccuaucuguaaaauggaguaugcaauaauaguacucuuaaccucauagguuguggaagaauucacagacacaauggaaauaaaaggccuggcucauugccuggcauguaguaaggaccugauaaaugucagccaucauauuauuacuacaugguauuacugccuccccuuagaugggagccaagucuugcucaccagcucauugccugauguuaguaggcauucaauaaaaguaucaugaaugaauaagaacauuugagaaagacagcauuccagccuuuccaggcaauacucgugugugugugugugugugugugugugugugugugagagagagagagagagagagagagaaagagaaagaaagaaaagaaagaaagaaagaaagaaagaaaacaaagaaaggaaagaaagaaaaaaaaagaaagaaagaaggaaagaaagaaagagggagggagggagagagggagagagggaaggaaggaaggagagagagagagagacagaaagaaagaaagaaagaaagagaaagaaagagagaaagaaagaaagaaagaaagagauugguuugaaacauugggagcugagcuuaaugagaaaaggccauuccuaacugcuaagcuaccguauuaaacaguggcaaguaccuuggaaaauaaaacagaaaccacugcccaucuuuuucuaacggagaaagacaagagauggcuugaccagaguggagauuuagaacuucaggugcugauaaauaugguaacaucauggggugcuuuggcagcuggauagauuuuauuuauucagggcuccuuuaagccagaggagauuccuggaggcugcuaaaauagaaugcuccaccuggauaguuaacaucuggauuuuauuuuguuucaaaaaguuaauuacaaauaguucgaauuccuucugguaucccucugagaagaguuucuuacuggguggcucacaagcggggagacagaaagggaaaaaaacuagauugauauugcucaggagaaacaggauuguggcuacacgugagccauguaugcaauuuugaauuuucccauagucauguuuaaaaaaacgaggaaaaagugaaauuaauuuuaauacuaaacccaauauguauaaaauaugaccauuucaauauguaaucaauuuuacacuuauuaauaagaucuuaauauuuuuaaaauuaaguuuuugacauccauuauguauuuuacacucauagcauaucucaguuuggacuaguugcguuucagcuaccugugguuaguggccgccauguuaauacuacagcacaggucaagauaacauuugcaaaggcaaggcaucuuccccuccccauuucuaguuucaugaacugugcacagggauauggggcuguucgagguacuuuugggcugaccaaggcucagaggcuacugacagcuuugcugcaaguaacuucuaggccuugugggucccagugcagggaacccaugugcggugacacuggagaagccaucugauccaggucucucacuugacagauggggaaacugagguccaaagagguacagcagcuugguuuaagagauagagauggaacuggaacaaaaauaauaaccauuugauaauauuuuaacauuuauugauuuguuuuuauaugccaagaccuuuuaaagcauuaucuccuuuaaacucucauaaccacucauugagguaggcacuccuauuucuacuuugcagaugaaaaaaauugggacuuaagaggaauuaaauaugaaagcagcuacuauuuguugacagcuauuuuaagaucuuuauauacauauauacauguaauaaauucuauucuuuacuauaaacauacaugucagaaauuauuaguguuaucauccuuguccuccucauuccacuuugcagaugaaaauacugaagcugagagagacuagguaacuuaccuaguauguaccuacauagugaagccagauuugagccggaccuccugacuccagaguccgagcaaucucaccaauucugcccacggucaccccacugcaugauggcagagcuaguauuugagcaggugugucuguucuguggucuguggucuucaccgccccacuagacagccuggauuuuucugcucuugagucucaacacuuucugccuuacugugccacuaguaaggaacagaacagggagguuuuugaccccagcacugauugaagggcccaggcaaagcaggcucgucuccucuggcuuggcugguucccaggcugcccuaacccaugaagccagauucuuggccaaguuaagcagggugggaagaacacuuguccauuccgccuucccaguugggcgaggucaguguaccagguuggaaagugguaugugucuaauugcaggggcggggguaggggggaggccagaggauuaacacucuuuaaauagacaucagaaaacuaagaauagccuugcugccugguaauugaugggcauuccugacuacgggccacacacucaguaggugcucgauaaacaugggugaaauacaggaauaaacaaauacugaaaaugggucauugggugagcacuuagccaguaaaaaucugugcuuuguauaaaaagaacuuuggacugagguuauaugagucuuccugcaggcuggagaccucuguuaccuuuacuucucuacuuuuguugucuugagaccagcuuuuuuauuuuuggugaggagaacagcaggcaguucaaaugucagggaaagacaaguucagcuugcuuuuuccuuauuucugucuuguuaccugcuauccugccagguuagaaagauggaaucacucccuuuugcccuaucaucaagacuucaguguucccuggagcacucuaaauuugccaucagacuuggaucauccucuaauaccaagcuccuggguccuuccugaaggcugccuccuugucuugcugagaagaauuaaggucgcuucccugggaggaauucagcagcaccucuuguaagucaucaggugugcuguaaggauggggcaggcaacauuucuuuguacugugggaaggccuaaaucaguguuucucaaggugugauccuugcaccaccaaucuuaagaaauguucuuuggagccgggcacagcggcucacgcauauaaccccaccuugggaggcugaggcgagaggaucgcuugagcccaggaauugaagaccagucugggucacauaguaagauucccugucucuacuaauuuaaaaaaaaaaaaaagaaaaggugguugggccuguagucccaguuacucuugaggcuuaggugggagaaucgcuugaguccacgagguugaggcugcagugagccaugauuguaccacugcacuccagccagggugacagagcaagacucuaucucaaaaaaaaaaaaauguuauuugggagagcuguuuauuguauuccccucuuggagagacauguggcuauuagcauaguaaaagcucugagaaguccugcugcauggugaccuguuuagcucuguuuaauccaguguucucugaacauaucuagccaaggaacuaauuuucccaagaagcaccuacaaaugcaguuggugagacacugcccagaugaggauucugaaaaccccuuuugcccacuugccugccauugugauugcugaguagggaagaagaaauuaggaaguaucaucugcauuacacagggaagcugcucuccuaggguugccaaacagaaauggcuguaguggugccagugggugcuuuguagggaccagaagaaaaaggaggaagggaaggcugaccuucaaggucacacauuugccagauuuaaaguuccuuccuguggucaugacuuguuuuauaaucuugcuuggcucaguucugggcacacaucagauuuuuaaauccuaggaucuuguuuauaccguuaaggacaugauugaaggacauuguggugagugugaaggugagauguuucugauugaagguccauggggcaggcacccugcgagcagguaaugaacaguaggggacauaccggugcaaccccacccugguccccuggucgucugggccagaucucuccccucucuguucuauacuucucuuacaucaccguccuaccuaaucauuuuaccgauaggagcaccuuugggauucugauuaaagcuaugcauacaaauuucaagagcuucagaaauucuccuaaaagcuaucuuggaucauuagaacacuugcccuagaguaucacugagucaauaaugguguugaaacuaaacagcaacaaaauccccccaaaaagguaaccuaacuuagucugaaauugucugaaaauuaauggcacugccaguucaguggcugcucagagcguuuuggugaagaaauuggcugauggauauuuugcaguagucuacaggauuugacgugggaugccaucuuuauggacauggcucugcugggcaaagcaaggacgggcacauccagccuaugcgguccaucaggggcacucacauuuagaaugggggagucuuaguuagcccaggggcugggggcagcaugguaguguagaaaaaggggccagugccuccagaaaaugggaccccaggccuggcucugcuccuucugcugugugauucugguugaguggccuucccuuugaguccucuggaugaaguuaaggagaagucuuggguucucaaguagucacuauucagacucucgcuuucagaguauuuaaaggaggaaaggaaacagaaggauagggcugguggacuuaaaaggccguguguuugccgccaccccauuugcucccagggcuggguguuugucuccccuccggcgcugggccuccugcuuggccuccagcucuugcaccauuaacugcagucagaaaagcugaugucacuguggccggccuagggggaaagucucaggauaaaacugcuuccaccuggaucuggagaaggggaagugacuggcaagagauucgcagguagggcucagagaccaggaggaauccagucuggguaagaauucccugucauggggcucugaagccacgggccaggcagguaguggauuucaagccagccagcggggucacuuggccccugcagcuacuccucgcccccuccugcauaauuuccuauuuccugccuccuccuccucugacacaguuauaaauaaccucgaggcuggccucugcgcuuaaguauaggugagccagaggaaaguggaggggaucaagguggagcuggaucugccacuuggccagggggucacaggguuucagauugcucaggggaauuuuguuuucuuguuuuuuccacuagggagugagguagugaaagaggaaauaagcuguguuggcauggggaggcuuggccuugcaggccggugcuggguuucacccgcaaggagcugccucucugcucacugcagauccccaggaccaaaggucuggaaagaggcuuagugagaaggcaucucaggacacaaagaggacacgaugccuugcuggugagguccugcggucuccuucucgaggcccagcccggccccauauuggaggccaaacauguagaaggguguaucucauuuuuuaccuuuuuuucucaaccaccagccaacgauggguaugugauuucuaaggauguccauugacuauaaaggucccauuaauacauaugcuauggacagauucucuccuugaacacagguuuauggagcaccuacuauauuccaggugcugggcagagugcuaaggucacaaaaaugaaucagcuguggccucuacagccuguuccccucuuggcauagaucugcccuucccccuccacagucuggacaaucaaggaccuggaguaagcacacucuaggggccgcgucucccagcauaucuuuuguuuucgaaaguucaaaaaacagaagaggaggauucugaaacagcaaacuugcugggucauccauagaguauauuaacuggcuaucuugcuaucuguccauaacuugcuaccuguccauaguguauauuaacuuccugggagcccacucacugccugacuuccuguucugcgcaugggcccaagggaaguucucgcaaccauaguuuucugugauauccauccuaccacauggcuuccugggaaacccauuagcuuuuuuguuuguuuuagagcccaagggaaucagggccuugaggggauuuuuuggugugggggguggugcaagcuucuaacacugagagugggugcuuuucugauuccuaugaagguggaguguaggugucguuccuggcucagcagagucagcccucucauccuauucaggccgucucugaggcuggcuccugugcccaagcccuuccucacucccucagggcaugaucacagggcauuuccuuagcauuccuccuuucuccccugugugugugugugugugugcgugcgcguguguguguguguguguggugugugugguguguguucuacuccgugugugugucauccucugcucauccacccauuccacugcgugugugugugugugugugugugugguguguucuacuccgugugugugucauccuccucugcucauccacccauuccacugcagcaccuagcaucaccuaggggccuggaaaaccugcaccugaaagccguaacuccccggcaccuggcugguugacuucuucccccuuaaccccauuuacuuugaggauggagguagucuuuagggucaggcugagauuuguccugacccaugcuuaguuggcacaucuugcuucugcaacaugcuugcuuaggguugggcaggggcccggagaaaacaagucguggcaucaccaggaccugauuacccccaggcaccaaggagcaccugggaccaaggggagguuuggggcuugggauauguuuuagggugaaggaucacagaagcuuacucauaccuauuugaaagccaagucaacagauguggguucuuggaaggagaaaaggagguuaacugcuuacuuauuagauuagaagugauguaugaaugauaaagagcagaguuugccagauauugcuaauuaauucucucacugcuuauuuuauggaugauaaaggguagggagagacauguuaauuggcuucaaggucucugagccaagcaugaccaauccgagaaacccagguggcuucaugcucuuucaauaugaucucaucccugcacuagagaauuuauauuuuugagcauaaagaauacccaccggugcaaucucccaggcucuucugaaggguuuggagagacaguggaggaugucaaaagagaugaacuuagagucaaaaaaagcagagauggaaucccgucucugccuuuuaccacuggaguuaguugacuaaaauguaaacucugagccuugguuuucccaauugcaaaaugggaaagaccccauuuauaaugcaggugggugagagaugccagcagugacagggacuuucaguaaaggcugagcugaagcugaauuugaaaagcacauucuuuacguuccauugaagaucugcacuugcucuucugcuaaccgcuaaggugucaucagugcugugcuauuaaaaucagaagucaaagaagguggguguggcccucauagccagaguugauagaaauggauuuauuaauauaauggaugguccauagaaaggugaaugaccugguuaacagacagggauggaguggagaccugucugcccuggucuucaggcugguucugaaaucacagaauuaagaugaucucagcugaggggcaaggcaaaucggauggaagagcggaggcccagagaagcgaagcccuuucccaauaucucacagcagguggggagugggggaaagcagcuuccaggggguggauuccugaaccagguauuugucacugucccacguagcuccucuugucaccauaugucccacucaguggagggauacuuccugcaagacaaagagggccucaugguucccccgucacucacugccuuccacucccugcuucugauuauucuguaagaaguugaggccgagcgcaguggcucacgccuguaaucucagcacuuugggaggccgaggcaggcggaucaccugaggucgggaguucgagaccagccugaccaacauggagaaaccccaucucuacuaaaaauacaaaauuagccgggcgugguggcgcaugccuguaaucccagcuacucgggaggcugaggcaggagaauugcuugaaccugggaggcagagguugcaaugagccgagaucgcaccauugcacuccagccugggcaacaagagcaaaacuccaucucaaaaaaaaaaaaaaaaaaagaaguuggagcucugucugucuguccuuuccccaacuccccaucuccgaggcuggcuccugugcccaaagucuuccucgcugucucuggguauguucacaggguaugaucacauuuccccugcaugcccugcgugggaugugcuccaugugcugaugccucuggggauuuccagaugaugucccuggacuuggcagagcaguguggggaaucugggacuugcacuuccuauccucauggagucuggucucucaccuucacaggccacuaagaggaaaggcaacuggugugacgucuggggagggaaguauguuccugugcaucgaaagccucaaacaugugcauacacuuuaacuagcaaucuuacuucuagaaauuuaguccuaagaaauaacuaggcaauggaguccauugcuacauuguuuauccccaaauuaaucuaaaugucuauugcaaauagacugcuuagauuauggugcguucauacagugaagaucugcacuuccucuucugcuaaccgcuaaggugucaucagugcugugcuauuaaaaucagaagucaaaggagguggguguggcccucauagccagaguugauagaaauggauuuauuaauauaauggaugguccaaagaaaggugaaugaaagagucauaaaagauguugagguaguucucuauugaugccagaauagcccuauggugcacuuuugaguaacagaagccaauuuguuaaaaacaacaacaacaacaacaacaaaaaaaaaacagagagagagagaugaaugugcauccagaugcuuagagaagagucugaaugucuguauacuaaauaucaacacuaguuacucugcgcugugggauuuuggaugauuuuaauuugauccaguguuuucuggaaaauaaaauuucacuacauugacacaucauuugauaaucagauaaaagaacaauggugggaaagcaaggacucaagugacccuugcuuuugggucuagagcaucauguaggaagccagcacagcccaucccuuuccuaggcgccaccuucuggcuccuggugggacuuguaagucccguggucaguuaccugauugcucuuacggaccugacgcuggaaauccucucucuccaaggucccugcaggagaugggaccugccacagagaaugccgcaagggauguuucuguugggagcugugagugggguggauguccucugccucucuuaaauagaugagcuagauuugaaccuggggcuggccaaagggagucuccucucagaaaccaggaugcagugggccgucugugucccagccccaaagcagccaggguccaguggauuagcacagagccgaccaggccuggagggugguggucugggauugggugagcagccaccagcaggaauagcaauuggagggaaggagaagcauugccaagagcaacuuagggggccgugagugcaggucucuggacagacagcaugguaacuggcugaggcaggaagaagcuuggugggcucccauggugcuaauaauaggccguguaggagcaggggaggcagcuccagacuuggagugaaaagacguggggugcagucagaaugaacuccccagccauccauguggucucaggcaagucacucugccuccagagccccauguccacuccuauaagaugguacauccccacagugcccugccacaggugauuauaggugaaggucuuuugacaccuauaugucuaagggucauggagugacaucuuaugaagucagcacauagaaagucaaaaaacccuuacauuccuguaaaauacagugcaggccaggcgcggugacucacgccuguaaucccagcauuuugggaggccaaggguggcggaucaugaggucaggagaucgagaccauccuggcuaacacggugaaaccccaucucuacuaaaaauacaaaaaauuaaccaggugugguggcgcacaucugaagucccagcuacuugggaggcugaggcaggauaaucacuuaaacuugggagguggagguugcagugagacgacaccucgccacugcacuccagccugggcgacagagcaagacuccaucucaaaaaaaaaaaaaaauacagugccaucucuccauaacuccaccugagccagcaguuccaucaguguugugacagauuacuauuuuuuuuuuguugucaaguacccucagguugagcagcugagaugcuuuuagggagugagacaaucucaggaucugucuuuaaaccccguagucauauagggacuggcaccaccagagacaacagcagaucccugucuggagcucacugaagaaucaggggugggaggaauugcccuuuuaaaauggaguguauauauguauauauuuuuugcauaauuaaauaauauauauaugucauugaacucaggcugguuagaggcaugcauguaugauauaaauucucuguauacaaauaaaaggaaguuacuuguauucguugaauggguuguuaugaugacucccuucauaggaaacauuuggauccauuuccucugcuuucgauguuguucuuucgcuucugaaccaguguuugaggcagaugucuuugauacugaguaaagacauggcaguuugcauucacucucugaccaaaagagaugcucccuacucuugcagaauacugauugcccaugacaaccagaguacuuuuauaagaaaaggagcacacagaaggcagaaagggaccuuguuuggggaggcggcuuugagcagugacuuuaugacauaaacgauuaggcucuuccuggccccgccugucuugggauaucuacucagacccuggaacuuugaaaucgcaggcuggguccaaugagcgcagaaaagggacaggacucaggcagauaggauuucuuucggguuugguaaacagcuggccucuagggguagggacaggggcagugggugggaggacuugggggagggaugggugagcucgugggaacugagaaacugugucuagggcuuccuuaguuauacugaaugcugcauguagaggucugcaggguggccagcugauggcuggcggaagaucugcugacuuggauucaguuacuacuaaaauggcagguuuagaaagaggagagaacuucuagauccagaggaaauaaucagguaaguaugcuaagauguguguauguguuagccaggcacgguggcucacgccuguaaucccagcacuuugugaggcugaggcagguggaucaccaggucaggagcucaagaccagucuggccaacauggugaaaccccgucuuuacuaaaaauacaaaaauuagcugggugugguggcgggcgccuguaaucccagcuacucgggaagcugaggcagagaaucacuugaacccgcaaggcagagguugcagugagccgagaucaugccacugcacuccagccugggcgacagagcgaguuuccaucucaaaaaaaaaaaaaaaaaaaaaaaaaaaaaaaaaaaaaaaagauguguguauguguguaugcuuauauauauaauacauauuuauuuguacauaugugcauguacagauauaaacacacaaggauguuuaucauagaguuguuuauaaaagcauccaacuaacauuucuguaucuaugcaauugaaaacaacauagccauucaaagggaugaggcagagcuauaugaacugauauauugggauugaaauaaaccagaucaccaagcacauuuuggaugauucuauuagcaggggacguauccacaaguuuauaguagcauagggaaaagucuugaagguaauauaaauauaaagcauaguuauaacuggacagugggaguuuaggucauuuacacaauuauuuuauagguuuuuguuuguuuguugacuucuuuuuuucccaaccuuucuuuagugaaguuguauuacuuaaguuaaaaaggaaauaaugagccuggugugguggcucacgccuguaauuccagcacuuugggaagccgaggcaggagcaucacuugaggucaggaguuugagaccaggcuggucaacauggugaaacuccaucucuacuaaaaauacaaaaaauuagcugggugugguggugacaccuauaaucccagccauucaggaggcugaggcaggagaaucgcuugaacccgggaggcggagguugcagugagcugagauugugucacugcacuauagcuugggagacagagcaaacuccgucucaaaaauaaauaaauaaauaaauaaacaaaauuuaaaaagguaauaauguaagaaaauaaagagcauggagaaaguagaaaaccagauaaccucgguccuauuuuguuaaauuuugggaaauuucaguaucugcauuguacagaugacaggcagaaucuugagaaguuaacacuuuaaaagaaagaaagaaaaaaacuagauauucacuaugugucaucuuguugacuauucucuucucugaacuuccuggcaucuuaguuagccuauuugagcuggaauaaaauguacuacgugucuucagauucugcaaacauuuaccaggcaccagggcguccacuauccagucccaagccugccacucaggaguucaugggggagugagugcauguggcaggcauuaggcaggguuuuugcauucugcucucccacuugaucccugugacaacccuaggagccugcugccacugaucuucuuauuccacuugagggaaccuagaggcagagacaggauuugaauccaagccuccagcuccaaaccccagcugaaggaagcaagcuggaacccaagaugcuuucaaucccugcugcucugagcacugagauuuguucacuggaaugcuggaguuuugcugaucauugaccucgcaggggcccacucugaaguuaaaaauccccgagugaauaaaucuccagccucuccugcuguuuccuucccaguucugaaagugagggcaggagagaugagcuuuggccaggaauucagcgagugacuuugcguggagugucagcuucuccacauugcuggguguuagcuuaccccugucuggcaccagcagcaaaaacagagccaggcguggccuauagcaaagcucccaguuuaaauaugugaauucauuugggccuggacagcugcauagcucaggcugggcagaaucugccacccuaccccguuuccuugaaaucuauacaggaacacaguuccaaauacccuggugccagucccugcaagcuccuacuuguacaaauggauuuuaaaacaugugaugauaucuaccuccucccguaccucugggcuuuucuaggugucagcaugaaucucaugugagcuuuacaaugaccccagagugggugggcaagggagaggugguuaugacuaucaugaacucccuugcuuuuacaagccacuccccuacaauccuuucuccaacaaguagacagugaacuuuaaaaaaugucagucacaucucugccaaugcccugcucaaagcccuccaguggcuucuuaauuccucaagaagcucuagaaguuucuacgggaucuggccucugucucccuuggccuugcuguugccacauacuucuagcuauuccucaaaugcuccaggcuccaaguuugucacugucucuuuugaacuugcuguccucucuuccaggaacaccucaucccccagauacucacuggcuggccccuucucaucauggaggucucaacucaaaugucaccuucguagagaggccuuccuugccucccuuccccuccuaccagccuccuugucuauuccccuuugccuccuagcaccugccaucauauuggguauuugucuuauuguuuggccugauuccuccuccguuacuuaggcaccaggagaguagagaccuuguuggucuuguucaccaucuagaagauacuugaaacucuaacauuuguuaaaugcaggaaagaaugcccuuuugacagcuaggaaauugaggcugagacaagugaagugucuugcccugguuucccagcuagugagugucugugcuggauucaaacuuagcucuuaugcuccagccuucaagugggggaaacucaagagggcaaguucuuacggggccacuuaggagcagacagcuucuuaggacaacauucuuuuauguugaugugaaguagcaaaucuuucagagauacaggccucuaaaaaauucugccaucugccggcugcuguguuagagccagccucagaaaaaggucagagauccaaucccuggcugggugcugugcacccaggaaagaaggagcagaauugaaauaagucuuuuccacucuucuagaugagccuucuaggccacaggcagggcauacccaugcauagacuuuaagggccuuuauuuggucuguuugcuucccaguuggggaaacaggcccagggacaggaagugaccugccugaugcuaccucaugaguuagugguccaggcaguuagaaccaagguuucccaauccagcgggaguucuuaccuacccacuauagacuucuuggccgguucugggagacugagcucuuuccuucccuguguuugccucaucagcacgcuggacugagcguucccagauucagugcuggagccagcgguggggaggggaguaggggcugaagaguauaucagccaagcuugggggagacagucacauaaggaaauucacacucuuccucucucauuagggggccccacaaugaggaggggaaagacaaaaaacaaggaucuuggguacauugguccuuaccuccccacugccccaggagcggucuugaggguuggaggagacuaccagccuccucccuauagcggacuugaacuuggcacauggaaccagcugaaacuggcaccauuucuacccucagaggguaccgcugaagaagacgggcagagaugaaagaggaacugcuuaauucagcucggcacuucuuagcagcucccccaucccauugccggcuuuagucccaggccagagacccaugaggugcguugaacauuacugauacccucuuugaucuaaacccuccuuucgugaucacgccugguggcucaaagaauugcucccccagcuuacuguuccuguuggugcugaaagaaugcucguaauuguuaccaaacaguggacggagcaaggcaacauguccccuuugcccagcuggcucccaguuggcacuucauuauggcaaagacagagggggugggguccccgggccuucggcauuucauuugcacccacauguaggcucacuucuuggccugggaauugaucggugccagaugcuccaucuagccagcauccccaccgcagcagggcugcccgccuccuguuucgugaaaaacggcccggauuuucaucagaccuuaauuggccugggucuggccuucauucuaccccagccucuucacagacugcuggccacuggcuguucccuccuccagccaggacaaugccgguccccgggcacugacccuggcccaggcaggccugccaacuccauagcucucauuucucacucugcacaucagugcuggcuucccacacccacagcuccuccagaaggaagguuugucagcgggcuucaccaugcacucugacguaccacuuuuggcccaaccaaacuacaccccacccuuggguagaaugggaccaagaugcgacccugacagacuuaaaugagaaaugagcauuuuccagugacgccuccucuuccugccucuugcugggccucucucugcauugcucugggguguucacugcacuuggacugauaccagucaaugucccucgcuucaaccugaccugaaacugaaaugcuccaaacaagaguaaguggggcagccgacauuucaggaggaggaagguuggcagccaggcugcugugagcuugcacggcccauaugggucccagcuaguacuuugcauuuucuuuucucucuucuuggaaccccuucguccuuuuucccgcugcccucuagccucuucacugucuugggaaagggggccucucacaaaacaguagucaccgcugcuguucacugagugguuacuuugcaccaggcacugugcuaaguaccucaaggggaguaucucccuuaaugccugcaacauccuaugagccuuguaugauugcaucucccuuuucaagcugaaaagaaguuacaugcuuugcccgacagucuauagcuaggaggagcuggagcugagauucaaccccagguucucuggugcccaagugcucaugucuuugcccugugugccccucuuucacagaaacagagcuucagccaaauccuggaacggaagcucuugggaagcugccugugaccuuucuuauuguguccccucagcacaggucaugcacaggcagcugggaauagauaugcgaguuaaaggaauucucguuggaaaacaccagagggauccacagggccacccccccgcccccgcaauaccacugugugucugucccugcagggcccuggaaucccacaguuguuuccuguacccaggccuggggagccagccagucacauggaccgugaguguauccgccucacgcuucucuguggccccuggcuucucccaguggauuccgcaagguguuuccugcaaauccugcugauggucuucgcuggcacguagcaaaauccacccagaacaccgcgaucugcuggccucagccuggaugggguuuuguuuuuguuuagcuuuuaaaaaaauguguguuuuuuuuuccccaaccaggggcacaggggugggggaagaggagaaacaugaagguaaaaauauugacagagugaaaaguauugaauauuccuucuauuucaaaaauagcagcuuccauggcugggaugcaggcuggcuaaguucagguugggcugagguugaaguugagaucaagguggcagcgugacccuuaugccucaagcauguccuucaggagggugugggagccugaggcagaagagagcuccuuccuguuuuaaaaacaccuuuuucugagacucucaaagaauguuugaaaucagccauccaaggugcucugccauuuuuaagagggaggacggggcuggauggugucccugggaauugaagggacccagagaagaggugaauuguuuaaaguuaacucagagcauuagagugggcugauauccucugaagagucuacuugucugugagagcuguuucagcuacuucaaagccagaugaucagggcagcggggcuggauuuucaucuucauggcugugcacaucuccacuugauaugugggggucggaguuggggggcaguaaagccugguccccauggagaugcuauccuggaagcauuuuuauuaccaaggacuagcauauaauuggaagauugaaggcagaagcccuuaucuucucggcauucuuuagaauucuucuguauguagauuucagaacacacagagccagagcaaaagaccuuacuuggcauuaacaccaggauccaccugccccucccuuccuggcauuaauguccagugcuccccuaaugcacuuuaagcugugaaguuaucccagguuuauuuacacuguaacuaauuuacucuuggcuggacugucagccuggaaaauaggaugucacugcaccccccccaaccuccaccaaaaaaagacaguggcuaaugaagaaaacagauuguugaagggcacuaaaauugaggcaaggagcugaauaaugugcccuccucaggggcaggcagggcaggcguggcaggcugucggcauuguuacagaucagcaaugucccacuaguuagcaaaugggccccucucaguuugaaugugcagcugauggaccagguggggugauuaggggccaacuccguacuuguuucuguccccaguuuuguuaagugcagaucacccagacagaucccaggcugagaaagagacugaagacaaagcuagaagaggcagcugaagcauccuaaugucuuaacucaaguuugacuuuucagaaaugugauuuuagaacauagcaaacaggaagcacgugacaacuuggaccacuacaacgaagagaaaguggaacccaggggaaaugcaugaguuagaaauauaaagugaugggacucuuagauucuaggguuaauugggacacuagaauauguccaguccaacguguucauuuuguacaauaaaaaacaagggcuccaggaggaaaugauuugucaaacucacauagaaaaugaauggaaaaaaacagaaagaguaucuagcuuccaauuccuggcccagggcucuucuugcuauucaauacuuucuacguaauaagccuggguuuuuuuuuuuuuucaaaaaaauuauuauacuuggccacccagaugaguacaguuauuuaguagaguacguagaguuauucacuaaaucacaucaaaguugggagacagagucugguuugaaaacccucgaguauuuuauuuuauuuuauuuuauuuuauugugauaauacuuaacaugagauauacucgccccucucuuuuucugagacagagucucacucugucguucagcuggagugcaguggcaugauacuggcuuccugcagccucaacuuccuaggcucaagugauccguuucccucagccucccaaguagcugggacuacagguacguacuaccauucccagcuaauuuuuuuuucgugguuuucguagagacaggguuuuaccuuguugcccaggcuggucucgcacuccugagcucaaggaauucaccugccucgaccucccgaaguccugggauuacaggcgugagccaccgcgcccagcaagaucuaccuucuuaacacauuuuuuaacacuagaaguacuuaaauagaugauggugaagucucaagcuguccuaccagcaguaaaaagauuccaaguggggaaggugaacucucaaccuuguauacugaucgguggcuccugggaaauuugcauuuauccccuaacaaagccauuaagagagucauuggcccccagcaagacugagauggucgaaggacaugggaccaugucauaagcagggagagaccauccuaaucuaugaaaauauuuauccuggagaugauuugggaaacaugacccuucuuuucaaauaucuuguuuuuuuguaagcccaagaugucaccuaggugggagaaagccacagggaagcaguccaaaggagaauuuuuuuauagucaaaaaaaauggcuugacauggaacaggcugaccuaggucagagaugguugcacacugggcaguuuaaccuugggaugggacuguagaagaaauucaaaggagcuuacacugagugacccugaaggucccacccaaccuaaagucuguggccugugaaaugugcccaugccacugugccguaguuuaacauguccuucuggaaggcagguaggacccagagaugagaaguaggggcucccaauucaggcugccuggacuggcaugcuauguccaccacuuccgcauuagaugaucuggggagagucacuucuucuuuacaggccucgauuucuaaaagaugggcuaaugacaacacuuacuuuauagggcccuagugaggcucaaaugggaaaauccacggaaagcauuuagcacugaucaugcauggaaagugccugauagcugauggcaccuauuguaacuaauaauaguauuagaauuaguauuguaaucauugacaauaggauuuuuauaauuagggaaaguggggaacuacccacaugaccauccuccugcuuucugugucaguguuugaccaaauguguucaucccugguacucucauugcuuauccuccgagagcacuggcauauaauggaaaauguauuccaauuuguucuguuauuccagccaggaacaucuaggaacagggguuggaggugugcuucagggacuaccugagcccagcuuuuuuuuuuuugagauggagucucauucuucuugcccaggcuggagugcaguggcacgaucucggcucacugcagccuccgccuccaagguucaagccauucuccugccucagccucccaaguaguugggauuacaggugcccuccaccacaucuggcuaauuuauuuuuuuuuuuguauuuuuaguagaaacgggguuccaccguguuggccaggcuggucucaaacuccugaccucaggugaucagccugccuuggccucccaaagugcugggauuacaggcaugagccacugcacccggccaagcccaccuuuugauaggagccucccaugggcaggcagaguaagaagugucacaugcagccacuggucacuuaggcaaaacccugccagcuuucagaugugcaguggagguggcagggggagguggcuggugcuguguauguuuugcagauacucugugguguggcaauugcucuagaggacucuaguguccagaagcaggcaugugcaguuuaucauuacagcccuccuucaaagaggacagcuggcccugugcuuugcagggagaggugcacuccggguggcccauaaacccagaaaauaugauuccuaucugguacaggguaccauccuggcaccuggagaggggucugcaugagacccagaaaugacuggauccacaacagaccuaguuuguggaacaguccuaaagaauccuccauucaagcuuauaucugucacccagggaacuggacauucccuucagucagaaugaacuaguggccuccccuucucuucagccagggucuuugcaguccucagccaugugaccuccgaccugucagucuuggucugauugcuguacccuuguuugugcuguuuccauugccuggaccauccuucuuuucuuuccaugaucaaaacccuauacauucuucugagucaguucaugcagcggaauuggcauuggaauguugcagcuaauugcacauacugggugacagagugcacaguagagaaagguagggugauacacucuucuuaggaagcaaucaauaagggccaagauggaaaagaugucuuauuucacccacugagcaccuacuauguuccagacacugugagauguugcgguuagauacaauugugagcaaagcaagauguaauuccggcagaauuuagugaguguaugggggcagggaagaaagaggaugagacaugauucaaaugaaucuacgaacauauaguuacauacacacuagggccccugagaauacaaaacagggguucuguucuagucuuaugcuugcaggaggugguuggggauggcuuuaugugaggaaguguuuuuugauuuuaaaugugaaguaugaguggcaguugauggguaauggggagcagaagagggucucaugcagauagaaugguaugugcaaaggccccaaggcuuugcaacugagagauuuagaccagggcugccgaucagaugucuaaaaaaguauacuuguucgccccuugccauacucuuugguccaaagggcugagcucccugucuucaaaccagggggcuucaggucaguuacuggacuucucucuuccugcccuuugucugcaagccaagguacccucaaucuggcauugagagcccuggggcccacccagcuuguaaguggagauuugaauccagacuucaccauuggaugagauucuuagacauuacaagaguuauggagaguuaacuccaccucaaaguucucaccaucuguaacuuauacaagcccuucucucauaauucagucuugggaauuuucccuaucuccgcauuuccaaugcauuugacuuggugggguguuucagauuuguuaaauauuuaguaguagaaagaagaugagcuuugcugcugggcauauuuggauuccuagcugugugacuucugacaaguuucuuaacuauccugagacuuguuuucuuccuauacucaguggaaauaaagcuacacauuuuggggaaugguuuuaagaguaagauguacuguuuguaaagugugucugucuuguucacuuuucuguuucugccaccugacacaaugccuggcacauaguaagugcucagugaauauuuacugaaugaauaagagguuuaggcaccaugauugcacagacacgauguucauagaguaguuggucuucuccuucuuuaucaaugacuccaucucccugucacacuucaaggccagggcaggugguucagaaauaccagagguuggcuuuauaguucugccauuacccacuuugaccaaagagggcagcaguuagcauucuuuacuuauuuauuuuauuuaaaaugaagguuuccuuaaaaggauuuggaucuucucuuuaaucauuccuccgcaccuucagugcuauugauuccugauaauggucuuagggcuugaagaccuauguaugggcucguuuuucucguaccuguuccuaccugagugcccacuaugugagugaugugguugugagcuggaagggaggugcugagugaguaggggaacacccgcugcagcaggugggccuuccaaacuauggcccuggguguccacaaccuuacagaaugaagcuuguggaacuuaaaggugaggaaagccuacacuauuuuaaaagccacaugaaggguaaguuauagauguaccagggucuccuuggcaucugugcuguauaaaauccauagacagagcagccauuggcucuuguucaaaccacaagaaagucuccugcccacuccuggugcauucugggaacagauuugcugucugcaaaggcugcaucugcgggucuggcgugcaaaggagggugguucuuuggcuaaugguggacuugcuccuaggccuaucccagagucccucagcucuccuagcaaacaaaaucccaauuaggagaaaaauaaaaugcuauagauggcuccugagauguugccagcuguuugggcuucaaaaaugccccgaccugaaagcuggaaguucugagaaccguuugagggcaugguauuuuucugggcacugcuucaaaggggcugugguugaagaccaugcugcuauucugguggccacuugugugggauaaaguuucccaugggcccccguggagaggcuggagcacucucaggggauaggggguggucucagccccccucaccgagugcacuugcauggcaguaagcaagucggcgccucugaccccugagugggcuugagcuuuugagaggucagcaugcccccuuaaacuugaugucuccucagagcacagcacagaugcccagccaaaacacccagggcgaaaccacuccaagaggugaaagggcuugaggggagacaggguacggcgggagacagagaugcaugaaauacuaacguugaagauuagaaaugggaugugcacuggaaugagaucauuugugguucugaugcaaagacccaggcuuguuucuagggguuucuuggggcuucgggggccuccugucaauggacuguuuggacacccauuuggauacaugcaauccuaaagucuaugggcagugacagagugauaagucuuuaucacuagccucagggaguagaagcccaccuaagaaauggcacugucccauguuggagcaagacccaaccuaccaagcugggaguuaccgcccacugcaaggcaccccuguacuuuguuggacucucuguuuucugucucuccaaugggcuggacucuccagccuccgggccucugcccaaccaugaccagaagguccucuccuuucucuuucucuuaacugucucuagugauucucugaucccagcucaggcaggaugucucccuccggcgccuccaggcuggcugggugugucugcugcaugcuccuguggcucccuggacuauaacucccugucuucuugucucacaagaguaaaauaagcuucuuaaagguaggaaccuugucugccugcuuauuacugaauccccaagacauggcacaggaucugagaugcauaguuccucaaauacuucugaauaaauaucagaugagugaaucaaugaauuucaaguggacuugaggagaaggaggggggguggcaaaauaaaacaaacaauaaacacuauggcagagagggacacaggaccuggagauggggccuggauaaacagccugccaugcucuucauauuuccugagugcuaccacaaggaagaggggcagcuggaggccagagggccugcagaggagucagcaggucuagcaaggagugccuuggguggagacucccuggggcuaauuuuggugucaccacugacuuccuugagggugcugagccuugggaucuucauguguugguagcuuuugggugcuguccuuccacagacacaucaacaaguucaugggggucuccuguaauaggguccugugacuugccucuuuuuggaggucagucuucaauauuuuggaacaaugucgguauucggccucuccagaucacauuuuuacuugucccuuccuuuucugaguaacucuauggaacaaggacuccugacccagcacuccaggaagccaaacacaaaaccauccccgucuucguuauuguauuaccuuugguucccucccacagccucauucauucauucauucaacauuuuugggaacccuggccacaaucuaggcucuaugccaugugcuggagucccagaugcagucccugccauccgguaauuagcgaugcuagugaguguccaaggaaccaaucauuaaagaacacgugcuggaagaaagagaggaaagccaagcagaagagagguggacuagcuuggccugggguggacagaaggcuuccuggaggagguagcauuucagcugggugggucuugcaggaagccaaaggugcaggcagaugcacagggaggaagugauucucaccuaggcaaggggcaucauaggacagguucauauagugaugggggcuggaagcuucagagugauaggguuugagguauggucccagcucugaagagccauauauaugccaccgagcuaugcagaauaauccuguagauacugcaaacccaagggagguguaggugaggauguaaaugaggguuguggaucccauuuguuccugggagaaugugggggacuuaggggagaaggacuguguuucccacugucuauccuuuggggcuuugacauuucccaccugacagccauuugcagaguaaaagccucagggauucuaaucaugcuuggugaacacuuugagguagucgccucauuggacccuuagaaacccaggucacagaaacaccaucacccuucugagauucacaguccucccuccccagguaagucggcccugaauccaggaaucagccagcccuaggacuuuugcccugucccaggccaagguaucuguaccuuucuuccaaauugcugguggccccaggaagaaaucaagaguggcugacuuuaagcaguuagauuaaacaucaaaugcauucaucccaaguccaggcauauaccuagaaggagcgacucuuaaauuuugucauuucauuguguaaaacugagguugccccuuaacacaugaaggccagcaugggaugcuaauuuuguguuguguucuuuuggguaaucucaaaguuccaggaagccugaccuuccuaagccuguguuuccuugccuccccuucccggccccuucauuucaucuacaacagacgucagcaggggcccugaguuuuucccagaccgcucaagcagaaacccauccugcucacaaggugaggagagccaggagcucacaaaggccccuccuccccuuccccgggagguccaggacagggcauccccaggacagaccugcccuggggaccccggaacacaaggcagguacugagaaacaggaaucucugggcagggagguuuucauauccuccagguuuaauagcuuucccugagauggaaacuuggguugaaaugauuugcagcuuuccagauuuucugagugugugucuuuggguuuauuuuuagccacaggcauucauuucuugccaaaaaaaccugcuuaaauaaaaccaagauuaauauuuuuacuuaacggaaagaguuagucaggacaggcuuugaacugggacuccuuaucuugauggggagugcauguuaacggucuggccuuggcguugacaucaacgaaaagggccuuugaaacggacaagagagaagggcccugggggaccaggguaggaugcaggaaaagccuauuugugggacuucucugaagagagagaguuccucuucacucaggcugcucgccgcuccccacccccagcccccagcccccaugcucuugcagugggaggggggucaucaucuuccuggaaaggcgggagaucggcucuggcuuugcucagagcccggcugugauucugccucacuuccagcugcucuccuuaccgccgcccccuccgccccccacccagaucagauccagacuucuuccuccucuggauucagacgcagcaaacugagucucuucugcaggaugggcugaggcucagaucugaugccaucuccagggcgauucccugacaccccuccccugagauggacuucaucucuucuuggcucuguccuggcuuuccguccuugcuuauauugcugagccugccuuacuugagugucauugcuggucucucucaccucuggcccuugaguuccuaggagccuuauguaucucucuaucccuguauacgucuucacaauacugaaacaccuuccugguugcugaagaguuguguaucugacccugugaaccgagaauugcuguuacccccuuuugauugaauaagacuuagaaagacuggucauuugacagagcuugcacaggaauuauuuaucuguuuuuaaaucacucuguguguggcacuuuauacaagaaaucacacguagcuucccauauucagcaaauacauaugaggugccuguuaugugccaggcacucuucgggcagcuuuggcuacagcaauagguaaagcaaagaaccugcugcccggggaggcuuacauuuuaauggggagagaugaucaguaaagaagcaaguuaauguauaaugucagaugguggccagugucugauagagcacagugucaggggccaagggauugcgaggagggggaggaaugugcauggaucaggaucagggaaggucccccgcccaagugaagaaagaguguuccagcagagggaacugcaaggucagagacccugagagcaugcuugggugcuagggugugcaguagagugagcuacaauuuccugagauuaagaaggccaugagagccccgggugcagggaaggccuguuaucuggagcucaguguuggaugggucgaauuugagauguuuuauuaggcuugcagguauaaauguagacuaaauguagacucugggauauauaaguaaaaagaucaucagggaggggaacaacauacacuggggccuguuggugggugggguaggggagggagagcauuaggaaaaauagcuaaugcacacucggcuuaauaccucagugauggguugauaggugcagcaaaucacuaugguacauguuuaccuuuguaacaagccugcacauccugcacauguaccccagaacuuaaaauaaaaauacaauuuguuuaaaaaaaaaguucaugagaguucuagguuggcgguggcaaaagcgugggagcugucaguugugcagauggugcugagacccacaagcuggaagaacauagcaggaccacgagccugcaccucgaugaccggacugagcaccaagaaggucaugggugacuucgacaagcacugcuuuggagagguuaggggggaggcugccuagguuauugcaggcaccuuuggaggcugguaauuaucacccacaauuuaucugcugggaugggaagugacuugcccaaggucacagagaaacagggcagcgacuucacccagaccccacgugcuccaugccuguuuuucauuccaguacgccgugaucacuucuccaguuuucuugaucuguccuuucagcuucugagucuuucaggaggguuuuuuugggaguugggauuguggugaucaauaggcugggaaucagagggacccaguccaggcaggccccucaggccucugcuuuucacccuuaguuccgaaggcccuuuccucucaccuagacaucaucaaagcauccccagagaggcagcagauaucugagaaggaccuugggaagggucacugaggaagguucucaagauccuggggggaugaggaaaugcugaaucacaagaaucuuucggguuccucuugcuguuuuccucugauuaguaaauuuaagaaucuacaagucaucaccaucagcaauauaacaguguaucauuugucuagcuucaggguuacaaaguaccuuuguacauauacauugucucauuuaauuaaucaaucuaauuaacuucaaacuuccuguguugggagaacccuuagggagccugugguuuugugguuucuaaguuauuuguuuuuauuccaugaaagccuugccggggagcacaaaggucuaaacagaugauacgauauacuguuauacugcugauggcgaugacuucuagauuuuuauuacuaaucagaggacauguguuugugugucuguguaagugauugggaaggguggugggugggugaucaaagggauguggggcucacugggagcuuaucaaggguccuuccuuuuagguaucaaucuucuucucugauccucugcagugaaaguggggaaugcaguaaaauuaugaacuauuuugcaaccagugugaaaucccauguaaagguuuuuagguggucugcuguccugggggaccucccauuuuuuuuuuucccccacuaggaugcaaaacugcuuacaggcuaccugauccucauuguccacaguuggaaaguagggacauuaacagccacaacaguagccaccuuaccagcuugccaugaggacagaguuaaagaacaugcacacguugcuuggcaccuaagaggcauucgauaaaugguagugguuguuaucaguauguucuaguucccuuccuucuccucuagauucacuaaugugaugcuaagaaaagcaagcaguuuguaauucuugaaugggugagcagcuggaagagugagagagccuggcucugcccuccuugggcaggcuacauuguagaguguccaaggugggcaggaaaaaggcuugcuuggcgggcuccaggccgaccucccugugggucccugaccuauugccuuugccaugagcacuccggccucagcaaggccgcucccuuugucauccugugggagaugauaaaauacacacgaaggggccgugagacaagcugggugacagggaucccucuuuccuccuuuuugguguguuuucauggguagggcaucauuccaacacuuccagaucccucuuuuccuccaagucuaggccgaagaugcgagcccaugguccaggcuuuucuuccuaccuagagccugccugcuggggucccaucagaagagcagccccuucccugggacugacacuaacagugacuucugcauuugaagaaaugcagucuacccacuaaccagacgucccuuacuuauccuugcuguccuuuuaaaaaccaugccuuaaagcagcaaaaucauucuauggggucuuuggagagacaggaauggggguguugugugugugugugggguggcggugguaucucaccugcuagauagcaugaaucaacuccuaagucauggagaggauuuguacugcucuuccguugaugcuaccauggguggaaccuggacuccuaaguuaguauacauuaauuaguuaaggaguccuugauccccagaccagccaaauggguagcauuguugcucggccuucuagucugccaguaggaaaguccaaccauuaggucggggaagaagggucuggauuugguugacaaugguuggaugggggauagaagcagagagagagagggagggcagcucaaggguaucuugccccacucuguuuaugcugaugaacagcacaugugcaauuucuggagacacaccaguaagcuuuucuggaaacucaaucccaauugccauuggaaaauuguucuuuguucaaaacuugugccacugugguccauacugcuagagcuggagguggggagaggcagcaugaagguauauuuauggaagaggugugccuuguuugccuugcuuuuguaagcucuuacuagcacucuugcccaaacaaauauucaaaggaagcaaagacaguucaauagagauauaugccucuaugccuggcuucucaggcgcaugauauauucaagagggccccauauauauuuauagaucaaugugcccauuauauaaguucacacauccuaguuaguuucuucuuagauacuuuuacauugaaauacugcuuauuccuuaaucaaucucuuccuuguuucuucuucuuccuuuuuuuuuuuugcugagacagagucuugcucugucacccaggcuggaguguaauggcaugagauauagcucacuguagccucgaacuccugggcucaagcaauccucccaccucagccuccugaguagcugagacuacagauacacggcaccaugccuggcuaauuguuuuaaauuuuuauaauuuuuuauuuuuuauagagacaaggucucacuguguugcccaggcuggucuggaacuccugagcucaagugauccuccugccuuggccucccaaagugaugagauuauaggcaugugccaccacacccagccucuuccuugcuucuuuugaccaccagaucccuagaagcccagauucucuuccuaagagcaaaagaaauucuagagagacaagagaggcucagaggcugagauucacacugagccucaccucucccuucucugauuggugcuucuguaccuuggagacuaguccucuagccauaaacuuuuuuuuuuugagauggaaucucgcucuguuuccaggcuggaguacggugaugcaaucucggcucacugcaaccuccaccuccuggguucaagugauucuccugccucagccucccaaguagcugggacuacaggcggccccaugcccagcuaauuuuuguauuuuaguagagaugggguuucaccaugcuggccaggauggucucaaucucuugaccucgugaucugcccaccucagccucccaaagugcugggauuacaguggugagccuccacacccggccagccauaaacuuuuaaaccuuaucuccccacuagacuagccaucaguggaagcgggaaauaggacuucuauuucuuguugucacccucaccagcacccaacccaauguuccagacaccaaccuaguucaugccuauguugguuugauuguugggggcacuggguagacaguguaggggccauacuccagcaugaaugggaauaaagacaaccuguguccagccuggcccaucuguaaagcuggcuucuagccaccacaacaagguggaaggaauggcuagacaugcugccaguuaccaguuugaaaagugucuucuguuguuggaaaagcacaaccuccucccaccccacuucccuuguucccuguggccccugggccagcgaaugccucgggagaacccugauugccaaacaggagaguacaaaauagcacacauuugaauuacagaggagaaacuggagcaaauacggacagauuaaugcacaaaccaaauagguggaucugggguuggccagcaauucuacuuuggaaggacuuugagaaucuauuuggagggcagaauguaacuuaauuuuaguucaguuuagugaaguuuuguuuuuguaaggaaaacacugauguggccucuucacugggccaucucugccucagacuuuuggaaccaugacugugaucuuguuuggcuggucuuaguaggcaauucuuggguuacacaugggugauaaggugggauggguacaugugauagaguaggcacuccugaucccaaaauaccuccuauacuuguucugacuacuucaucugugcuucuccaccucucccugaaguucuguaaggcuagaauauuuuuaugagguugccuuucuucucauccuagggagaacucccaggccuuagcuuacagugcauguuagaagucugaagaugguaugcccuaagauggaauaaaaauagacaucaccauaguggugauaaugcuaauaacagugguagcaaacacaugagguuugggauggacuacauacuguucucagcgcuuauauuaauacgacccucacagcaacuuuaugaggcauuguuucaucauucccaucuuacagauugggaaaccaaggcauagagagguuuagcaacuuccugaaggucacccagcaccagggcugggauuugaacccuggcucucaggcuccagagaccaggcucuuuaaugcaaugcuauguugcugcuccaauaguaauaagcaaaucacuuguuagccacaugagaggcacugggcuaagaaagccagagagauucaggaggaaagagccccagagagaucauacaguaaugguggaacccaaacuucaaugcagcuuccugacuacaaaaacguauucuuuucacugaacuauccucagaugaaaagguuccaagcucaggcuauuugggguaaggaaggaguuggcugguuguaugugcagaagcuuccagcaguacucagcuuuauggggcaggucugcuugugacaucuucugucuaaaucaagucaagccauuuuugaaccaggauguugcuauuuaaaggaaucccuuuugccuugccccucccacaccccccggccaagacucgcucccuuguuuaccuucuguguuaaugaggcagagaagauggguccaaaucauuucaggaagaaucagugguaaaggcuggcagacaugccucugcacggaggugaagcuguuauaaccugccugugagaguuaauauggaggaaacaguccccggggccuccgggaggcuggcuugucgccgagaauacuaccgcaauguuagaaacagagguggaugcaggaucuugacagacauuggccugggaucuugccaaccucucguuuuuacagcagacuuggaaacaaccacucgccuccuccuaauuugagcugccuccgcuaaauugcucacuuugccaaugacuguguguuuugccaucgccggcagggaaggucugaaggggccauugauucaucugaacccugacuucaugucugacugcaaggguaggauccaagcucauuuggaaagaaacaagacagaauccaguauggaugaggaaucaguucuuaguaaagauuuuuuaaaaacagagauuagagucaaauaacugggauacauaguggagcauccacaaugaggaaggauaauggagcuaccaaaauguguguguguguguuuguguuugugugugugaaggguauuuuacuuaacaagcauuuauugaguaucuacuccuuuuugggcuaagugcaacuugagauaagaaagauugauaggaucucagggcugaaggaguucaauuuguaauucaaaguaugacugcauaagcaagccccauuccaauuccuguugaggucuuagcauggaaguauccagcacccucaucacacccccugauagaggcacucucugcccuaauggcagccccccugccuuuuguugcugguucuuauuauuagacgauuuuuuucuuugguugagccaaugaauguuacucucugcaauuuccaguuuugguauucaagaccuguccauuugcuccuccaugugccaauuuuacaaauaccugaagacagcucuugggugcuucuuuuucacacaacguagaaagagaagcacaaccuuguagaaucuaaaagucaaguccucuccucuuucuguucccagugcaugugguaaaugccucucuuucagcccucaacccacuggguguaauuacuuuuguauucauaguuaacuaguaucuacuggguaaauccuuucugccagacauuguagugggaaauuucauaagaucuuucguucaauccugauuccaauucccugauguaaagagaguuauacccucuuuauagaugagaaaauugaggcucagaaagaggaagugguuucacuucuuggucuguuaccuuaucuagaucauguggaugcuaauacugcccuuguaagacaguuaagagcaguaaauaagugaaauguacauggcacauaguaggugugcaauaaaugggagcuguuuucauuggaacagcccuuccaugguuagcccauuucauuuuuggugaugauaaugaugaugauauuaauaauauuugucuagugcaaacuauguccaagacaguaucaagaguuucacauuugucaucuugacuaaucccuucaguucaagagauuaguaucauuaugauuccuguuuuauagaagaggaggccagaaacaaaguuacuuacuugcauacagucgcaauagccauaaacagcagagcugagauuggaacaguucugucuggcuccugagccccgacucccaauugcuccuucuucuaaccacauccccauagagcucagacucuauugcaucccuugcuaucuaagcacuggauaccaagggcucaaucagaaugcuaacugggggcacugugggaagcuagggugcaccacaacccuguagacaugucaagauguggugaauuaaugcaugcaaaggaagagccccaaaugaggugguuagaaagggguccuaguggaaagagaacagaucugggagaccauggcauugucagauggacaagggaggggggacaauggcucuaacaggagaaguagguuuuggauuaugguaaagucacaaagucaagaaaauccucagggucggcggggguugacuauagccuuggaaguucuggagcuggcaauugugaauauuugggguaauuaacuugaaugguggcuguuucuuuuuccuccaaccucccucucaccccagggaauucccacucuuguaaacacaaucaucuauuccaguuggcuccaagguaagagugcaauuccaggcuccacagaggcuagcgugcccgcccugagaugcuguuccugaugugguucaggccuuccuaaccucuuauugucuccuucugucucugcagugauccgggccaaggugguggggaagaagcugguaaaggaggggcccuucggcacgcuggucuacaccaucaagcagaugaagguagguaaugucaucacccuggcuccgggaagguuuuuggguuuuugccagaagaguccuggcuaagggaggcaaaguggguuggaacuggggugugugucuaagcaccagccagacccagcccuucugccugcuggagagggagcugcuaaggcugcauaaagggauggguagggagggggcauggggcugccuuguccaagagcccaugcagguggagucacuccaaggcacuuguuaggaagcugagcucuggagccagauggcagauagccuuguuagcucguaaccaugagaccuuggucaagucacugccccucucugggcuuuaaucuucccaauugugaaaugaggggguuggacuagaucaucucuaugaacucuucugagcucugacuaucugggacucaacagugcuuacagguuucaugcagccacugagguuacagcuuagguuuacagcccucaaaucuuuacauggaaacugugcugaucacaggaaccucaucccaaggcaggaacuucaccuucuuucccuauuuucccagcugauugucuucuugcauccuagauaguuagcaauguuugcuaagcauauucuuaucauuaaacauauuacugaggauaugaacaucaugaaguacaggaaggagguaugcccuuaagaaaaagaacaccagauuugaaaucuagagaaccugccuccuagucucaccucuacuccuaaauagccugcuuaccuugggcuugucccuuuuccugggccgcaguuuugccaccuguuaacagugugggguugggcuuggugcuccuaacauccucucuagcucaggcauucuaagcacccugggaugcgggccauguuacuuguaaggaggagcgggugguauacaauggaaggguguacuggugauugccuuagcacagaagacuggggcuucaccuugaauaacucagcaacugguucaucaccccaucuuuguaagcaccucucuacaugcagagcucccagcuaggagccagggaggccgugagggagauacaguuuccaucuuuaggaacuagagucagguugggagagaagaggcagguaugugugugacucaucagaaguucaauguggggugugcugagguccacaggaacuguccagcccuuuaacuuauugcucauauuugcaucccuagcaauuaggguaggaccuggcaugcaaaagugacuuggugaaugcuuaucugucuaauacgggcaugagggugagaccccacaggccuggaaacuccccagaggagacaagccgcaauguccagguagaagggaguggaggagugacgcagcccacggugguacccaaccauccccaaggccaaccuccaggcuuucuuauuccuguguccugaggcuggauguacuaauuuuguggaaccuguugcuuuggauucaauuuugcaaacauccacagccuucugguuauguaauguccagagucagcccuggccaguugcccuuggcugccuaagcuuggucaugagaccagcuuaugucuucagacagcccuggggagagaaaaaugggcagggguggggaaccagcaagagcaacaacaacgcaaaaagcccacuuugcaaccucuggcagacagcgcgggaaugccaaagcauauuagaccaaagcagagguucagaaaacacacgaaccugccuggucuggaacaauccucauuacgagacacucgguggucagcagagagcugagagggaaauagcugggaggcagcaguuccuaagccugccugguuuccuuccuaccaucagggccuggagaccagggugaccagaggcccuuccuguggacauaaugucccauucccccuugcuggugucagaccagccacgggugguuguuuagagaccaaacaacacuugcuagccuaucagcaucagacacucccacucccaggcuggugggcuuagaagacacacucccacucccagacuggugggcuuaggcuuucgguucaccauccuucgccugagcucaugaaucauggugcugggaauuagauguaggaucccucgucuuacuucugacagaggcgcaaaggggaaaugacuuacucagagucaagcauuuaacuaagggcagaucugauccccaagcugaggcaucggaauuucuucccaauccuguguucuuuauaugacucccaaaucucccugccaucuuaaucaucagucaccaucucaugccuuucauucacucugacccuccauagaggguaucaugauccauagaacuggucagugcccuucuauccagagacaccacuggaaucugcuugucucuagguaccagccugcaagucagacaagauacaggcuagaaguaauaguccguccauccauccucucgugcuuccuucccacccucucucugugcuuaguacuguacuaugaacuggggauacaaagauaacacugcuuauaauuaugauaagacuuggcaucaguuaacauuuacugagcaauugcuuagugccaggcauucugcuaggucuuugcauagaucaguacuuauacuaacacuguaaaauagauaacaccuuguccucuguuugacaggugaggcaacugagaccugggaggucauauaacuguuaagauuauauggccacaaaguggcaaaccugagcaaaacuacagggucuuugccuauaaggagauaauacaguauggagcagcaggcugauucaucauuccuacccacuuugggguauauaaaugcccacuccauauguuuuuaguucccagggaacaaaaagaggucaguuuggguuuguugguuuaucauccagcaguguagggcuggacuuguaauauccugcaaaggguguaucagaaaaaucuuuguaggagggaagagagagaggccagagaggcaagccugcaugaguuuuggcacuggucccugggagacuuuguucuagcagauuagacagucuacccuagagagucagaaggggugagcaagggcuuccuuagagcaggacuaaaggaacuuggagaaccugagacuccgagccgcccugucugaccucucucuucucucacugauggaaggcaggcagaccuucucccgucugcuaacucuggagccucugacccaucucucaggaacacuucaguacacagagaccugcgauaugugugugugugugagggagcaggguguuagaauguugagagagcuuauugcaaucccaaacuuggaaauuagcugggcuguggggugaaggugaaaguuuccagaacuggcugcucuaagcuguggggaccuuaucucccaucaggaccaugagaaaccgauccacugugccaggaguuauuguuuauguagcggagacaugcucuccagcuggcugcaggggacagaacgugggggacauuaugucccagcugguccugggagggucccauggggagacccgcuggucaugugcuuugcauguccugacuguaggcagagcagaccuccagggacuuccuuccuuuagugguuugucuaaccaaaugagcaauagcagggucucgccuuugaagcucuagcuggaagcaucuuugacccccagcccacagggaaccauucuucuugcaaugcccgugguucuuccugccuuaggacucucauccagcccucugcagagacuggcuccauuucuacauucucugccuguccugcuagacaaauugcuguauagagaaagaucauggccgugauagcucggucggucuguaaauaagaauuuguggguuuaaaugaguccgugauguacaccagcauccagaacaguguugaucuuugguaggcaugcaagacauaguuggaaucauugaggcaacucaugcugucaauguagagugaaggccagacauuucauaagaaauaugcaaauguccccagacucagaaacuucuuuuuuacuuuauuugucccuucacuccaagggaagcuaacaucuuggaacuuuguguagaugcuaccaagaagaagaagaggggcccagaggcaugcagaacccagcugaaaaagaacaacccacuuaugucugaaguucuaaaccagcuuuaacuacucuuguuaagagcugaggaagggacuuaggagaaaggggaccaaacucauuccuccucuccuuacgaauuucaguauaacuuguucuaagcuaacuuuuauugaauguugugggcugacugcuauucuaagucauuugcuucucucaaacacccuaagaagugcuuugacccauuuuacagaugaagaaacugagacccaaagagguuaaguaacuuuccaaguggcgaacacagguggcagagaagauugaagauucaaacucuggcugucagccuccaaaaccugaauuuaccacugaucuccauggcauugguuuggauuagauuaccuuuaacaucuuuuccaacucugagauucuaggauucucugaugucaggacauuauaaaccuauuauaacucuccuaaauuugucaaaccaauucuagaucucuaugauuacagacaugauacuuuuagaaucaauauuuaaaucaagguaggauuauuacacagaaaacacaacugaguagaaucuaccuuugccauguuguucuuuucagaauugacccuaaaacacagcgcuauguuugucagagccagucauuuguaaugugucagaauuucgacucuaggcaagugcuaggagcuaaaaugcagguuccuucaaacuuccaaguagcugcggugccaagcugauuucgaugaguugaguucuuacugagcaguucaaaugaccagacuguaaccaggggcuucauucucucacccacgaagcacuagggcagucaaggggaaagacugacgcagaaggaaugagguucccaugggcuggguccaaaagaccuagagcgagugcuuaguugaaacauuugccaaaaccucaaggaacacccacacaaaaauaagaaguugcucggcacagaagucaggguaggggauguucuucgaaggccacacuccauggcaggcauacagcagcacgcuuaaacaugguuccuguuaaggcuagagaggcaccauucacauagaagaagucaucaucgugacucuacccaccccgcgcccccaccgcguaauugaaugcugaguguggacggcacuucuuccagcacuuggcugcguuaccgugcucaguuggcaagccuugggggagaagagagguucagaaggaagaccaucugaguccaucagaacaaugugugcuuuuaacaaggcaggggcgcccaaacucaguagguccaacagaccaaguuaugcuaugaaggucuuguggaccaccuacccccgccaaccagucaccacuuaaaagaugagaaaacgccagcucacaggccaaaugggaggcauuuagaagagacaccaaugaagagaugucuggcuuuguauuaauuacuguagguaaauuaauaccaaaugccaggaaguaaaguagaggcauuuuccuauuauaaacccuugggacaagcccagagaccaccagcaguccagggcuuguguacgcugagaacugaggggauaacagaauugugcaacaccuuggugccccaccgcccccguuaccaaaucucacaguucacaguaucgccuuggcacacugggcuuguguaauacucauggacuugaccuggaaucacaaagcggacucagcuucuguuacauucauucaccccagugacucugggcacacacugugccucugaaggaggcacaguggccauaaauggaaauagcauuugccugcuucuggggaccuuggucauagacuucugaggcuuuccugggagccagucuaagauaauggguaagaguauggacucugaaggcagaguccucugcuuggaauccuagcccugccauuucccaacuguguggccuuaacaagcuacuuagccugccugugacucaggcuccucaucuauaaaaugggcauaauaguuccuaccucauaggguugucauggugauucgugggcuaauauuaaaggagauuucucaaccucaguaccauugacauuuggggccggauaauucuuuguucugggggcuguccugaguauuaugggauguuuagcaaccucccuacccucuacgaacuguugugacaaccaaaauugucuccagacauugccacaugucccaaauauuuccuaggggggcaaaauugccuccaguugagaaccacuguauuagauuaugucguagauacaaauagccaaauaucagcaauuucacgugguucaaucuaacaauuauaaaguauuuaacaguuaaaacucuuugaacuuuguagauacauuuaugugcuucaucugggauaaacgaacccaaugcuuucaccagacgcucagaagaauaaaaaacauggagaauuucuagcuugaauucaacguucaccagccaaauagaauuucuauaaagugggguuuguaauacaucccucccagggcucuuuuaaggauacugcaaggagaaugugagugagaauguuuuugugggcuggaaagugucacagagauaucaugagaaugcuggcugaguucacgggacucagguccuaagguugacaaagaaaaaggaccuuugucacagcuacuucucuggauuucugaaaaggugcugggaugucagacauguguagccgaaggaguguuguggggcaguuggaaugggggguauggcuggcugcacaggaagguuucucugggaaggcaccaaccuggcuagucaagaggaucgguggcuucaucuggggugaagggggcccugggguggguagaucagugaccggccacuggacagcugaauaggggagcgagauucccucagauccaaugucagcaagccuucuggguacugagacuccucuccuguguuccucuuauuuuauugauacauaauaaauggacauauuuugagaguccaugugguauuuugauauauucaaaaauguauaguaaucaaaucaggguaauugggauauucauaaccuuaaacauuuaucguuucuucaugcugggaacaucugaauuauccucuacuagcuacuuugagauauacaauaaguuauuguuuacuguagucauucuacugauucaaugaacacugggucuuacuuguucugcguacucguauuuuuguacccauuaauuauaucucuuugccccaauccuuauuaccuuucuugccucugguaaccaccaauccacuguccaucuuuaugagauuuacuuucuuagcucccacaugagugagaacaugguguauuugucuuucugugccuggcuuauuccgcuuagcaaaacgaccuccaguuccagcugcauugccacaaaugacaagauuucauucuuuuuucuggaugaaucauauuccauuggguauagauaccagguuuugucuauccauucaucuguugaugggcacuuagguugauuucauaucuuggcuauugugaauauugcugcagucaacaugagagugcagaccccucuuccauauuccgauuuccuuuccuuuggauacauacccagcagugggauuagggaucauacggguguccaaacugggaaagaagaagucaugauguuccuuuugcccacagauguaccgaggcuucaccaagaugccccaugugcaguacauccauacggaagcuuccgagagucucuguggccuuaagcuggaggucaacaaguaccaguaccugcugacagguaauggccaacucuagcuucuaggccaggguuuggccaagguccacuguuucuugacuucagaagaacacauacggaguaguugacucaccaaauguccaguaaauuguaaggagucucuaauguugaauucaucccacuuacccagugcuaggagcuugaggcuccuacacuuaggcuggacuuuggaauuagcuccaccacucaccugggggaggaaaucuccuaauuuguagcuucucaacuuuacuguaaauaaaaagggaguaucuguuccucuccaccucacacucgaccuguuaggcccgucuuugaaaguuauucaucuuuaggcagucaguguaguaaaggagaaaacaaaaacaaaaaucauuauaaagggagugaagaguuggccucuaguccuagcuccaguauuuaaugggcuugggaccuuuggcaaaucacuuuaccucuccaagccucauuauccucaucuggaaaauggggcuacaguccauuuuaaaagguguuggguagggugaaauaaaaucaugggucugaaaaguacccagccacagugccugggcuaagugggaacauaguaggugugaauucucucugggcuaggcucuggacaaaacaaccucuccuuguuuucuucuuuccuccuguaggucgcgucuaugauggcaagauguacacggggcugugcaacuucguggagaggugggaccagcucacccucucccagcgcaaggggcugaacuaucgguaucaccuggguuguaacugcaagguaagcucuggggucacugggggaaggaggggaggugcugacuugcagcccuagaaacaucagcucccaaugcacugggugccaggcccucggcugggaaggguaugcauguguuaggccagggcagaggggcaggucugagcagauauaguaaggauuguugccccagguggggcagugaggaaggcagggaaggaagaaugccuuucugcuguaaucggcugccuccaugaugaccacuuggaagcugcuggggcaugagggcucuugagucccuggccccaccuggcaguucaaggcuggagguauaggauccugacacuggcagguucucccaagugguuucaagugggcucacccugguagcugacucaucgcuaaccccaccccagguaggcaaaugggcccaggacugcagagaccagaugcuacagaaggucucucuuuaccaggcccaucccccugacccaaguauagggccaaggugcagccugccugcugugggaggaaguugggccauucucucacuucaucuucaaaacaguccugugugguuuuaauuacuaugaucuccauucugcagaugagagcucagagaacuuaaguaacuagcccuaggucccacaguucacugaaucugguuuccaaccuagggcagcuagacuccaaaguuuaugcucuaaccuuucuaauuccucgauucccuaaaacaacugagaucucccaccugagacgaaaaaguccucucaguagucuaauucugcuacuuacuggcugugugaccugcagcaaguuacuuaaccucucagagccuccuaaaacugugauaagaauuaaagagaauaauaucaaagcacuuaucagaaugucuguuagacagcagaugcucaagcuagugcuauuuauauuaugaucacugagggacugauguggcuaggcuucccaugcaguggccccagggucugaauccaggcucgguagccucaggccugggcauaccauggcagaguccaucaacugcugccuguuaucuaauugcagaucaaguccugcuacuaccugccuugcuuugugacuuccaagaacgagugucucuggaccgacaugcucuccaauuucgguuacccuggcuaccaguccaaacacuacgccugcauccggcagaagggcggcuacugcagcugguaccgaggaugggcccccccggauaaaagcaucaucaaugccacagaccccugagcgccagacccugccccaccucacuucccucccuucccgcugagcuucccuuggacacuaacucuucccagaugaugacaaugaaauuagugccuguuuucuugcaaauuuagcacuuggaacauuuaaagaaaggucuaugcugucauaugggguuuauugggaacuauccuccuggccccacccugccccuucuuuuugguuuugacaucauucauuuccaccugggaauuucuggugccaugccagaaagaaugaggaaccuguauuccucuucuucgugauaauauaaucucuauuuuuuuaggaaaacaaaaaugaaaaacuacuccauuugaggauuguaauucccaccccucuugcuucuuccccaccucaccaucucccagacccucuucccuuugcccuucuccuccaauacauaaaggacacagacaaggaacuugcugaaaggccaaccauuucaggaucagucaaaggcagcaagcagauagacucaaggugugugaaagauguuauacaccaggagcugccacugcaugucccaaccagacugugucugucugugucugcauguaagagugagggagggaaggaaggaacuacaagagagucggagaugaugcagcacacacacaauuccccagcccagugaugcuuguguugaccagauguuccugagucuggagcaagcacccaggccagaauaacagagcuuucuuaguuggugaagacuuaaacaucugccugaggucaggaggcaauuugccugccuuguacaaaagcucaggugaaagacugagaugaaugucuuuccucucccugccucccaccagacuuccuccuggaaaacgcuuugguagauuuggccaggagcuuucuuuuauguaaauuggauaaauacacacaccauacacuauccacagauauagccaaguagauuuggguagaggauacuauuuccagaauaguguuuagcucaccuagggggauauguuuguauacacauuugcauauacccacauggggacauaagcuaauuuuuuuacaggacacagaauucuguucaaugcuguuaaauaugccaauaguuuaaucucuucuauuuuguugucguugcuuguuugaagaaaaucaugacauuccaaguugacauuuuuuuuucauuuuaauuaaaauuugaaauucugaacaccgucagcacccucucuucccuaucaugggucaucugaccccuguccgucuccuugucccugcuucauguuugggggccuuucuuuaacugccuuccuggcuuagcucagauggcagaugagaguguagucaagggccugggcacaggagggagagcugcagaguguccugccugccuuggcuggagggacaccucuccuggguguggagacagcuugguucccuuucccuagcucccuggugggugaaugccaccuccugagauccucaccucuuggaauuaaaauuguuggucacuggggaaagccugaguuugcaaccaguuguaggguuucuguuguguuuuuuuuuuuuuuuuugaaauaaaacuauaauauaaauucuccuauuaaauaaaauuauuuuaaguuuuagugucaaaagugagaugcugagaguaggugauaauguauauuuuacagaguggggguuggcaggauggugacauugaacaugauugcucucugucucuuuuuucagcuuauggguauuuaucuucuauuaguauuuguaucuucaguucauuccacuuuaggaaacagagcugccaauugaaacagaagaagaaaaaaaaaaaaagcagcagacaacacacuguagagucuugcacacacacaagugcccaggcaaggugcuuggcagaaccgcagagugggaagagaguaccggcaucggguuuccuugggaucaauuucauuaccguguaccuuucccauuguggucaugccauuuggcagggggagaaugggaggcuuggccuucuuugugaggcagugugagcagaagcugaugccagcaugucacugguuuugaagggaugagcccagacuugauguuuugggauuguccuuauuuuaaccucaaggucucgcaugguggggccccugaccaaccuacacaaguucccucccacaaguggacaucagugucuucucugugaggcaucuggccauucgcacucccugguguggucagccucucucacacaaggaggaacuugggugaaggcugagugugaggcaccugaaguuucccugcggagucgauaaauuagcagaaccacauccccaucuguuaggccuuggugaggaggcccugggcaaagaagggucuuucgcaaagcgaugucagagggcgguuuugagcuuucuauaagcuauagcuuuguuuauuucacccguucacuuacuguauaauuuaaaaucauuuauguagcugagacacuucuguauuucaaucauaucaugaacauuuuauuuugcuaaaucuugugucauguguaggcuguaauauguguacauuguguuuaagagaaaaaugaaacccacaugccgccauuuuccugaaucaaauucugcaguggaauggagaggaaaauacuucuaggcaagcagcuagacuggugaauugggggaaauagaaggaacuaguaacugagacuccuccagccuccucccuauuggaaucccaauggcuccuggaguaggaaaaaaguuuaaacuacauucauguucuuguucugugucacucggcccuggguagucuaccauuuacuucaccccaaguccugcugcccauccaguugggaagccaugauuuuccuaagaauccagggccaugggagauacaauuccaaguucucgcuuccuccuuugggcaucucuucugccucccaaucaaggaagcuccaugcucaggcucucagcucucgggccagugcucugcucuguccaggguagguaauacugggagacuccugucuuuuacccuccccucguuccagaccugccucaugguggcaacaugguucuugaacaauuaaagaaacaaaugacuuuuuggaauagcccugucuagggcaaacuguggcccccaggagacacuacccuuccaugccccagaccucugucuugcaugugacaauugacaaucuggacuaccccaagauggcacccaaguguuuggcuucuggcuaccuaagguuaacaugucacuagaguauuuuuaugagagacaaacauuauaaaaaucugauggcaaaagcaaaacaaaauggaaaguaggggagguggaugugacaacaacuuccaaauuggcucuuuggaggcgagaggaaggggagaacuuggagaauaguuuuugcuuuggggguagaggcuucuuagauucucccagcauccgccuuucccuuuagccagucugcuguccugaaacccagaagugauggagagaaaccaacaagagaucucgaacccugucuagaaggaauguauuuguugcuaaauuucguagcacuguuuacaguuuuccuccauguuauuuaugaauuuuauauuccgugaauguauauugucuuguaauguugcauaauguucacuuuuuauaguguguccuuuauucuaaacaguaaagugguuuuauuucuaucacac

SEQ ID NO: 16348 - RNA, 61524 nt, Homo sapiens
gugugauagaaauaaaaccacuuuacuguuuagaauaaaggacacacuauaaaaagugaacauuaugcaacauuacaagacaauauacauucacggaauauaaaauucauaaauaacauggaggaaaacuguaaacagugcuacgaaauuuagcaacaaauacauuccuucuagacaggguucgagaucucuuguugguuucucuccaucacuucuggguuucaggacagcagacuggcuaaagggaaaggcggaugcugggagaaucuaagaagccucuacccccaaagcaaaaacuauucuccaaguucuccccuuccucucgccuccaaagagccaauuuggaaguuguugucacauccaccuccccuacuuuccauuuuguuuugcuuuugccaucagauuuuuauaauguuugucucucauaaaaauacucuagugacauguuaaccuuagguagccagaagccaaacacuugggugccaucuugggguaguccagauugucaauugucacaugcaagacagaggucuggggcauggaaggguagugucuccugggggccacaguuugcccuagacagggcuauuccaaaaagucauuuguuucuuuaauuguucaagaaccauguugccaccaugaggcaggucuggaacgaggggaggguaaaagacaggagucucccaguauuaccuacccuggacagagcagagcacuggcccgagagcugagagccugagcauggagcuuccuugauugggaggcagaagagaugcccaaaggaggaagcgagaacuuggaauuguaucucccauggcccuggauucuuaggaaaaucauggcuucccaacuggaugggcagcaggacuuggggugaaguaaaugguagacuacccagggccgagugacacagaacaagaacaugaauguaguuuaaacuuuuuuccuacuccaggagccauugggauuccaauagggaggaggcuggaggagucucaguuacuaguuccuucuauuucccccaauucaccagucuagcugcuugccuagaaguauuuuccucuccauuccacugcagaauuugauucaggaaaauggcggcauguggguuucauuuuucucuuaaacacaauguacacauauuacagccuacacaugacacaagauuuagcaaaauaaaauguucaugauaugauugaaauacagaagugucucagcuacauaaaugauuuuaaauuauacaguaagugaacgggugaaauaaacaaagcuauagcuuauagaaagcucaaaaccgcccucugacaucgcuuugcgaaagacccuucuuugcccagggccuccucaccaaggccuaacagauggggaugugguucugcuaauuuaucgacuccgcagggaaacuucaggugccucacacucagccuucacccaaguuccuccuugugugagagaggcugaccacaccagggagugcgaauggccagaugccucacagagaagacacugauguccacuugugggagggaacuuguguagguuggucaggggccccaccaugcgagaccuugagguuaaaauaaggacaaucccaaaacaucaagucugggcucaucccuucaaaaccagugacaugcuggcaucagcuucugcucacacugccucacaaagaaggccaagccucccauucucccccugccaaauggcaugaccacaaugggaaagguacacgguaaugaaauugaucccaaggaaacccgaugccgguacucucuucccacucugcgguucugccaagcaccuugccugggcacuugugugugugcaagacucuacaguguguugucugcugcuuuuuuuuuuuuucuucuucuguuucaauuggcagcucuguuuccuaaaguggaaugaacugaagauacaaauacuaauagaagauaaauacccauaagcugaaaaaagagacagagagcaaucauguucaaugucaccauccugccaacccccacucuguaaaauauacauuaucaccuacucucagcaucucacuuuugacacuaaaacuuaaaauaauuuuauuuaauaggagaauuuauauuauaguuuuauuucaaaaaaaaaaaaaaaaacacaacagaaacccuacaacugguugcaaacucaggcuuuccccagugaccaacaauuuuaauuccaagaggugaggaucucaggagguggcauucacccaccagggagcuagggaaagggaaccaagcugucuccacacccaggagaggugucccuccagccaaggcaggcaggacacucugcagcucucccuccugugcccaggcccuugacuacacucucaucugccaucugagcuaagccaggaaggcaguuaaagaaaggcccccaaacaugaagcagggacaaggagacggacaggggucagaugacccaugauagggaagagagggugcugacgguguucagaauuucaaauuuuaauuaaaaugaaaaaaaaaugucaacuuggaaugucaugauuuucuucaaacaagcaacgacaacaaaauagaagagauuaaacuauuggcauauuuaacagcauugaacagaauucuguguccuguaaaaaaauuagcuuauguccccauguggguauaugcaaauguguauacaaacauaucccccuaggugagcuaaacacuauucuggaaauaguauccucuacccaaaucuacuuggcuauaucuguggauaguguaugguguguguauuuauccaauuuacauaaaagaaagcuccuggccaaaucuaccaaagcguuuuccaggaggaagucuggugggaggcagggagaggaaagacauucaucucagucuuucaccugagcuuuuguacaaggcaggcaaauugccuccugaccucaggcagauguuuaagucuucaccaacuaagaaagcucuguuauucuggccugggugcuugcuccagacucaggaacaucuggucaacacaagcaucacugggcuggggaauugugugugugcugcaucaucuccgacucucuuguaguuccuuccuucccucccucacucuuacaugcagacacagacagacacagucugguugggacaugcaguggcagcuccugguguauaacaucuuucacacaccuugagucuaucugcuugcugccuuugacugauccugaaaugguuggccuuucagcaaguuccuugucuguguccuuuauguauuggaggagaagggcaaagggaagagggucugggagauggugagguggggaagaagcaagaggggugggaauuacaauccucaaauggaguaguuuuucauuuuuguuuuccuaaaaaaauagagauuauauuaucacgaagaagaggaauacagguuccucauucuuucuggcauggcaccagaaauucccagguggaaaugaaugaugucaaaaccaaaaagaaggggcaggguggggccaggaggauaguucccaauaaaccccauaugacagcauagaccuuucuuuaaauguuccaagugcuaaauuugcaagaaaacaggcacuaauuucauugucaucaucugggaagaguuaguguccaagggaagcucagcgggaagggagggaagugagguggggcagggucuggcgcucaggggucuguggcauugaugaugcuuuuauccgggggggcccauccucgguaccagcugcaguagccgcccuucugccggaugcaggcguaguguuuggacugguagccaggguaaccgaaauuggagagcaugucgguccagagacacucguucuuggaagucacaaagcaaggcagguaguagcaggacuugaucugcaauuagauaacaggcagcaguugauggacucugccaugguaugcccaggccugaggcuaccgagccuggauucagacccuggggccacugcaugggaagccuagccacaucagucccucagugaucauaauauaaauagcacuagcuugagcaucugcugucuaacagacauucugauaagugcuuugauauuauucucuuuaauucuuaucacaguuuuaggaggcucugagagguuaaguaacuugcugcaggucacacagccaguaaguagcagaauuagacuacugagaggacuuuuucgucucaggugggagaucucaguuguuuuagggaaucgaggaauuagaaagguuagagcauaaacuuuggagucuagcugcccuagguuggaaaccagauucagugaacugugggaccuagggcuaguuacuuaaguucucugagcucucaucugcagaauggagaucauaguaauuaaaaccacacaggacuguuuugaagaugaagugagagaauggcccaacuuccucccacagcaggcaggcugcaccuuggcccuauacuugggucagggggaugggccugguaaagagagaccuucuguagcaucuggucucugcaguccugggcccauuugccuaccuggggugggguuagcgaugagucagcuaccagggugagcccacuugaaaccacuugggagaaccugccagugucaggauccuauaccuccagccuugaacugccagguggggccagggacucaagagcccucaugccccagcagcuuccaaguggucaucauggaggcagccgauuacagcagaaaggcauucuuccuucccugccuuccucacugccccaccuggggcaacaauccuuacuauaucugcucagaccugccccucugcccuggccuaacacaugcauacccuucccagccgagggccuggcacccagugcauugggagcugauguuucuagggcugcaagucagcaccuccccuccuucccccagugaccccagagcuuaccuugcaguuacaacccaggugauaccgauaguucagccccuugcgcugggagagggugagcuggucccaccucuccacgaaguugcacagccccguguacaucuugccaucauagacgcgaccuacaggaggaaagaagaaaacaaggagagguuguuuuguccagagccuagcccagagagaauucacaccuacuauguucccacuuagcccaggcacuguggcuggguacuuuucagacccaugauuuuauuucacccuacccaacaccuuuuaaaauggacuguagccccauuuuccagaugaggauaaugaggcuuggagagguaaagugauuugccaaaggucccaagcccauuaaauacuggagcuaggacuagaggccaacucuucacucccuuuauaaugauuuuuguuuuuguuuucuccuuuacuacacugacugccuaaagaugaauaacuuucaaagacgggccuaacaggucgagugugagguggagaggaacagauacucccuuuuuauuuacaguaaaguugagaagcuacaaauuaggagauuuccucccccaggugagugguggagcuaauuccaaaguccagccuaaguguaggagccucaagcuccuagcacuggguaagugggaugaauucaacauuagagacuccuuacaauuuacuggacauuuggugagucaacuacuccguauguguucuucugaagucaagaaacaguggaccuuggccaaacccuggccuagaagcuagaguuggccauuaccugucagcagguacugguacuuguugaccuccagcuuaaggccacagagacucucggaagcuuccguauggauguacugcacauggggcaucuuggugaagccucgguacaucugugggcaaaaggaacaucaugacuucuucuuucccaguuuggacacccguaugaucccuaaucccacugcuggguauguauccaaaggaaaggaaaucggaauauggaagaggggucugcacucucauguugacugcagcaauauucacaauagccaagauaugaaaucaaccuaagugcccaucaacagaugaauggauagacaaaaccugguaucuauacccaauggaauaugauucauccagaaaaaagaaugaaaucuugucauuuguggcaaugcagcuggaacuggaggucguuuugcuaagcggaauaagccaggcacagaaagacaaauacaccauguucucacucaugugggagcuaagaaaguaaaucucauaaagauggacaguggauuggugguuaccagaggcaagaaagguaauaaggauuggggcaaagagauauaauuaauggguacaaaaauacgaguacgcagaacaaguaagacccaguguucauugaaucaguagaaugacuacaguaaacaauaacuuauuguauaucucaaaguagcuaguagaggauaauucagauguucccagcaugaagaaacgauaaauguuuaagguuaugaauaucccaauuacccugauuugauuacuauacauuuuugaauauaucaaaauaccacauggacucucaaaauauguccauuuauuauguaucaauaaaauaagaggaacacaggagaggagucucaguacccagaaggcuugcugacauuggaucugagggaaucucgcuccccuauucagcuguccaguggccggucacugaucuacccaccccagggcccccuucaccccagaugaagccaccgauccucuugacuagccagguuggugccuucccagagaaaccuuccugugcagccagccauaccccccauuccaacugccccacaacacuccuucggcuacacaugucugacaucccagcaccuuuucagaaauccagagaaguagcugugacaaagguccuuuuucuuugucaaccuuaggaccugagucccgugaacucagccagcauucucaugauaucucugugacacuuuccagcccacaaaaacauucucacucacauucuccuugcaguauccuuaaaagagcccugggagggauguauuacaaaccccacuuuauagaaauucuauuuggcuggugaacguugaauucaagcuagaaauucuccauguuuuuuauucuucugagcgucuggugaaagcauuggguucguuuaucccagaugaagcacauaaauguaucuacaaaguucaaagaguuuuaacuguuaaauacuuuauaauuguuagauugaaccacgugaaauugcugauauuuggcuauuuguaucuacgacauaaucuaauacagugguucucaacuggaggcaauuuugccccccuaggaaauauuugggacauguggcaaugucuggagacaauuuugguugucacaacaguucguagaggguagggagguugcuaaacaucccauaauacucaggacagcccccagaacaaagaauuauccggccccaaaugucaaugguacugagguugagaaaucuccuuuaauauuagcccacgaaucaccaugacaacccuaugagguaggaacuauuaugcccauuuuauagaugaggagccugagucacaggcaggcuaaguagcuuguuaaggccacacaguugggaaauggcagggcuaggauuccaagcagaggacucugccuucagaguccauacucuuacccauuaucuuagacuggcucccaggaaagccucagaagucuaugaccaagguccccagaagcaggcaaaugcuauuuccauuuauggccacugugccuccuucagaggcacagugugugcccagagucacuggggugaaugaauguaacagaagcugaguccgcuuugugauuccaggucaaguccaugaguauuacacaagcccagugugccaaggcgauacugugaacugugagauuugguaacgggggcgguggggcaccaagguguugcacaauucuguuauccccucaguucucagcguacacaagcccuggacugcugguggucucugggcuugucccaaggguuuauaauaggaaaaugccucuacuuuacuuccuggcauuugguauuaauuuaccuacaguaauuaauacaaagccagacaucucuucauuggugucucuucuaaaugccucccauuuggccugugagcuggcguuuucucaucuuuuaaguggugacugguuggcggggguaggugguccacaagaccuucauagcauaacuuggucuguuggaccuacugaguuugggcgccccugccuuguuaaaagcacacauuguucugauggacucagauggucuuccuucugaaccucucuucucccccaaggcuugccaacugagcacgguaacgcagccaagugcuggaagaagugccguccacacucagcauucaauuacgcggugggggcgcgggguggguagagucacgaugaugacuucuucuaugugaauggugccucucuagccuuaacaggaaccauguuuaagcgugcugcuguaugccugccauggaguguggccuucgaagaacauccccuacccugacuucugugccgagcaacuucuuauuuuuguguggguguuccuugagguuuuggcaaauguuucaacuaagcacucgcucuaggucuuuuggacccagcccaugggaaccucauuccuucugcgucagucuuuccccuugacugcccuagugcuucgugggugagagaaugaagccccugguuacagucuggucauuugaacugcucaguaagaacucaacucaucgaaaucagcuuggcaccgcagcuacuuggaaguuugaaggaaccugcauuuuagcuccuagcacuugccuagagucgaaauucugacacauuacaaaugacuggcucugacaaacauagcgcuguguuuuagggucaauucugaaaagaacaacauggcaaagguagauucuacucaguuguguuuucuguguaauaauccuaccuugauuuaaauauugauucuaaaaguaucaugucuguaaucauagagaucuagaauugguuugacaaauuuaggagaguuauaauagguuuauaauguccugacaucagagaauccuagaaucucagaguuggaaaagauguuaaagguaaucuaauccaaaccaaugccauggagaucagugguaaauucagguuuuggaggcugacagccagaguuugaaucuucaaucuucucugccaccuguguucgccacuuggaaaguuacuuaaccucuuugggucucaguuucuucaucuguaaaaugggucaaagcacuucuuaggguguuugagagaagcaaaugacuuagaauagcagucagcccacaacauucaauaaaaguuagcuuagaacaaguuauacugaaauucguaaggagaggaggaaugaguuugguccccuuucuccuaagucccuuccucagcucuuaacaagaguaguuaaagcugguuuagaacuucagacauaaguggguuguucuuuuucagcuggguucugcaugccucugggccccucuucuucuucuugguagcaucuacacaaaguuccaagauguuagcuucccuuggagugaagggacaaauaaaguaaaaaagaaguuucugagucuggggacauuugcauauuucuuaugaaaugucuggccuucacucuacauugacagcaugaguugccucaaugauuccaacuaugucuugcaugccuaccaaagaucaacacuguucuggaugcugguguacaucacggacucauuuaaacccacaaauucuuauuuacagaccgaccgagcuaucacggccaugaucuuucucuauacagcaauuugucuagcaggacaggcagagaauguagaaauggagccagucucugcagagggcuggaugagaguccuaaggcaggaagaaccacgggcauugcaagaagaaugguucccugugggcugggggucaaagaugcuuccagcuagagcuucaaaggcgagacccugcuauugcucauuugguuagacaaaccacuaaaggaaggaagucccuggaggucugcucugccuacagucaggacaugcaaagcacaugaccagcgggucuccccaugggacccucccaggaccagcugggacauaaugucccccacguucuguccccugcagccagcuggagagcaugucuccgcuacauaaacaauaacuccuggcacaguggaucgguuucucaugguccugaugggagauaagguccccacagcuuagagcagccaguucuggaaacuuucaccuucaccccacagcccagcuaauuuccaaguuugggauugcaauaagcucucucaacauucuaacacccugcucccucacacacacacacauaucgcaggucucuguguacugaaguguuccugagagaugggucagaggcuccagaguuagcagacgggagaaggucugccugccuuccaucagugagagaagagagaggucagacagggcggcucggagucucagguucuccaaguuccuuuaguccugcucuaaggaagcccuugcucaccccuucugacucucuaggguagacugucuaaucugcuagaacaaagucucccagggaccagugccaaaacucaugcaggcuugccucucuggccucucucucuucccuccuacaaagauuuuucugauacacccuuugcaggauauuacaaguccagcccuacacugcuggaugauaaaccaacaaacccaaacugaccucuuuuuguucccugggaacuaaaaacauauggagugggcauuuauauaccccaaaguggguaggaaugaugaaucagccugcugcuccauacuguauuaucuccuuauaggcaaagacccuguaguuuugcucagguuugccacuuuguggccauauaaucuuaacaguuauaugaccucccaggucucaguugccucaccugucaaacagaggacaagguguuaucuauuuuacaguguuaguauaaguacugaucuaugcaaagaccuagcagaaugccuggcacuaagcaauugcucaguaaauguuaacugaugccaagucuuaucauaauuauaagcaguguuaucuuuguauccccaguucauaguacaguacuaagcacagagagagggugggaaggaagcacgagaggauggauggacggacuauuacuucuagccuguaucuugucugacuugcaggcugguaccuagagacaagcagauuccaguggugucucuggauagaagggcacugaccaguucuauggaucaugauacccucuauggagggucagagugaaugaaaggcaugagauggugacugaugauuaagauggcagggagauuugggagucauauaaagaacacaggauugggaagaaauuccgaugccucagcuuggggaucagaucugcccuuaguuaaaugcuugacucugaguaagucauuuccccuuugcgccucugucagaaguaagacgagggauccuacaucuaauucccagcaccaugauucaugagcucaggcgaaggauggugaaccgaaagccuaagcccaccagucugggagugggagugugucuucuaagcccaccagccugggagugggagugucugaugcugauaggcuagcaaguguuguuuggucucuaaacaaccacccguggcuggucugacaccagcaagggggaaugggacauuauguccacaggaagggccucuggucacccuggucuccaggcccugaugguaggaaggaaaccaggcaggcuuaggaacugcugccucccagcuauuucccucucagcucucugcugaccaccgagugucucguaaugaggauuguuccagaccaggcagguucguguguuuucugaaccucugcuuuggucuaauaugcuuuggcauucccgcgcugucugccagagguugcaaagugggcuuuuugcguuguuguugcucuugcugguuccccaccccugcccauuuuucucuccccagggcugucugaagacauaagcuggucucaugaccaagcuuaggcagccaagggcaacuggccagggcugacucuggacauuacauaaccagaaggcuguggauguuugcaaaauugaauccaaagcaacagguuccacaaaauuaguacauccagccucaggacacaggaauaagaaagccuggagguuggccuuggggaugguuggguaccaccgugggcugcgucacuccuccacucccuucuaccuggacauugcggcuugucuccucuggggaguuuccaggccuguggggucucacccucaugcccguauuagacagauaagcauucaccaagucacuuuugcaugccagguccuacccuaauugcuagggaugcaaauaugagcaauaaguuaaagggcuggacaguuccuguggaccucagcacaccccacauugaacuucugaugagucacacacauaccugccucuucucucccaaccugacucuaguuccuaaagauggaaacuguaucucccucacggccucccuggcuccuagcugggagcucugcauguagagaggugcuuacaaagauggggugaugaaccaguugcugaguuauucaaggugaagccccagucuucugugcuaaggcaaucaccaguacacccuuccauuguauaccacccgcuccuccuuacaaguaacauggcccgcaucccagggugcuuagaaugccugagcuagagaggauguuaggagcaccaagcccaaccccacacuguuaacagguggcaaaacugcggcccaggaaaagggacaagcccaagguaagcaggcuauuuaggaguagaggugagacuaggaggcagguucucuagauuucaaaucugguguucuuuuucuuaagggcauaccuccuuccuguacuucaugauguucauauccucaguaauauguuuaaugauaagaauaugcuuagcaaacauugcuaacuaucuaggaugcaagaagacaaucagcugggaaaauagggaaagaaggugaaguuccugccuugggaugagguuccugugaucagcacaguuuccauguaaagauuugagggcuguaaaccuaagcuguaaccucaguggcugcaugaaaccuguaagcacuguugagucccagauagucagagcucagaagaguucauagagaugaucuaguccaacccccucauuucacaauugggaagauuaaagcccagagaggggcagugacuugaccaaggucucaugguuacgagcuaacaaggcuaucugccaucuggcuccagagcucagcuuccuaacaagugccuuggagugacuccaccugcaugggcucuuggacaaggcagccccaugcccccucccuacccaucccuuuaugcagccuuagcagcucccucuccagcaggcagaagggcugggucuggcuggugcuuagacacacaccccaguuccaacccacuuugccucccuuagccaggacucuucuggcaaaaacccaaaaaccuucccggagccagggugaugacauuaccuaccuucaucugcuugaugguguagaccagcgugccgaagggccccuccuuuaccagcuucuuccccaccaccuuggcccggaucacugcagagacagaaggagacaauaagagguuaggaaggccugaaccacaucaggaacagcaucucagggcgggcacgcuagccucuguggagccuggaauugcacucuuaccuuggagccaacuggaauagaugauuguguuuacaagagugggaauucccuggggugagagggagguuggaggaaaaagaaacagccaccauucaaguuaauuaccccaaauauucacaauugccagcuccagaacuuccaaggcuauagucaacccccgccgacccugaggauuuucuugacuuugugacuuuaccauaauccaaaaccuacuucuccuguuagagccauuguccccccucccuuguccaucugacaaugccauggucucccagaucuguucucuuuccacuaggaccccuuucuaaccaccucauuuggggcucuuccuuugcaugcauuaauucaccacaucuugacaugucuacaggguuguggugcacccuagcuucccacagugcccccaguuagcauucugauugagcccuugguauccagugcuuagauagcaagggaugcaauagagucugagcucuauggggaugugguuagaagaaggagcaauugggagucggggcucaggagccagacagaacuguuccaaucucagcucugcuguuuauggcuauugcgacuguaugcaaguaaguaacuuuguuucuggccuccucuucuauaaaacaggaaucauaaugauacuaaucucuugaacugaagggauuagucaagaugacaaaugugaaacucuugauacugucuuggacauaguuugcacuagacaaauauuauuaauaucaucaucauuaucaucaccaaaaaugaaaugggcuaaccauggaagggcuguuccaaugaaaacagcucccauuuauugcacaccuacuaugugccauguacauuucacuuauuuacugcucuuaacugucuuacaagggcaguauuagcauccacaugaucuagauaagguaacagaccaagaagugaaaccacuuccucuuucugagccucaauuuucucaucuauaaagaggguauaacucucuuuacaucagggaauuggaaucaggauugaacgaaagaucuuaugaaauuucccacuacaaugucuggcagaaaggauuuacccaguagauacuaguuaacuaugaauacaaaaguaauuacacccaguggguugagggcugaaagagaggcauuuaccacaugcacugggaacagaaagaggagaggacuugacuuuuagauucuacaagguugugcuucucuuucuacguugugugaaaaagaagcacccaagagcugucuucagguauuuguaaaauuggcacauggaggagcaaauggacaggucuugaauaccaaaacuggaaauugcagagaguaacauucauuggcucaaccaaagaaaaaaaucgucuaauaauaagaaccagcaacaaaaggcaggggggcugccauuagggcagagagugccucuaucagggggugugaugagggugcuggauacuuccaugcuaagaccucaacaggaauuggaauggggcuugcuuaugcagucauacuuugaauuacaaauugaacuccuucagcccugagauccuaucaaucuuucuuaucucaaguugcacuuagcccaaaaaggaguagauacucaauaaaugcuuguuaaguaaaauacccuucacacacacaaacacaaacacacacacacacauuuugguagcuccauuauccuuccucauuguggaugcuccacuauguaucccaguuauuugacucuaaucucuguuuuuaaaaaaucuuuacuaagaacugauuccucauccauacuggauucugucuuguuucuuuccaaaugagcuuggauccuacccuugcagucagacaugaagucaggguucagaugaaucaauggccccuucagaccuucccugccggcgauggcaaaacacacagucauuggcaaagugagcaauuuagcggaggcagcucaaauuaggaggaggcgagugguuguuuccaagucugcuguaaaaacgagagguuggcaagaucccaggccaaugucugucaagauccugcauccaccucuguuucuaacauugcgguaguauucucggcgacaagccagccucccggaggccccggggacuguuuccuccauauuaacucucacaggcagguuauaacagcuucaccuccgugcagaggcaugucugccagccuuuaccacugauucuuccugaaaugauuuggacccaucuucucugccucauuaacacagaagguaaacaagggagcgagucuuggccggggggugugggaggggcaaggcaaaagggauuccuuuaaauagcaacauccugguucaaaaauggcuugacuugauuuagacagaagaugucacaagcagaccugccccauaaagcugaguacugcuggaagcuucugcacauacaaccagccaacuccuuccuuaccccaaauagccugagcuuggaaccuuuucaucugaggauaguucagugaaaagaauacguuuuuguagucaggaagcugcauugaaguuuggguuccaccauuacuguaugaucucucuggggcucuuuccuccugaaucucucuggcuuucuuagcccagugccucucauguggcuaacaagugauuugcuuauuacuauuggagcagcaacauagcauugcauuaaagagccuggucucuggagccugagagccaggguucaaaucccagcccuggugcugggugaccuucaggaaguugcuaaaccucucuaugccuugguuucccaaucuguaagaugggaaugaugaaacaaugccucauaaaguugcugugagggucguauuaauauaagcgcugagaacaguauguaguccaucccaaaccucauguguuugcuaccacuguuauuagcauuaucaccacuauggugaugucuauuuuuauuccaucuuagggcauaccaucuucagacuucuaacaugcacuguaagcuaaggccugggaguucucccuaggaugagaagaaaggcaaccucauaaaaauauucuagccuuacagaacuucagggagagguggagaagcacagaugaaguagucagaacaaguauaggagguauuuugggaucaggagugccuacucuaucacauguacccaucccaccuuaucacccauguguaacccaagaauugccuacuaagaccagccaaacaagaucacagucaugguuccaaaagucugaggcagagauggcccagugaagaggccacaucaguguuuuccuuacaaaaacaaaacuucacuaaacugaacuaaaauuaaguuacauucugcccuccaaauagauucucaaaguccuuccaaaguagaauugcuggccaaccccagauccaccuauuugguuugugcauuaaucuguccguauuugcuccaguuucuccucuguaauucaaaugugugcuauuuuguacucuccuguuuggcaaucaggguucucccgaggcauucgcuggcccaggggccacagggaacaagggaaguggggugggaggagguugugcuuuuccaacaacagaagacacuuuucaaacugguaacuggcagcaugucuagccauuccuuccaccuuguugugguggcuagaagccagcuuuacagaugggccaggcuggacacagguugucuuuauucccauucaugcuggaguauggccccuacacugucuacccagugcccccaacaaucaaaccaacauaggcaugaacuagguuggugucuggaacauuggguugggugcuggugagggugacaacaagaaauagaaguccuauuucccgcuuccacugauggcuagucuaguggggagauaagguuuaaaaguuuauggcuggccggguguggaggcucaccacuguaaucccagcacuuugggaggcugaggugggcagaucacgaggucaagagauugagaccauccuggccagcauggugaaaccccaucucuacuaaaauacaaaaauuagcugggcauggggccgccuguagucccagcuacuugggaggcugaggcaggagaaucacuugaacccaggagguggagguugcagugagccgagauugcaucaccguacuccagccuggaaacagagcgagauuccaucucaaaaaaaaaaaguuuauggcuagaggacuagucuccaagguacagaagcaccaaucagagaagggagaggugaggcucagugugaaucucagccucugagccucucuugucucucuagaauuucuuuugcucuuaggaagagaaucugggcuucuagggaucugguggucaaaagaagcaaggaagaggcugggugugguggcacaugccuauaaucucaucacuuugggaggccaaggcaggaggaucacuugagcucaggaguuccagaccagccugggcaacacagugagaccuugucucuauaaaaaauaaaaaauuauaaaaauuuaaaacaauuagccaggcauggugccguguaucuguagucucagcuacucaggaggcugaggugggaggauugcuugagcccaggaguucgaggcuacagugagcuauaucucaugccauuacacuccagccugggugacagagcaagacucugucucagcaaaaaaaaaaaaggaagaagaagaaacaaggaagagauugauuaaggaauaagcaguauuucaauguaaaaguaucuaagaagaaacuaacuaggaugugugaacuuauauaaugggcacauugaucuauaaauauauauggggcccucuugaauauaucaugcgccugagaagccaggcauagaggcauauaucucuauugaacugucuuugcuuccuuugaauauuuguuugggcaagagugcuaguaagagcuuacaaaagcaaggcaaacaaggcacaccucuuccauaaauauaccuucaugcugccucuccccaccuccagcucuagcaguauggaccacaguggcacaaguuuugaacaaagaacaauuuuccaauggcaauugggauugaguuuccagaaaagcuuacuggugugucuccagaaauugcacaugugcuguucaucagcauaaacagaguggggcaagauacccuugagcugcccucccucucucucucugcuucuaucccccauccaaccauugucaaccaaauccagacccuucuuccccgaccuaaugguuggacuuuccuacuggcagacuagaaggccgagcaacaaugcuacccauuuggcuggucuggggaucaaggacuccuuaacuaauuaauguauacuaacuuaggaguccagguuccacccaugguagcaucaacggaagagcaguacaaauccucuccaugacuuaggaguugauucaugcuaucuagcaggugagauaccaccgccaccccacacacacacacaacacccccauuccugucucuccaaagaccccauagaaugauuuugcugcuuuaaggcaugguuuuuaaaaggacagcaaggauaaguaagggacgucugguuaguggguagacugcauuucuucaaaugcagaagucacuguuagugucagucccagggaaggggcugcucuucugaugggaccccagcaggcaggcucuagguaggaagaaaagccuggaccaugggcucgcaucuucggccuagacuuggaggaaaagagggaucuggaaguguuggaaugaugcccuacccaugaaaacacaccaaaaaggaggaaagagggaucccugucacccagcuugucucacggccccuucguguguauuuuaucaucucccacaggaugacaaagggagcggccuugcugaggccggagugcucauggcaaaggcaauaggucagggacccacagggaggucggccuggagcccgccaagcaagccuuuuuccugcccaccuuggacacucuacaauguagccugcccaaggagggcagagccaggcucucucacucuuccagcugcucacccauucaagaauuacaaacugcuugcuuuucuuagcaucacauuagugaaucuagaggagaaggaagggaacuagaacauacugauaacaaccacuaccauuuaucgaaugccucuuaggugccaagcaacgugugcauguucuuuaacucuguccucauggcaagcugguaagguggcuacuguuguggcuguuaaugucccuacuuuccaacuguggacaaugaggaucagguagccuguaagcaguuuugcauccuagugggggaaaaaaaaaaaugggaggucccccaggacagcagaccaccuaaaaaccuuuacaugggauuucacacugguugcaaaauaguucauaauuuuacugcauuccccacuuucacugcagaggaucagagaagaagauugauaccuaaaaggaaggacccuugauaagcucccagugagccccacaucccuuugaucacccacccaccacccuucccaaucacuuacacagacacacaaacacauguccucugauuaguaauaaaaaucuagaagucaucgccaucagcaguauaacaguauaucguaucaucuguuuagaccuuugugcuccccggcaaggcuuucauggaauaaaaacaaauaacuuagaaaccacaaaaccacaggcucccuaaggguucucccaacacaggaaguuugaaguuaauuagauugauuaauuaaaugagacaauguauauguacaaagguacuuuguaacccugaagcuagacaaaugauacacuguuauauugcugauggugaugacuuguagauucuuaaauuuacuaaucagaggaaaacagcaagaggaacccgaaagauucuugugauucagcauuuccucauccccccaggaucuugagaaccuuccucagugacccuucccaagguccuucucagauaucugcugccucucuggggaugcuuugaugaugucuaggugagaggaaagggccuucggaacuaagggugaaaagcagaggccugaggggccugccuggacugggucccucugauucccagccuauugaucaccacaaucccaacucccaaaaaaacccuccugaaagacucagaagcugaaaggacagaucaagaaaacuggagaagugaucacggcguacuggaaugaaaaacaggcauggagcacguggggucugggugaagucgcugcccuguuucucugugaccuugggcaagucacuucccaucccagcagauaaauugugggugauaauuaccagccuccaaaggugccugcaauaaccuaggcagccuccccccuaaccucuccaaagcagugcuugucgaagucacccaugaccuucuuggugcucaguccggucaucgaggugcaggcucgugguccugcuauguucuuccagcuugugggucucagcaccaucugcacaacugacagcucccacgcuuuugccaccgccaaccuagaacucucaugaacuuuuuuuuuaaacaaauuguauuuuuauuuuaaguucugggguacaugugcaggaugugcaggcuuguuacaaagguaaacauguaccauagugauuugcugcaccuaucaacccaucacugagguauuaagccgagugugcauuagcuauuuuuccuaaugcucucccuccccuaccccacccaccaacaggccccaguguauguuguuccccucccugaugaucuuuuuacuuauauaucccagagucuacauuuagucuacauuuauaccugcaagccuaauaaaacaucucaaauucgacccauccaacacugagcuccagauaacaggccuucccugcacccggggcucucauggccuucuuaaucucaggaaauuguagcucacucuacugcacacccuagcacccaagcaugcucucagggucucugaccuugcaguucccucugcuggaacacucuuucuucacuugggcgggggaccuucccugauccugauccaugcacauuccucccccuccucgcaaucccuuggccccugacacugugcucuaucagacacuggccaccaucugacauuauacauuaacuugcuucuuuacugaucaucucuccccauuaaaauguaagccuccccgggcagcagguucuuugcuuuaccuauugcuguagccaaagcugcccgaagagugccuggcacauaacaggcaccucauauguauuugcugaauaugggaagcuacgugugauuucuuguauaaagugccacacacagagugauuuaaaaacagauaaauaauuccugugcaagcucugucaaaugaccagucuuucuaagucuuauucaaucaaaaggggguaacagcaauucucgguucacagggucagauacacaacucuucagcaaccaggaagguguuucaguauugugaagacguauacagggauagagagauacauaaggcuccuaggaacucaagggccagaggugagagagaccagcaaugacacucaaguaaggcaggcucagcaauauaagcaaggacggaaagccaggacagagccaagaagagaugaaguccaucucaggggaggggugucagggaaucgcccuggagauggcaucagaucugagccucagcccauccugcagaagagacucaguuugcugcgucugaauccagaggaggaagaagucuggaucugaucuggguggggggcggagggggcggcgguaaggagagcagcuggaagugaggcagaaucacagccgggcucugagcaaagccagagccgaucucccgccuuuccaggaagaugaugaccccccucccacugcaagagcaugggggcugggggcuggggguggggagcggcgagcagccugagugaagaggaacucucucucuucagagaagucccacaaauaggcuuuuccugcauccuacccuggucccccagggcccuucucucuuguccguuucaaaggcccuuuucguugaugucaacgccaaggccagaccguuaacaugcacuccccaucaagauaaggagucccaguucaaagccuguccugacuaacucuuuccguuaaguaaaaauauuaaucuugguuuuauuuaagcagguuuuuuuggcaagaaaugaaugccuguggcuaaaaauaaacccaaagacacacacucagaaaaucuggaaagcugcaaaucauuucaacccaaguuuccaucucagggaaagcuauuaaaccuggaggauaugaaaaccucccugcccagagauuccuguuucucaguaccugccuuguguuccgggguccccagggcaggucuguccuggggaugcccuguccuggaccucccggggaaggggaggaggggccuuugugagcuccuggcucuccucaccuugugagcaggauggguuucugcuugagcggucugggaaaaacucagggccccugcugacgucuguuguagaugaaaugaaggggccgggaaggggaggcaaggaaacacaggcuuaggaaggucaggcuuccuggaacuuugagauuacccaaaagaacacaacacaaaauuagcaucccaugcuggccuucauguguuaaggggcaaccucaguuuuacacaaugaaaugacaaaauuuaagagucgcuccuucuagguauaugccuggacuugggaugaaugcauuugauguuuaaucuaacugcuuaaagucagccacucuugauuucuuccuggggccaccagcaauuuggaagaaagguacagauaccuuggccugggacagggcaaaaguccuagggcuggcugauuccuggauucagggccgacuuaccuggggagggaggacugugaaucucagaagggugaugguguuucugugaccuggguuucuaaggguccaaugaggcgacuaccucaaaguguucaccaagcaugauuagaaucccugaggcuuuuacucugcaaauggcugucaggugggaaaugucaaagccccaaaggauagacagugggaaacacaguccuucuccccuaagucccccacauucucccaggaacaaaugggauccacaacccucauuuacauccucaccuacaccucccuuggguuugcaguaucuacaggauuauucugcauagcucgguggcauauauauggcucuucagagcugggaccauaccucaaacccuaucacucugaagcuuccagcccccaucacuauaugaaccuguccuaugaugccccuugccuaggugagaaucacuuccucccugugcaucugccugcaccuuuggcuuccugcaagacccacccagcugaaaugcuaccuccuccaggaagccuucuguccaccccaggccaagcuaguccaccucucuucugcuuggcuuuccucucuuucuuccagcacguguucuuuaaugauugguuccuuggacacucacuagcaucgcuaauuaccggauggcagggacugcaucugggacuccagcacauggcauagagccuagauuguggccaggguucccaaaaauguugaaugaaugaaugaaugaggcugugggagggaaccaaagguaauacaauaacgaagacggggaugguuuuguguuuggcuuccuggagugcugggucaggaguccuuguuccauagaguuacucagaaaaggaagggacaaguaaaaaugugaucuggagaggccgaauaccgacauuguuccaaaauauugaagacugaccuccaaaaagaggcaagucacaggacccuauuacaggagacccccaugaacuuguugaugugucuguggaaggacagcacccaaaagcuaccaacacaugaagaucccaaggcucagcacccucaaggaagucaguggugacaccaaaauuagccccagggagucuccacccaaggcacuccuugcuagaccugcugacuccucugcaggcccucuggccuccagcugccccucuuccuugugguagcacucaggaaauaugaagagcauggcaggcuguuuauccaggccccaucuccagguccugugucccucucugccauaguguuuauuguuuguuuuauuuugccacccccccuccuucuccucaaguccacuugaaauucauugauucacucaucugauauuuauucagaaguauuugaggaacuaugcaucucagauccugugccaugucuuggggauucaguaauaagcaggcagacaagguuccuaccuuuaagaagcuuauuuuacucuugugagacaagaagacagggaguuauaguccagggagccacaggagcaugcagcagacacacccagccagccuggaggcgccggagggagacauccugccugagcugggaucagagaaucacuagagacaguuaagagaaagagaaaggagaggaccuucuggucaugguugggcagaggcccggaggcuggagaguccagcccauuggagagacagaaaacagagaguccaacaaaguacaggggugccuugcagugggcgguaacucccagcuugguagguugggucuugcuccaacaugggacagugccauuucuuaggugggcuucuacucccugaggcuagugauaaagacuuaucacucugucacugcccauagacuuuaggauugcauguauccaaauggguguccaaacaguccauugacaggaggcccccgaagccccaagaaaccccuagaaacaagccugggucuuugcaucagaaccacaaaugaucucauuccagugcacaucccauuucuaaucuucaacguuaguauuucaugcaucucugucucccgccguacccugucuccccucaagcccuuucaccucuuggagugguuucgcccuggguguuuuggcugggcaucugugcugugcucugaggagacaucaaguuuaagggggcaugcugaccucucaaaagcucaagcccacucaggggucagaggcgccgacuugcuuacugccaugcaagugcacucggugaggggggcugagaccacccccuauccccugagagugcuccagccucuccacgggggcccaugggaaacuuuaucccacacaaguggccaccagaauagcagcauggucuucaaccacagccccuuugaagcagugcccagaaaaauaccaugcccucaaacgguucucagaacuuccagcuuucaggucggggcauuuuugaagcccaaacagcuggcaacaucucaggagccaucuauagcauuuuauuuuucuccuaauugggauuuuguuugcuaggagagcugagggacucugggauaggccuaggagcaaguccaccauuagccaaagaaccacccuccuuugcacgccagacccgcagaugcagccuuugcagacagcaaaucuguucccagaaugcaccaggagugggcaggagacuuucuugugguuugaacaagagccaauggcugcucugucuauggauuuuauacagcacagaugccaaggagacccugguacaucuauaacuuacccuucauguggcuuuuaaaauaguguaggcuuuccucaccuuuaaguuccacaagcuucauucuguaagguuguggacacccagggccauaguuuggaaggcccaccugcugcagcggguguuccccuacucacucagcaccucccuuccagcucacaaccacaucacucacauagugggcacucagguaggaacagguacgagaaaaacgagcccauacauaggucuucaagcccuaagaccauuaucaggaaucaauagcacugaaggugcggaggaaugauuaaagagaagauccaaauccuuuuaaggaaaccuucauuuuaaauaaaauaaauaaguaaagaaugcuaacugcugcccucuuuggucaaaguggguaauggcagaacuauaaagccaaccucugguauuucugaaccaccugcccuggccuugaagugugacagggagauggagucauugauaaagaaggagaagaccaacuacucuaugaacaucgugucugugcaaucauggugccuaaaccucuuauucauucaguaaauauucacugagcacuuacuaugugccaggcauugugucagguggcagaaacagaaaagugaacaagacagacacacuuuacaaacaguacaucuuacucuuaaaaccauuccccaaaauguguagcuuuauuuccacugaguauaggaagaaaacaagucucaggauaguuaagaaacuugucagaagucacacagcuaggaauccaaauaugcccagcagcaaagcucaucuucuuucuacuacuaaauauuuaacaaaucugaaacaccccaccaagucaaaugcauuggaaaugcggagauagggaaaauucccaagacugaauuaugagagaagggcuuguauaaguuacagauggugagaacuuugagguggaguuaacucuccauaacucuuguaaugucuaagaaucucauccaauggugaagucuggauucaaaucuccacuuacaagcugggugggccccagggcucucaaugccagauugaggguaccuuggcuugcagacaaagggcaggaagagagaaguccaguaacugaccugaagcccccugguuugaagacagggagcucagcccuuuggaccaaagaguauggcaaggggcgaacaaguauacuuuuuuagacaucugaucggcagcccuggucuaaaucucucaguugcaaagccuuggggccuuugcacauaccauucuaucugcaugagacccucuucugcuccccauuacccaucaacugccacucauacuucacauuuaaaaucaaaaaacacuuccucacauaaagccauccccaaccaccuccugcaagcauaagacuagaacagaaccccuguuuuguauucucaggggcccuaguguguauguaacuauauguucguagauucauuugaaucaugucucauccucuuucuucccugcccccauacacucacuaaauucugccggaauuacaucuugcuuugcucacaauuguaucuaaccgcaacaucucacagugucuggaacauaguaggugcucagugggugaaauaagacaucuuuuccaucuuggcccuuauugauugcuuccuaagaagaguguaucacccuaccuuucucuacugugcacucugucacccaguaugugcaauuagcugcaacauuccaaugccaauuccgcugcaugaacugacucagaagaauguauaggguuuugaucauggaaagaaaagaaggaugguccaggcaauggaaacagcacaaacaaggguacagcaaucagaccaagacugacaggucggaggucacauggcugaggacugcaaagacccuggcugaagagaaggggaggccacuaguucauucugacugaagggaauguccaguucccugggugacagauauaagcuugaauggaggauucuuuaggacuguuccacaaacuaggucuguuguggauccagucauuucugggucucaugcagaccccucuccaggugccaggaugguacccuguaccagauaggaaucauauuuucuggguuuaugggccacccggagugcaccucucccugcaaagcacagggccagcuguccucuuugaaggagggcuguaaugauaaacugcacaugccugcuucuggacacuagaguccucuagagcaauugccacaccacagaguaucugcaaaacauacacagcaccagccaccucccccugccaccuccacugcacaucugaaagcuggcaggguuuugccuaagugaccaguggcugcaugugacacuucuuacucugccugcccaugggaggcuccuaucaaaaggugggcuuggccgggugcaguggcucaugccuguaaucccagcacuuugggaggccaaggcaggcugaucaccugaggucaggaguuugagaccagccuggccaacacgguggaaccccguuucuacuaaaaauacaaaaaaaaaaauaaauuagccagaugugguggagggcaccuguaaucccaacuacuugggaggcugaggcaggagaauggcuugaaccuuggaggcggaggcugcagugagccgagaucgugccacugcacuccagccugggcaagaagaaugagacuccaucucaaaaaaaaaaaagcugggcucagguagucccugaagcacaccuccaaccccuguuccuagauguuccuggcuggaauaacagaacaaauuggaauacauuuuccauuauaugccagugcucucggaggauaagcaaugagaguaccagggaugaacacauuuggucaaacacugacacagaaagcaggaggauggucauguggguaguuccccacuuucccuaauuauaaaaauccuauugucaaugauuacaauacuaauucuaauacuauuauuaguuacaauaggugccaucagcuaucaggcacuuuccaugcaugaucagugcuaaaugcuuuccguggauuuucccauuugagccucacuagggcccuauaaaguaaguguugucauuagcccaucuuuuagaaaucgaggccuguaaagaagaagugacucuccccagaucaucuaaugcggaagugguggacauagcaugccaguccaggcagccugaauugggagccccuacuucucaucucuggguccuaccugccuuccagaaggacauguuaaacuacggcacaguggcaugggcacauuucacaggccacagacuuuagguugggugggaccuucagggucacucaguguaagcuccuuugaauuucuucuacagucccaucccaagguuaaacugcccagugugcaaccaucucugaccuaggucagccuguuccaugucaagccauuuuuuuugacuauaaaaaaauucuccuuuggacugcuucccuguggcuuucucccaccuaggugacaucuugggcuuacaaaaaaacaagauauuugaaaagaagggucauguuucccaaaucaucuccaggauaaauauuuucauagauuaggauggucucucccugcuuaugacauggucccauguccuucgaccaucucagucuugcugggggccaaugacucucuuaauggcuuuguuaggggauaaaugcaaauuucccaggagccaccgaucaguauacaagguugagaguucaccuuccccacuuggaaucuuuuuacugcugguaggacagcuugagacuucaccaucaucuauuuaaguacuucuaguguuaaaaaauguguuaagaagguagaucuugcugggcgcgguggcucacgccuguaaucccaggacuucgggaggucgaggcaggugaauuccuugagcucaggagugcgagaccagccugggcaacaagguaaaacccugucucuacgaaaaccacgaaaaaaaaauuagcugggaaugguaguacguaccuguagucccagcuacuugggaggcugagggaaacggaucacuugagccuaggaaguugaggcugcaggaagccaguaucaugccacugcacuccagcugaacgacagagugagacucugucucagaaaaagagaggggcgaguauaucucauguuaaguauuaucacaauaaaauaaaauaaaauaaaauaaaauacucgaggguuuucaaaccagacucugucucccaacuuugaugugauuuagugaauaacucuacguacucuacuaaauaacuguacucaucuggguggccaaguauaauaauuuuuuugaaaaaaaaaaaaaacccaggcuuauuacguagaaaguauugaauagcaagaagagcccugggccaggaauuggaagcuagauacucuuucuguuuuuuuccauucauuuucuaugugaguuugacaaaucauuuccuccuggagcccuuguuuuuuauuguacaaaaugaacacguuggacuggacauauucuagugucccaauuaacccuagaaucuaagagucccaucacuuuauauuucuaacucaugcauuuccccuggguuccacuuucucuucguuguagugguccaaguugucacgugcuuccuguuugcuauguucuaaaaucacauuucugaaaagucaaacuugaguuaagacauuaggaugcuucagcugccucuucuagcuuugucuucagucucuuucucagccugggaucugucugggugaucugcacuuaacaaaacuggggacagaaacaaguacggaguuggccccuaaucaccccaccugguccaucagcugcacauucaaacugagaggggcccauuugcuaacuagugggacauugcugaucuguaacaaugccgacagccugccacgccugcccugccugccccugaggagggcacauuauucagcuccuugccucaauuuuagugcccuucaacaaucuguuuucuucauuagccacugucuuuuuuugguggagguuggggggggugcagugacauccuauuuuccaggcugacaguccagccaagaguaaauuaguuacaguguaaauaaaccugggauaacuucacagcuuaaagugcauuaggggagcacuggacauuaaugccaggaagggaggggcagguggauccugguguuaaugccaaguaaggucuuuugcucuggcucuguguguucugaaaucuacauacagaagaauucuaaagaaugccgagaagauaagggcuucugccuucaaucuuccaauuauaugcuaguccuugguaauaaaaaugcuuccaggauagcaucuccauggggaccaggcuuuacugccccccaacuccgacccccacauaucaaguggagaugugcacagccaugaagaugaaaauccagccccgcugcccugaucaucuggcuuugaaguagcugaaacagcucucacagacaaguagacucuucagaggauaucagcccacucuaaugcucugaguuaacuuuaaacaauucaccucuucucugggucccuucaauucccagggacaccauccagccccguccucccucuuaaaaauggcagagcaccuuggauggcugauuucaaacauucuuugagagucucagaaaaagguguuuuuaaaacaggaaggagcucucuucugccucaggcucccacacccuccugaaggacaugcuugaggcauaagggucacgcugccaccuugaucucaacuucaaccucagcccaaccugaacuuagccagccugcaucccagccauggaagcugcuauuuuugaaauagaaggaauauucaauacuuuucacucugucaauauuuuuaccuucauguuucuccucuucccccaccccugugccccugguuggggaaaaaaaaacacacauuuuuuuaaaagcuaaacaaaaacaaaaccccauccaggcugaggccagcagaucgcgguguucuggguggauuuugcuacgugccagcgaagaccaucagcaggauuugcaggaaacaccuugcggaauccacugggagaagccaggggccacagagaagcgugaggcggauacacucacgguccaugugacuggcuggcuccccaggccuggguacaggaaacaacugugggauuccagggcccugcagggacagacacacagugguauugcgggggcggggggguggcccuguggaucccucugguguuuuccaacgagaauuccuuuaacucgcauaucuauucccagcugccugugcaugaccugugcugaggggacacaauaagaaaggucacaggcagcuucccaagagcuuccguuccaggauuuggcugaagcucuguuucugugaaagaggggcacacagggcaaagacaugagcacuugggcaccagagaaccugggguugaaucucagcuccagcuccuccuagcuauagacugucgggcaaagcauguaacuucuuuucagcuugaaaagggagaugcaaucauacaaggcucauaggauguugcaggcauuaagggagauacuccccuugagguacuuagcacagugccuggugcaaaguaaccacucagugaacagcagcggugacuacuguuuugugagaggcccccuuucccaagacagugaagaggcuagagggcagcgggaaaaaggacgaagggguuccaagaagagagaaaagaaaaugcaaaguacuagcugggacccauaugggccgugcaagcucacagcagccuggcugccaaccuuccuccuccugaaaugucggcugccccacuuacucuuguuuggagcauuucaguuucaggucagguugaagcgagggacauugacugguaucaguccaagugcagugaacaccccagagcaaugcagagagaggcccagcaagaggcaggaagaggaggcgucacuggaaaaugcucauuucucauuuaagucugucagggucgcaucuuggucccauucuacccaagggugggguguaguuugguugggccaaaagugguacgucagagugcauggugaagcccgcugacaaaccuuccuucuggaggagcugugggugugggaagccagcacugaugugcagagugagaaaugagagcuauggaguuggcaggccugccugggccagggucagugcccggggaccggcauuguccuggcuggaggagggaacagccaguggccagcagucugugaagaggcugggguagaaugaaggccagacccaggccaauuaaggucugaugaaaauccgggccguuuuucacgaaacaggaggcgggcagcccugcugcgguggggaugcuggcuagauggagcaucuggcaccgaucaauucccaggccaagaagugagccuacaugugggugcaaaugaaaugccgaaggcccggggaccccacccccucugucuuugccauaaugaagugccaacugggagccagcugggcaaaggggacauguugccuugcuccguccacuguuugguaacaauuacgagcauucuuucagcaccaacaggaacaguaagcugggggagcaauucuuugagccaccaggcgugaucacgaaaggaggguuuagaucaaagaggguaucaguaauguucaacgcaccucaugggucucuggccugggacuaaagccggcaaugggaugggggagcugcuaagaagugccgagcugaauuaagcaguuccucuuucaucucugcccgucuucuucagcgguacccucugaggguagaaauggugccaguuucagcugguuccaugugccaaguucaaguccgcuauagggaggaggcugguagucuccuccaacccucaagaccgcuccuggggcaguggggagguaaggaccaauguacccaagauccuuguuuuuugucuuuccccuccucauuguggggcccccuaaugagagaggaagagugugaauuuccuuaugugacugucucccccaagcuuggcugauauacucuucagccccuacuccccuccccaccgcuggcuccagcacugaaucugggaacgcucaguccagcgugcugaugaggcaaacacagggaaggaaagagcucagucucccagaaccggccaagaagucuauaguggguagguaagaacucccgcuggauugggaaaccuugguucuaacugccuggaccacuaacucaugagguagcaucaggcaggucacuuccugucccugggccuguuuccccaacugggaagcaaacagaccaaauaaaggcccuuaaagucuaugcauggguaugcccugccuguggccuagaaggcucaucuagaagaguggaaaagacuuauuucaauucugcuccuucuuuccugggugcacagcacccagccagggauuggaucucugaccuuuuucugaggcuggcucuaacacagcagccggcagauggcagaauuuuuuagaggccuguaucucugaaagauuugcuacuucacaucaacauaaaagaauguuguccuaagaagcugucugcuccuaaguggccccguaagaacuugcccucuugaguuucccccacuugaaggcuggagcauaagagcuaaguuugaauccagcacagacacucacuagcugggaaaccagggcaagacacuucacuugucucagccucaauuuccuagcugucaaaagggcauucuuuccugcauuuaacaaauguuagaguuucaaguaucuucuagauggugaacaagaccaacaaggucucuacucuccuggugccuaaguaacggaggaggaaucaggccaaacaauaagacaaauacccaauaugauggcaggugcuaggaggcaaaggggaauagacaaggaggcugguaggaggggaagggaggcaaggaaggccucucuacgaaggugacauuugaguugagaccuccaugaugagaaggggccagccagugaguaucugggggaugagguguuccuggaagagaggacagcaaguucaaaagagacagugacaaacuuggagccuggagcauuugaggaauagcuagaaguauguggcaacagcaaggccaagggagacagaggccagaucccguagaaacuucuagagcuucuugaggaauuaagaagccacuggagggcuuugagcagggcauuggcagagaugugacugacauuuuuuaaaguucacugucuacuuguuggagaaaggauuguaggggaguggcuuguaaaagcaagggaguucaugauagucauaaccaccucucccuugcccacccacucuggggucauuguaaagcucacaugagauucaugcugacaccuagaaaagcccagagguacgggaggagguagauaucaucacauguuuuaaaauccauuuguacaaguaggagcuugcagggacuggcaccaggguauuuggaacuguguuccuguauagauuucaaggaaacgggguaggguggcagauucugcccagccugagcuaugcagcuguccaggcccaaaugaauucacauauuuaaacugggagcuuugcuauaggccacgccuggcucuguuuuugcugcuggugccagacagggguaagcuaacacccagcaauguggagaagcugacacuccacgcaaagucacucgcugaauuccuggccaaagcucaucucuccugcccucacuuucagaacugggaaggaaacagcaggagaggcuggagauuuauucacucggggauuuuuaacuucagagugggccccugcgaggucaaugaucagcaaaacuccagcauuccagugaacaaaucucagugcucagagcagcagggauugaaagcaucuuggguuccagcuugcuuccuucagcugggguuuggagcuggaggcuuggauucaaauccugucucugccucuagguucccucaaguggaauaagaagaucaguggcagcaggcuccuaggguugucacagggaucaagugggagagcagaaugcaaaaacccugccuaaugccugccacaugcacucacucccccaugaacuccugaguggcaggcuugggacuggauaguggacgcccuggugccugguaaauguuugcagaaucugaagacacguaguacauuuuauuccagcucaaauaggcuaacuaagaugccaggaaguucagagaagagaauagucaacaagaugacacauagugaauaucuaguuuuuuucuuucuuucuuuuaaaguguuaacuucucaagauucugccugucaucuguacaaugcagauacugaaauuucccaaaauuuaacaaaauaggaccgagguuaucugguuuucuacuuucuccaugcucuuuauuuucuuacauuauuaccuuuuuaaauuuuguuuauuuauuuauuuauuuauuuuugagacggaguuugcucugucucccaagcuauagugcagugacacaaucucagcucacugcaaccuccgccucccggguucaagcgauucuccugccucagccuccugaauggcugggauuauaggugucaccaccacacccagcuaauuuuuuguauuuuuaguagagauggaguuucaccauguugaccagccuggucucaaacuccugaccucaagugaugcuccugccucggcuucccaaagugcuggaauuacaggcgugagccaccacaccaggcucauuauuuccuuuuuaacuuaaguaauacaacuucacuaaagaaagguugggaaaaaaagaagucaacaaacaaacaaaaaccuauaaaauaauuguguaaaugaccuaaacucccacuguccaguuauaacuaugcuuuauauuuauauuaccuucaagacuuuucccuaugcuacuauaaacuuguggauacguccccugcuaauagaaucauccaaaaugugcuuggugaucugguuuauuucaaucccaauauaucaguucauauagcucugccucaucccuuugaauggcuauguuguuuucaauugcauagauacagaaauguuaguuggaugcuuuuauaaacaacucuaugauaaacauccuuguguguuuauaucuguacaugcacauauguacaaauaaauauguauuauauauauaagcauacacacauacacacaucuuuuuuuuuuuuuuuuuuuuuuuuuuuuuuuuuuuuuuuugagauggaaacucgcucugucgcccaggcuggagugcaguggcaugaucucggcucacugcaaccucugccuugcggguucaagugauucucugccucagcuucccgaguagcugggauuacaggcgcccgccaccacacccagcuaauuuuuguauuuuuaguaaagacgggguuucaccauguuggccagacuggucuugagcuccugaccuggugauccaccugccucagccucacaaagugcugggauuacaggcgugagccaccgugccuggcuaacacauacacacaucuuagcauacuuaccugauuauuuccucuggaucuagaaguucucuccucuuucuaaaccugccauuuuaguaguaacugaauccaagucagcagaucuuccgccagccaucagcuggccacccugcagaccucuacaugcagcauucaguauaacuaaggaagcccuagacacaguuucucaguucccacgagcucacccaucccucccccaaguccucccacccacugccccugucccuaccccuagaggccagcuguuuaccaaacccgaaagaaauccuaucugccugaguccugucccuuuucugcgcucauuggacccagccugcgauuucaaaguuccagggucugaguagauaucccaagacaggcggggccaggaagagccuaaucguuuaugucauaaagucacugcucaaagccgccuccccaaacaaggucccuuucugccuucugugugcuccuuuucuuauaaaaguacucugguugucaugggcaaucaguauucugcaagaguagggagcaucucuuuuggucagagagugaaugcaaacugccaugucuuuacucaguaucaaagacaucugccucaaacacugguucagaagcgaaagaacaacaucgaaagcagaggaaauggauccaaauguuuccuaugaagggagucaucauaacaacccauucaacgaauacaaguaacuuccuuuuauuuguauacagagaauuuauaucauacaugcaugccucuaaccagccugaguucaaugacauauauauauuauuuaauuaugcaaaaaauauauacauauauacacuccauuuuaaaagggcaauuccucccaccccugauucuucagugagcuccagacagggaucugcuguugucucugguggugccagucccuauaugacuacgggguuuaaagacagauccugagauugucucacucccuaaaagcaucucagcugcucaaccugaggguacuugacaacaaaaaaaaaauaguaaucugucacaacacugauggaacugcuggcucagguggaguuauggagagauggcacuguauuuuuuuuuuuuuuugagauggagucuugcucugucgcccaggcuggagugcaguggcgaggugucgucucacugcaaccuccaccucccaaguuuaagugauuauccugccucagccucccaaguagcugggacuucagaugugcgccaccacaccugguuaauuuuuuguauuuuuaguagagaugggguuucaccguguuagccaggauggucucgaucuccugaccucaugauccgccacccuuggccucccaaaaugcugggauuacaggcgugagucaccgcgccuggccugcacuguauuuuacaggaauguaaggguuuuuugacuuucuaugugcugacuucauaagaugucacuccaugacccuuagacauauaggugucaaaagaccuucaccuauaaucaccuguggcagggcacuguggggauguaccaucuuauaggaguggacauggggcucuggaggcagagugacuugccugagaccacauggauggcuggggaguucauucugacugcaccccacgucuuuucacuccaagucuggagcugccuccccugcuccuacacggccuauuauuagcaccaugggagcccaccaagcuucuuccugccucagccaguuaccaugcugucuguccagagaccugcacucacggcccccuaaguugcucuuggcaaugcuucuccuucccuccaauugcuauuccugcugguggcugcucacccaaucccagaccaccacccuccaggccuggucggcucugugcuaauccacuggacccuggcugcuuuggggcugggacacagacggcccacugcauccugguuucugagaggagacucccuuuggccagccccagguucaaaucuagcucaucuauuuaagagaggcagaggacauccaccccacucacagcucccaacagaaacaucccuugcggcauucucuguggcaggucccaucuccugcagggaccuuggagagagaggauuuccagcgucagguccguaagagcaaucagguaacugaccacgggacuuacaagucccaccaggagccagaagguggcgccuaggaaagggaugggcugugcuggcuuccuacaugaugcucuagacccaaaagcaagggucacuugaguccuugcuuucccaccauuguucuuuuaucugauuaucaaaugaugugucaauguagugaaauuuuauuuuccagaaaacacuggaucaaauuaaaaucauccaaaaucccacagcgcagaguaacuaguguugauauuuaguauacagacauucagacucuucucuaagcaucuggaugcacauucaucucucucucucuguuuuuuuuuuguuguuguuguuguuguuguuuuuaacaaauuggcuucuguuacucaaaagugcaccauagggcuauucuggcaucaauagagaacuaccucaacaucuuuuaugacucuuucauucaccuuucuuuggaccauccauuauauuaauaaauccauuucuaucaacucuggcuaugagggccacacccaccuccuuugacuucugauuuuaauagcacagcacugaugacaccuuagcgguuagcagaagaggaagugcagaucuucacuguaugaacgcaccauaaucuaagcagucuauuugcaauagacauuuagauuaauuuggggauaaacaauguagcaauggacuccauugccuaguuauuucuuaggacuaaauuucuagaaguaagauugcuaguuaaaguguaugcacauguuugaggcuuucgaugcacaggaacauacuucccuccccagacgucacaccaguugccuuuccucuuaguggccugugaaggugagagaccagacuccaugaggauaggaagugcaagucccagauuccccacacugcucugccaaguccagggacaucaucuggaaauccccagaggcaucagcacauggagcacaucccacgcagggcaugcaggggaaaugugaucauacccugugaacauacccagagacagcgaggaagacuuugggcacaggagccagccucggagauggggaguuggggaaaggacagacagacagagcuccaacuucuuuuuuuuuuuuuuuuuuugagauggaguuuugcucuuguugcccaggcuggagugcaauggugcgaucucggcucauugcaaccucugccucccagguucaagcaauucuccugccucagccucccgaguagcugggauuacaggcaugcgccaccacgcccggcuaauuuuguauuuuuaguagagaugggguuucuccauguuggucaggcuggucucgaacucccgaccucaggugauccgccugccucggccucccaaagugcugagauuacaggcgugagccacugcgcucggccucaacuucuuacagaauaaucagaagcagggaguggaaggcagugagugacgggggaaccaugaggcccucuuugucuugcaggaaguaucccuccacugagugggacauauggugacaagaggagcuacgugggacagugacaaauaccugguucaggaauccacccccuggaagcugcuuucccccacuccccaccugcugugagauauugggaaagggcuucgcuucucugggccuccgcucuuccauccgauuugccuugccccucagcugagaucaucuuaauucugugauuucagaaccagccugaagaccagggcagacaggucuccacuccaucccugucuguuaaccaggucauucaccuuucuauggaccauccauuauauuaauaaauccauuucuaucaacucuggcuaugagggccacacccaccuucuuugacuucugauuuuaauagcacagcacugaugacaccuuagcgguuagcagaagagcaagugcagaucuucaauggaacguaaagaaugugcuuuucaaauucagcuucagcucagccuuuacugaaagucccugucacugcuggcaucucucacccaccugcauuauaaauggggucuuucccauuuugcaauugggaaaaccaaggcucagaguuuacauuuuagucaacuaacuccagugguaaaaggcagagacgggauuccaucucugcuuuuuuugacucuaaguucaucucuuuugacauccuccacugucucuccaaacccuucagaagagccugggagauugcaccgguggguauucuuuaugcucaaaaauauaaauucucuagugcagggaugagaucauauugaaagagcaugaagccaccuggguuucucggauuggucaugcuuggcucagagaccuugaagccaauuaacaugucucucccuacccuuuaucauccauaaaauaagcagugagagaauuaauuagcaauaucuggcaaacucugcucuuuaucauucauacaucacuucuaaucuaauaaguaagcaguuaaccuccuuuucuccuuccaagaacccacaucuguugacuuggcuuucaaauagguaugaguaagcuucugugauccuucacccuaaaacauaucccaagccccaaaccuccccuuggucccaggugcuccuuggugccuggggguaaucagguccuggugaugccacgacuuguuuucuccgggccccugcccaacccuaagcaagcauguugcagaagcaagaugugccaacuaagcaugggucaggacaaaucucagccugacccuaaagacuaccuccauccucaaaguaaaugggguuaagggggaagaagucaaccagccaggugccggggaguuacggcuuucaggugcagguuuuccaggccccuaggugaugcuaggugcugcaguggaauggguggaugagcagaggaggaugacacacacacggaguagaacacaccacacacacacacacacacacacacgcaguggaauggguggaugagcagaggaugacacacacacggaguagaacacacaccacacacaccacacacacacacacacacgcgcacgcacacacacacacacacacaggggagaaaggaggaaugcuaaggaaaugcccugugaucaugcccugagggagugaggaagggcuugggcacaggagccagccucagagacggccugaauaggaugagagggcugacucugcugagccaggaacgacaccuacacuccaccuucauaggaaucagaaaagcacccacucucaguguuagaagcuugcaccaccccccacaccaaaaaauccccucaaggcccugauucccuugggcucuaaaacaaacaaaaaagcuaauggguuucccaggaagccaugugguaggauggauaucacagaaaacuaugguugcgagaacuucccuugggcccaugcgcagaacaggaagucaggcagugagugggcucccaggaaguuaauauacacuauggacagguagcaaguuauggacagauagcaagauagccaguuaauauacucuauggaugacccagcaaguuugcuguuucagaauccuccucuucuguuuuuugaacuuucgaaaacaaaagauaugcugggagacgcggccccuagagugugcuuacuccagguccuugauuguccagacuguggagggggaagggcagaucuaugccaagaggggaacaggcuguagaggccacagcugauucauuuuugugaccuuagcacucugcccagcaccuggaauauaguaggugcuccauaaaccuguguucaaggagagaaucuguccauagcauauguauuaaugggaccuuuauagucaauggacauccuuagaaaucacauacccaucguuggcuggugguugagaaaaaaagguaaaaaaugagauacacccuucuacauguuuggccuccaauauggggccgggcugggccucgagaaggagaccgcaggaccucaccagcaaggcaucguguccucuuuguguccugagaugccuucucacuaagccucuuuccagaccuuugguccuggggaucugcagugagcagagaggcagcuccuugcgggugaaacccagcaccggccugcaaggccaagccuccccaugccaacacagcuuauuuccucuuucacuaccucacucccuaguggaaaaaacaagaaaacaaaauuccccugagcaaucugaaacccugugacccccuggccaaguggcagauccagcuccaccuugauccccuccacuuuccucuggcucaccuauacuuaagcgcagaggccagccucgagguuauuuauaacugugucagaggaggaggaggcaggaaauaggaaauuaugcaggagggggcgaggaguagcugcaggggccaagugaccccgcuggcuggcuugaaauccacuaccugccuggcccguggcuucagagccccaugacagggaauucuuacccagacuggauuccuccuggucucugagcccuaccugcgaaucucuugccagucacuuccccuucuccagauccagguggaagcaguuuuauccugagacuuucccccuaggccggccacagugacaucagcuuuucugacugcaguuaauggugcaagagcuggaggccaagcaggaggcccagcgccggaggggagacaaacacccagcccugggagcaaaugggguggcggcaaacacacggccuuuuaaguccaccagcccuauccuucuguuuccuuuccuccuuuaaauacucugaaagcgagagucugaauagugacuacuugagaacccaagacuucuccuuaacuucauccagaggacucaaagggaaggccacucaaccagaaucacacagcagaaggagcagagccaggccuggggucccauuuucuggaggcacuggccccuuuuucuacacuaccaugcugcccccagccccugggcuaacuaagacucccccauucuaaaugugagugccccugauggaccgcauaggcuggaugugcccguccuugcuuugcccagcagagccauguccauaaagauggcaucccacgucaaauccuguagacuacugcaaaauauccaucagccaauuucuucaccaaaacgcucugagcagccacugaacuggcagugccauuaauuuucagacaauuucagacuaaguuagguuaccuuuuuggggggauuuuguugcuguuuaguuucaacaccauuauugacucagugauacucuagggcaaguguucuaaugauccaagauagcuuuuaggagaauuucugaagcucuugaaauuuguaugcauagcuuuaaucagaaucccaaaggugcuccuaucgguaaaaugauuagguaggacggugauguaagagaaguauagaacagagaggggagagaucuggcccagacgaccaggggaccagggugggguugcaccgguauguccccuacuguucauuaccugcucgcagggugccugccccauggaccuucaaucagaaacaucucaccuucacacucaccacaauguccuucaaucauguccuuaacgguauaaacaagauccuaggauuuaaaaaucugaugugugcccagaacugagccaagcaagauuauaaaacaagucaugaccacaggaaggaacuuuaaaucuggcaaaugugugaccuugaaggucagccuucccuuccuccuuuuucuucuggucccuacaaagcacccacuggcaccacuacagccauuucuguuuggcaacccuaggagagcagcuucccuguguaaugcagaugauacuuccuaauuucuucuucccuacucagcaaucacaauggcaggcaagugggcaaaagggguuuucagaauccucaucugggcagugucucaccaacugcauuuguaggugcuucuugggaaaauuaguuccuuggcuagauauguucagagaacacuggauuaaacagagcuaaacaggucaccaugcagcaggacuucucagagcuuuuacuaugcuaauagccacaugucucuccaagaggggaauacaauaaacagcucucccaaauaacauuuuuuuuuuuuugagauagagucuugcucugucacccuggcuggagugcagugguacaaucauggcucacugcagccucaaccucguggacucaagcgauucucccaccuaagccucaagaguaacugggacuacaggcccaaccaccuuuucuuuuuuuuuuuuuuaaauuaguagagacagggaaucuuacuaugugacccagacuggucuucaauuccugggcucaagcgauccucucgccucagccucccaaggugggguuauaugcgugagccgcugugcccggcuccaaagaacauuucuuaagauugguggugcaaggaucacaccuugagaaacacugauuuaggccuucccacaguacaaagaaauguugccugccccauccuuacagcacaccugaugacuuacaagaggugcugcugaauuccucccagggaagcgaccuuaauucuucucagcaagacaaggaggcagccuucaggaaggacccaggagcuugguauuagaggaugauccaagucugauggcaaauuuagagugcuccagggaacacugaagucuugaugauagggcaaaagggagugauuccaucuuucuaaccuggcaggauagcagguaacaagacagaaauaaggaaaaagcaagcugaacuugucuuucccugacauuugaacugccugcuguucuccucaccaaaaauaaaaaagcuggucucaagacaacaaaaguagagaaguaaagguaacagaggucuccagccugcaggaagacucauauaaccucaguccaaaguucuuuuuauacaaagcacagauuuuuacuggcuaagugcucacccaaugacccauuuucaguauuuguuuauuccuguauuucacccauguuuaucgagcaccuacugaguguguggcccguagucaggaaugcccaucaauuaccaggcagcaaggcuauucuuaguuuucugaugucuauuuaaagaguguuaauccucuggccuccccccuacccccgccccugcaauuagacacauaccacuuuccaaccugguacacugaccucgcccaacugggaaggcggaauggacaaguguucuucccacccugcuuaacuuggccaagaaucuggcuucauggguuagggcagccugggaaccagccaagccagaggagacgagccugcuuugccugggcccuucaaucagugcuggggucaaaaaccucccuguucuguuccuuacuaguggcacaguaaggcagaaaguguugagacucaagagcagaaaaauccaggcugucuaguggggcggugaagaccacagaccacagaacagacacaccugcucaaauacuagcucugccaucaugcaguggggugaccgugggcagaauuggugagauugcucggacucuggagucaggagguccggcucaaaucuggcuucacuauguagguacauacuagguaaguuaccuagucucucucagcuucaguauuuucaucugcaaaguggaaugaggaggacaaggaugauaacacuaauaauuucugacauguauguuuauaguaaagaauagaauuuauuacauguauauauguauauaaagaucuuaaaauagcugucaacaaauaguagcugcuuucauauuuaauuccucuuaagucccaauuuuuuucaucugcaaaguagaaauaggagugccuaccucaaugagugguuaugagaguuuaaaggagauaaugcuuuaaaaggucuuggcauauaaaaacaaaucaauaaauguuaaaauauuaucaaaugguuauuauuuuuguuccaguuccaucucuaucucuuaaaccaagcugcuguaccucuuuggaccucaguuuccccaucugucaagugagagaccuggaucagauggcuucuccagugucaccgcacauggguucccugcacugggacccacaaggccuagaaguuacuugcagcaaagcugucaguagccucugagccuuggucagcccaaaaguaccucgaacagccccauaucccugugcacaguucaugaaacuagaaauggggaggggaagaugccuugccuuugcaaauguuaucuugaccugugcuguaguauuaacauggcggccacuaaccacagguagcugaaacgcaacuaguccaaacugagauaugcuaugaguguaaaauacauaauggaugucaaaaacuuaauuuuaaaaauauuaagaucuuauuaauaaguguaaaauugauuacauauugaaauggucauauuuuauacauauuggguuuaguauuaaaauuaauuucacuuuuuccucguuuuuuuaaacaugacuaugggaaaauucaaaauugcauacauggcucacguguagccacaauccuguuucuccugagcaauaucaaucuaguuuuuuucccuuucugucuccccgcuugugagccacccaguaagaaacucuucucagagggauaccagaaggaauucgaacuauuuguaauuaacuuuuugaaacaaaauaaaauccagauguuaacuauccagguggagcauucuauuuuagcagccuccaggaaucuccucuggcuuaaaggagcccugaauaaauaaaaucuauccagcugccaaagcaccccaugauguuaccauauuuaucagcaccugaaguucuaaaucuccacucuggucaagccaucucuugucuuucuccguuagaaaaagaugggcagugguuucuguuuuauuuuccaagguacuugccacuguuuaauacgguagcuuagcaguuaggaauggccuuuucucauuaagcucagcucccaauguuucaaaccaaucucuuucuuucuuucuuucuuucucucuuucuuucucuuucuuucuuucuuucuuucugucucucucucucucuccuuccuuccuucccucucucccucucucccucccucccucuuucuuucuuuccuucuuucuuucuuuuuuuuucuuucuuuccuuucuuuguuuucuuucuuucuuucuuucuuucuuuucuuucuuucucuuucucucucucucucucucucucucucacacacacacacacacacacacacacacacacacgaguauugccuggaaaggcuggaaugcugucuuucucaaauguucuuauucauucaugauacuuuuauugaaugccuacuaacaucaggcaaugagcuggugagcaagacuuggcucccaucuaaggggaggcaguaauaccauguaguaauaauaugauggcugacauuuaucagguccuuacuacaugccaggcaaugagccaggccuuuuauuuccauugugucugugaauucuuccacaaccuaugagguuaagaguacuauuauugcauacuccauuuuacagauaggaaaaaugagaccagggaauuaacuuguccagggacaggcaacuagccaugaacgaggccaagguuugagccaaguggucuaacuccagaaccugugcuccagcucagaaagugugggaaaugcaggacacauuuugccaaaaaaaaaaaaauuggguguuacucacucagagauccgagaauugaaaggagauucuagaaauaaaauggauuccagaucacaaaacuggugacccacaaggcugaaucuggcccauggacauguuuuguuugguccacguguguguguguguguguguguguguguguguguguguguguguguguguaucuuuucagaagauguuacauuaaaaauuuggauuucuugcuuguccuaagagacuggaaaucuggcaucacuagacucacauccugauaggcuggagcuggacagcagcuguccccuccagaagggaccuggacuguacgguucaccacaguuacugccacucucuauugucuccccaacuccaaagccaaagcucagaugcuguuuaucaucacacuugcccacuguuuuauugcuugucuuauaauaaagaaaucauuuuuaguaccuguuuagcucuccaaaauggaaaccaagagaauggggaaccauaaacauauuugguaggagugaguaauauuccaauaugucugauacucaaauauccagcuucugugccuggucccuguaggcacuggguuugugacauggcauggaugacaagugaggaaauccaggccaaaagagaaucagccaaagaaggaacuggaacccacacccaccuucccaccuuaaguauaagcuuuuuauccacugcacucauuuguucagaacugcacccuggagaccaaccuggauucugagauucuuggaucucucaguccuugcaguggugaaguuugaccuuccaaacuuccucaggaucuuuggagcuuucuauccugucacugggguuucucccugucaggggagcagauagugacugcccaauggggcacacguuugaucuaagucuuccaaauacccuccucauucacuuaaacaaagguuccaucagaucacacauguguucaucugagccagacuuccaugagagaaguccucucagcaacagaaaauguuugagccgagccaugaaccacauuuuccagagugaggcacugcucagguaggcuguggauaaggaaagccuuauuuugaugaguauugagucuuaaucccauuucuugucuaucagcuucuucagugguguuaaugagguucaauuuuuaccaagcccucccacaaucagugacaggcccugaagugaccuugagucuuaauucuagccaucgacuaagucugcaagguugcugucuguuuggcaaaucagcccugcuccaacagaaguuugguggucaaauaugucaucugauaaaguaucucagcucacuagagguuuuguucagagcccgcauccacuuuugcaaccacagaaauccuggcucuuaccuuaauagaccauauuucuaacaaaguuaccuacugaagggugugguugacagauuuaggugcugaguuauucagcuaaaguagagagcccuuuccaagggaacuuagagccagaaaaacuugaccauaguaggcauucagugaaauacacaccacauagagccaauauccugcuguuuuacagauaagagaccaaacccagggaggucaguaucaccaaggggacuccagagucagaugaugaacuaggacuagaccuuaggccuccuaacuccagccagugcuccuccuccaugccacacugcaccuccuagcccuggcaguggauaggggagcgguugcugacucuucagccaaguucauugucaccauuccauuucuagggcccucucuuuggcuacccuagugacuucuaccucugcuuaucaaugggagcugucuaaagagggaagggcagcaccagauccuugacaaguguugggcuugcccucagaagacauggguuccaaucccauuccauguauuggcuauauggcuaagccacagaaccccgccauucucaauacugacauccacuaacuaggaacuaugaccgaccccccaaucaccauccugcuuuccucguugcgaaguugucaucaaaugagaucaaauggacuuaagacucuaaaaugugaagaguugugaaaauagaguaggaacuuuguuguuucuuucucugcccugugggaagcacugugacaaaauggaacacauuagauuuggaggcggggggaucaaaccacgauuuugaauugaaacucagcucucucuauaugacccuggaaaacaucacaucacaccacagagcgccauuuuccucaccgaaagugaagugagaauaucagcucugcucuauaacaacacuacuacuaaaagcucaugcuuauucuuauugagcuauucugugccaagaaucagucucuuguauagacuaagggcuacaacuuuuuagacuugggaagauucuacccauuuugcgaccucuccaccugagucuuuggcuccccacuuuuggggccccccucagucugcuuaucuuugauuuucuuccucuccagacaugccuucccugcugcccccaaauuuuauuaccguauagucaguucugggauccuaacauaaccaagccuuaccuccuaacccagugcccuuucaacugucucagugguucccagccuuuucaacacuaaggaauauuuagugcuaaacauuccaugaaguauuucacuuaauugccaaugaaguuaccacgugguacauaauauauuuccccccauuuuagagaugaggaaacugaggcaaagaaccugcccaagcuugggaguagcagagcucacuagagcuaucauguuuccaaaucgaaaaggcagggagcuuauucaugaugauaaagucuaagucaaaagggagcccuuccuaaauacaugagaugcaaacaccuuagucaaacaccucaagucacgaaaccaagucuucaugaaaucugacccugguugcgaaacucaccauccccacauccuaauccaggcauugcaggagcucugaaguuucugaaugaaacagcucuucucugcaggcagccaggcggcccugugccugacacccucaugggcagaggcagaggggauaauuaccauguaguauuuaagaucucuaguuccggaauggcucuuggaggcuuggucagcucaggacuuccccucuccacuccccaguacccaccccccgcccaaucaucuagggcucuguuuuuccacuaacugaacuuuaccuugggcucucugaggccagaucguacagcuuuccuucccuuccccacccccacaaaaagccagguggcugcaggcuuggaaacacuuauaguuucuugucuccaagccgugaaugccaccauuaggugaucggauuuacaugaacauaaaucagacuugaguguuggguaguguggacugucccuucugugacagcaaagccauccuagccacacagauggccucuaaaugggucaggaaagguucucuggggccccucugaagcuacaaacacuaauuuuuuaacagcugaacaaaaagaccucuuaguuccacugcagcccacauagacaccugugggccuccugucaaacaguauuuaguaagucccuuuagcuagaaucaauacuuuguguaccccuggaugccagacaugaacauaggaaaauaucugaacccaugucaccuccucugaaaggauagggaccucaacuaggacacaucaguuaccugcugucuaucccaggcaugguggcagcacuguggguaacagggagaagugacaauggcaguaaaugcaugggaccugcccacagggagaagagaugcuaagcuggcaugaaacuaaagauucucaggaggggcaaaggacagcgauauaccaaagaagccaggagcuauuuuaggcauaucaguaagccaacccaaauccgacaaugcaaucacccaggaacccaugagaaaacuucccaggcuuaugaaaacaccaaccguccuugcuuucggcuauaauuaauuaguauauuagcugauugugucagaauaaugacuggcuaguaucagcaguucuaguuauauuuuaauuuguuuuuuaauggaaaguuaaucaacacucaacacaugaaauugugucggauaacuguuccaaacacagaacuuauuggagggaaaaauuaauuuuaaaaaauuccauaguguugaaaagucugggaaccacugagagaguugaaagggcacuggguuaggagguaaggcuugguuauguuaggaucccagaacugacuauacaguaauaaaauuugggggcagcagggaaggcaugucuggagaggaagaaaaccaaagauaagcagacugacggggaccccaacaguggggagccaaagacucauguggagaggucgcaaaauggguagaaucuucccaagucuaaaaaguuguagcccuuggucuauaugagagacugauuggaaacacagguuuuggagauaggcuaagcaaguauagguugcaaguggugugagcuugggcaagccauuuggcuucccuagccugagacagcucaucaggcagcugggaugacugauaggcaaguaaggagcuugguacagugccuggcacauaguaagggcaccaaacuuacuaugaaaauuacaguauuauguuugugaucuccugcaggguuggcauuuagaaaucuccacuuucuucucugggagggugcuaggguaucauguccaccagaagacaggacuagacuuaucaaguaaugcagagagcauagugggugcuuacccucuaaaguggguuagguuuaucccucuggguggcacgcagcccuaaguucuuucucccagcgcaggaaugauccccucugggaguuucccaugcagcuuuggagaauuuggguuuuacuagagaugguguuuuucagcaugcuuaaaauaugggcaagguuuaugacuguucgucuguaccaaugccaaggagugaucagggaaaggaaccaaaggagaccuagagaaugagaaguuaaugaggacuguucaaaaccgagggggugucaugggccaagagccagagagacagaguaugaacagcuggagcaggacagaccagugaugagacuaugaggaugagguaggcaggguccacacuggcccuuguaaaagccauuugaugauacuuuauccuaagaguccacugaagagcuuucaucagaacaggaauucuuuccuaaaccaggccuucuagcucccauaauaaugagaccccagcguccuucuuggcugggguccacccagccucccucucggcaguccauccuccuccuugugaccaucccacugcucucacccaagugccauccauaggcaacaagaagggagacagaugagugagugcccuugcugccaccaugagccuggccagcggacagcuuugagucagaaagcaaaacccuguguauguguguucaaaacacagccacauauaccuuugaaccugaguccauguaaguccucaaagucaaacaacuugguguaauaaaugguccacugcuuauucugaaagcaaaauaaauacauaaagcuaucuucaaccgaauuacuccagcaugcaacaagucaagggucacagcuuuccuggcauugcagccuuccucucccuaugaaaauacucccauuaacuugaucuucguggcccuaauuuugcucccuuucaaagagacaaaaagaaggaaaaaaaacacucaguaagucaauaaaaauuauaaauuguuuuucuauuugagagaagcaugggagucucuuaagcacagggcucuaacauuccuccauccccucauguugcauauaugaaaagaacuguguuaacacagccacuguggaggccaaauuggcaggaacuauuaaaauugaaaaugcauauuauauaauuauaauaauauaagaguauguaguaguauauauaauaugauaugguauaaugugaccuauaguauaguuguuaaauauauuuuagagccagggugaaggggcuuaaauacaggcuguauuccuugcuagcaguauaaccuuaaacgaguuaccucauuuuucuaagccucaguuuccucagcuguaaaauggagaugacaauagcacaccucccucauaaaacugagagaauuaaaugaguuaauguaaguuaaugacuuagaauaaugccuggcacauaguaaucacucuauacuuauuagcuguuuaaaauuauaaccucaugaaauacauaaaagaaauauauauauuauauauauaauauauauguaaauauaauauauauauauuauauauaauauauauuauauauaauauauauuauauauuauauauuuauauauuauauauaaauuauauauuuauauauuauauauuuauauauauauauccuccaaaccaucaauccacaguaauaaaaggacuugguuugucucacuguggccagggagaaguaaaguuaauagagacaagacauuucaagguuccaagacucuucccuuaaagguggggaugaguuagggguccccagggggagcuacccagucugccaauguggugggaggaaagccaggggggcagucaggagacugggucccagcuggagaaggugcuccucugacaguuuuauauauauauuaaguagaaagaucucuaguacgcauuguugaaugggaaacaagcagaauacuauaugugguauuaugugguauuccaugauguuuaauguucuacuauucauguuucuaagggaaaaacuacuauaaauuugcuauggauaccuauguauguaaauguauaggaagaaaaggauuuggagaagggacuagaguuagaaaaaguaaucagaaaggauuuuacucuucuccgauuuuagauagagagauagauagauagaugauaaaugauaaauagaaauggauauaucauagauauacagagagauacauacauggacauagaauguauucauauacuuguagcuuuuaaaauauagauaaaacaggccaagaugguacaaauuguuauuccccuuguauaaauaagaaaacuaaagcucaaagguagcccauaugugccuaggcacacacagccaacaagccccagaggaaggaguggagcucagaucugcccuccccauugccuuuccaccacuccacccugccucucaaggccacccaggaguagacuaugacaaaagguagaagaaggggccuccuuguccauacuggcuggaaugguaaaagccaagugcgauggagaaucguguuguuguuuuuguuuuuaauuaaugaaccuguuggaaugugccauucagcaguggagcugaaugguuccugcuguucaugcaaaacaaacaaaaaucccuccacccaagcuacuucuguggccacuuuucuagccuuaucuauccagggacugugaaagggacacagaacugucagaggggcaccuucuccagcugggacccagucuccugacucccccuggcuuuccuccuaccacacuggcagaccggguaccucccacuggggagcccuaacugaucccaccuuuaagggaagagucuugaagcccugaaaugucuugucucuauuaaccuuacuucuccuugggccacagugagacaaaccaaguccuuuuauuacuguggcuugaugguuucaagggucuuuuccagaucuaauagccaaagaacauuagaauuuuccucuaugauacacuagaauaauaauaagcucucccucccuaaagaugauguuuaauuaaaaccucuggccauuuuggcuaucuucauauuuuuaaagaaaacccagauguagaagaaaagcauucuucaaauguuaaccauccauuccaucuccuggucaccuuagaaugucaugugucaaugaaaguugaaagguuuuugaagcaugguauaacugauaauacguuuuagcuuuaucauuuagcaacuggguggccuuggacaagcacagucucuucagccucaguguuuuccaucugaaaaaugggugcaauaccuacucuuaagguugcuguggggggucgggggagggggugaaagagauggcauuugggaagugcgugcaaccaggaggggccuaagacaugucucuucccuccuccagcuggauagcagcucuccuccuuccaugguuccaagacauccacagccugggucccccagacuugcccuaccaagugcuggcgccucuccaaagucugauucuuucuauuuuccuuaaguugcaaagcccaguguugagguguaauuguguguaagagggagaggggauggaucugguuucuuugaaaauggcuucuuugcuaaaacgacaaccucagaucugauacugaaagaaucugcuggcacuggccccugucagaacaauuuggagcuauccaggggccauccucuggggcuggcagccggccccccagcugagccucaugcucaaauucccaacaggcucagaggcaggccccgaacacacuucauccuacagccccauuccucccaugcaaaggcggcaagagagaaggagagaagggcuuggcauucugaagcaaaauucucuuucucugcugcaaccccccucagcccugccagccaccuuugcagaagccacacacgcgcacacacacacacacgcacacacgcacauuuucagaaagcccuuggcacagcccaccccuuccugagcuggacagagcugccagggcagauuugcccgggccgaggccgccuucuucaucuccagcccccucccauuccucuucuagagucaagguuuugucaggaguuucaggggcaaugacuggccagggagggggaccacagacauccugccugcugccaagucccuuucuuucccccacagugugucuuauaagccggcauguaguuuauucuucuccuaaacacuuccauagggugcagggccuggaguugccauagaaacaccuuuuaacuccuccucccccagaaugccaugccaggcccuaggacuuuggggaaaaaagacaaaaagagacaccuguggaugagcagagacaggaggaaaggccaucgggcagccccccggagaggaccaggccaggccuccugugccuuuugcuaggccaacauggcaccaagccaugaagagaaaaccaccaugaugguuuuaaaacaggaaguugaugggcugaugugaacaccuuuagggggcuacaaaguugacuggugggguugugugggucccaaggaauggggagcuccuucauauuuguuugagggcgagaauagacaguuucaacccagacuggaaaccagaaaggcucugagcaaugaaacuugggagccaaguacuggacgccagcagggugcugugcaaggcgagggaggucggcaggcaagcagcucacacccacaccucccauuuuaaaagcauuagcucaucccugccacuagugcagcucaccaaacccaggcagaacaauuugggauccgugccagagcaucgaagauuuuuuguuucuuuuuuucuuuuugauuccacaaucuccuggucuuuggcuacuuccugguaacuuagauuuucucugagaaauuuaugaagaggagcgagggagcuauuucuuguuucaauccagagaaauuguaagaaacuuucugcauugcucagacccaccgcaggaaaccuaagcaguaagcagacgggaaggcccccauuggaagcaggaucuacucaugcuuguuuucacuuuuccguggucaauuuuuaggguagaaaccccaaagcaaagggcaagggggaagaauggggaccuacucccacuacauaccaaaaaaacgcaagugaagucacccagcccauuuuccagcagaaaaggacuugggcugcaccccugcacacccugauuccaccugccagccuccuggccgcacgugugugauccugcugggcaaaaccagaacucagcugcagcagcaacuccccacacuaaucaggugggaauguuaccaacugggaugaggagggaaaggguaaguggaauguggguggagguggaggagggaggaaaacccuccccagucuucaggcugcccaaaaggaucuuucuaagcaauccacaaauccugggccagcuggguucccccaggagaggggaggauguaccaugcaggccccagggagccucuuacaagggugaccucaggucacacaaacacccucagcugccaacugcacugacauucuggucaccacacccccacucugaccucuaggcucagcccagcccaccagcagugccccucccggcccucacugccuccccugccaagcuccuaccuccucccccuccucaccacaacacgcugguagagucccucacccaagacucaguggaaaauuuccuucuccuuuaugacuguacuuaaaacacacacgcuccauucuucaccucugaaucgacacaggcagagggcggcaaggcugucccaccccaccgcccagcccagcccagugcacacacacacacucucccagcagagccacuggacuugcacgcuuuaugggcuggaaaggaggagagagauguuucccagaugccacuccaccuuuagccauccaaacacaagugucccaaacacucccagacaagccucccaggaugcucucggggcccuccauacacacuaaggaguaggaggucucuuuacagggucucucuacucaagacacuaaguccagucuggaacugucaccgugaugugacccuuggcagguuuguucuuuuggugacaaaucuguuuuccacuacccauucucccccuccccacacacauucaagggggaaaaaaauagccuuccugugaauuuucacagcuauguggugagugaccccucgcaccuucugcuggcuaucaacacucucaaacacagugccuccagggcgugggucaaugccacagcuuucuccucauuuucccccuuaaauccacccaaacuuggcagucccagaagcucgguuagcgcuugccugggaagccugcagcuggguugggucucagugaaaagaaugaauuucauaggcgcaggagaugaugcagacucggaguacuccaaguuucuccugcaacuuuccgugcacauggcgggcaacuuuuuuuuuuuuuuuuaacuauucaauuucccagcacuuuaguuagcauuccaaguuuugggaacccuuuccccacccuucucuucuagcccuuccuccguuaguagugaauggggacauuuuccagaugucaaaaggaccgguaggaaccucacgaccuaaguuaggaaagcaaaggcggccaggggcucccucagccacugugaguuuccucugcagggcaucuuccccucucagcuaugccagcgcccccgcccaaggacaucgaguuucuccacuccgccccaaccccgucugccccucuccuggggcagaggaaaggaguggggcucgcccugccucccuaagcagcgcugcaguccuggcugcagcguggggcucgggcggggcaccaggagcgcuuaccgaugucggaguugcagaaggcguccuggggguggcugggcgagcaugugcacgccucggcgccccagucccccaggcuccagcugcccaggagcacgaugagcccgagccaaggggucauugccgcugcugccgccgcugccggggcugcugcucgccucuccaaaguugccgugcgcgccgccggcggggcugcugcagcccgagcucgcucgcccgccgggccgugcggggcaaccuuggccuccggcgcgcugcccuccgagugcccggcgggacgggauggggcgcagcgaggcugccucggcgcuggcgcaggacucggcgggcggccucccggcgaaggagcaggagcuggaggagcaagaggaggaggagaagccgucugagcgcccgccgccugccugcugcccgcucugcgccgcugccugggcggccgagugauauagcgcugggcccccggggaccccgccucgggcuguuggggcccgcccccucagaccaauggcagagccgcauuaccucaucggcccuccaaaaagggggcggggccgggggcaagggguaacggggcggggccgcccccggaucguucagauccuu

SEQ ID NO: 16349 - RNA, 15225 nt, Homo sapiens
cuguccggugcggccccgggucccuguauuuuggguccggccugcucgccguccgcuccguccgcccuuagaccuguugcccagcaucccugcaguucgcgguacagucucuaguagagcgcguguauagaggcagagaggagugaaguccacaguuccucuccuccaagagguagaaggggcgcggggaaacgaccugguaucgguuuuccgcuugcugaucaagagcucccuuuaaugccgcacgcaggccggcgccccucacugauaaacgauuggggcugggccucggccuggagggcguucguccucucagugcccucagcucguaaaggaggaaaccgaggcgugggguugggcgagaacccagggguccuccugcacccccgccgccgugugucucguguccagcgcuggcuggagcgccucagcccuggcgcgguguagucgugagcuggaacuucugacacugccccuuccuuccccguccagccugccgaccaugcccgcgggcgugcccauguccaccuaccugaaaauguucgcagccagucuccuggccaugugcgcaggggcagaaguggugcacagguacuaccgaccggaccuggugagugcgggagggcuacuauuuuauuuuugagcuaaauauaccucauuucuuuguaaauuacccagccuuaggcauuccuuuauagcaaugcagaugcuccuggaccacuccauucuccucguggcagcaaaagugaucuugaacgaaauuaggaucacauuugcccugggcccaaaaccuuuggauggcaucccauugcaucuagggcaaugcauggccugugaggucuuacacagucuggccgcugccuaccuguggccuaucugccaccauuuuaccaguucuuuccccuguuaacauucacgccugcuuccuugcuguuucuccaacucaucaaaccuguccccauuucgaggccauucuuuucauuauccuuggcauguccuccuccccccaccacccccccaacaacuuggcuugguuuccuucuucaaaacuucaagucuuagcacaagucucuccuccagcaaugaggguccuuggguuagcucccaaagaauuccuccucugcgauuccgucucaucuuuuguuuccauagagcacuugucugcaguucuuugucuauuuauuuguucuuugucaguuugcuucaguagaauguaagcuccagacuaugucugucugguucagucuuguaucucaacugcuuggaauguagcagacacucaauaaguauuuguugaaugaaggaugagugacuauaggcauucaaaggaaggagaaauuuaaauuaauuuuaauaagcauucauuaggaacuagaauuaaagguucuuuucaggaauuagagucuuggggagguggagaugagaaaguauggcacaaauaauuacaagaaugugcuguuaugcuauaggugugaauagugguuuggagcacaauguugggagcagucauuucuguuuggacucugccuggacagguaacacuuucagagagucaaccauuaguguuucuuuuuuuagaaauuuuuauugaaaaauaauuuuaaaaaaauuagacaggucucauucuguugcccagguuggagugcaguggugcaaucagcucaccgcagccucacauuucuggguucaaucaguccuccugccucagccuccuaaguagcugagaugacuguguaccaucacacccagcuaauuuuuaaauuuuuuguagagacaaggucucaaaauguugcucaggcuggucuccaacuccuggcuucaaguaguccucccaccuuggccucugaaaguguugggauuacaggugugagccacugugccuggcuccauuuguauuugcacuuauguuuuauuuuuauuuuuugagacacagucucacucugucacccaggcuggagugcaguggcacaaucugagcucacugcaaccucugccuuccggguucaagcaaaucucaugcuucagccuccugaguagcugggauuacaggcauacaccaccaugcguggcuaaguuuuucuauuuuuuaguagauaugguguuucacuguguuggccaggcuggucuugaacuccuggccucaagugauccgcccgccucugccucccaaagugcugggguuacaggcaugagccacugugccuggcccauuuguauuuuuaacaucaguuaauugucacuacaauuuugaagguguuauuucuguuuucagaugagaaacagguugagaagagugaaguugauuucucaaagucacauagcuuagugagacgauuugaggaucugaagcccaagcuuucuguuugguaugucucuuuuuugcuccuguucauaaaauaauccaauacucuuguaaaacauucaaauugaguucaaguauguagaguaaaaagugaaaauccccccucuuauaaccuccuuucuccugucugcucacgacacguuaacuacuguuucuuguuuggugaauauccuuuacuacuucucacuguuguugaauguccacugauacggguuggauauuugucuccuccaaauuucacgccgaaaugugauccccaauguuggaaguaggaccuggcgggagguguuugggucauggggacgaaucccucaugaauggcuuggugcccucccuguggugaagagugaguucucacuuuauuaguucaugagagcugguuguuuaaaagaaccuggcucucucucucacucccucucuugccuuguguuacacaugcucccacuuugccuucugccaugaguuaaaagcuuucugaggccucaccggaagcuggacugauguuggugccaugcuuguacagccugcagaaccaagagccaaauaaacuucuuuauaaauuacccagccucaggcaaugcaaaauggacaaauacaccugugcaugcauguguacacacacaguuuguggaguguuuuuccuucaugugaauaggaguucacguacacauuucucugcaacuuccuuguuuugguuaacaucuacauaaauagacauuuguguauauuaaaucuuuuuaacuauugcauaguauuucauaauauagcugugacauauuauuugaucaaucccuuauugacauuuagguaguauguaguuuuuguacaaacaaugcugcaagagcucuuucuuacaacuucagagugcuucucuuuuaaaaaggguucuauugagcagcaagaauaccuaguggagacaaagugacaagaaccuuccacaguaaugcaguuuagucuauagcuugugcaggaauagacaucaggcaggccuugcaaaagaaggaaugccugggauuugacccugggaaguugaccuuugauucacccauuucauuauaauugggaaugugcaaggguuguuacagcagcuaccuguaccuugggaggagauagaaugaagccacagccuuuagaagggccauauugaagggucuaaacucaccucaguuugauuggguggugacauuggcaaugggguaucucuguaggaacuugaaggcccagguggcuggcuguguguugaaagcagugugcuuuauuaacauuuauauguucuuuaccuaugucuuuugguuuugcuccagcaauuacugucacuguugucaaccacuuuguucuuuguagcaaaacuggaucacaagucuuucggucggagaacuggaaggucugggcagagucgagcagaggagaccaugaugacugccuagacuugugcucagugcuguguuggggagaacugcuacaggugcuuuuaguuguccagcucagcucaucugaauagcaaaggagaugacucuguuguaguucagguugaaagcuaggagucauccuuaauuccucucucauacuguacauaugagcagaucccauuggauuaacuugaaagguacauccagaugcugccugcuucucaccaccucuuuugcuacuacccaguucaauccacugucagucacuuucaccuguuauuguaauagcuuccugaccugucuucugccuucgacucuugcucuccuguggucuauucucagcaaagcuaccauuaucaucucuguacacuugagugaggacaugccacucuucucagaacucuccagugucuucccauuucagagugaaaaacacuggagacuuuaucuccccacucccuuuuuccucugcccuugucuccucuuaaccucucugugaauacuuuguaccagcuauacugacaaccuugcuucuucuugaaccugaagccacacuccugccuuagguccucugcacuugugguuccaucugccugaaaugcuccuagguaacugcauggcugccucccucauccuccuccaugucuuuguucagcagucaucuucugaacaccaguaagcacacagaaagaugcucagcaucauuagccaccagagaaaggcaaaucaaaaccacagugaaauaccacuucauacccacuacaauggcuguaguaaaacagagaguaacaaguauugucaaggauguggagaaauugaaagccucacgcauuguugaugggaauauaaaauagugcaguggcuucagaaaagccugguaguuccucaagcaguuaaacaguuuccauaugacccagcaaugccacuuuuagguuuaugcccaauagacaugaaaacacauauucacacaaaaacuuguauaugaauguucagagcaguauuauucauaauauccaaaagguggaaaauccaaaugccuauuagcugaugaauggauaaauuguauauccauacaauggagcauuauucaguaauaaaaaaugaaauacugauacaagcuacaacauggaugaaccuugaaaacauuauucuaccugaaagaacacagaggaccacauauuauaugauuccauuuauagaaaauauccagaauaggcaaaucuauauagacaaaaagaagacuaauaguuaucuauggcuaugugggggaggguuguauggaaaugaaagugacugcuaauaaguaugggguuucuuuuuggggugaugaaaauuuucuaaaauuuauuguggugauagaugcagaacucugugaauaccuuccuggaaugcagggauuuuguauuuuuuugcauacugcuuucugcuuugcauauaauaggcacuuaauauuuuugaauuaauaaauuaauuccuaacgccuauuuucuaugccaggcacaugguagagagucaguagauggugcaggaaugaauuuccagauguggaaaguuuuauucaaagcugugaaccugucaauugauucugaugccagcuauccuuugugaguccugcaguacguaaugcugaagaccuugccaggaugauagacucauauaaacacaggguuagaaagggacuuagaucaaccagagcuucucauaauaaagaguuaucauugaguagcaagcaagggaacuuuuuguuauuuuuuacucuuuaaagucuucuagguuacauugaauuacagccuuauuaaggguuagacauuuauguuuuuuguuuuguuuuuuuugcagacaauaccugaaauuccaccaaagcguggagaacucaaaacggagcuuuugggacugaaagaaagaaaacacaaaccucaaguuucucaacaggaggaacuuaaauaacuaugccaagaauucugugaauaauauaagucuuaaauauguauuucuuaauuuauugcaucaaacuacuuguccuuaagcacuuagucuaaugcuaacugcaagaggaggugcucaguggauguuuagccgauacguugaaauuuaauuacgguuugauugauauuucuugaaaacugccaaagcacauaucaucaaaccauuucaugaauaugguuuggaagauguuuagucuugaauauaacgcgaaauagaauauuuguaagucuacuauauggguugucuuuauuucauauaaauuaagaaauuauuuaaaacuaugaacuaguuucauuaauugaauuugcuaaguggaguuauuucucauugcuaaacuguuuuuuuucaaauucuagaucucugcuaacuuuaguaaaugaacacuaaaguggugagcuuugauaaugcauuuuguggauacaaaaucaucgccucaucacuuucuagaaugaaaggcugggggcauugcucaccuuuugcgugaagaaaagaccugucccuuagagccaguuuuugcuuaaggggaggacagaccgucgucacccaguggaccacgugaaugaauggaugcagugcaugcuuuagaagcaccgcauaccuccuuuuacagguacagaguaaguggucuggcuacugagggaaagagucaugauuugaauccgagucuucuguaagacaaugacuucaugaaggugaaaaaucaguuuuaugguuauuaaaguaaaaauuuaccuuggguaaaaaugccaucuuuauuucauuaaguacugguucuaagugacuuccaauaagauacauuuucuuccuguuuugaaguugauccccauugugaaaaauauacauuguaguggucauggaaaugcgccauccauacucccuaaggcaggcuuguugcccuaguaucaagcaugccagcagcuuucaauggucagcuucuagaaggauugccucggcuaugguggccuugcucaaagccaugccuccugaaggggcccaaauccagugacuguuggaggugagaauagaaaggccuggccacuucagcacgugaguggugggcaacucugcugggcccaccacaacucccuaugggguuuagggacacugucuuuggaucugcauugcaacucaacuuauaccucugcucaguccuguuuccuuucucagguguugaucgaagggugugccuucauagacccccugcuaaacugcaccucaguguuucuuggagaaccaaaucuguaacauauaugcauuaaaaauuaaaggcaguacuauauuauccccuaauaauguuuuuuaacuuaaaaggccaagauagaccaguugcaaccuguuugguaauuaaauuaggccaguuaaacaguuuuuaugcaagacagguaugauugagcuguuuaucaaaaacugaaggaguaugaugcuuuccugcuaggaacagcagaaauuuagaaauuguaggauucugaggagcuaaagugucagauaucacuaauucaaugugaucugauggcuuugauuucuaugaguauaucauagcaguauuaacaaugguaaugcauaguggccccaaaaugggaaacauuucaaguagcaauuaauauaagccuguaucauaaaaggaagcuauauauaccuuaauuauagcauguuucuguaacugagcugccauucuaccacaaagggaaaagcagggugguuuucagaagacguacgcucaaguagggaagcugguaaugauuauugcaaacuaauucuagaaaaauaccuuaagguagggaggggguagggaagcaucaacagaaaaagaaguccauagagaaguacuagaucaucagaaaaacuguaaagucucuaaugaaacuuuguagcacauaaauuguguaaaauuuucuaauacacacaugauccuuaaauguacaguuaagacaucucucucuagcccacaguaaaaacaacaaaaacuuaagacuaccauuucaguuggcuguaacagacuagugaaauuaaaaauuguuucauaaacaagaguacauuucaaaauauaggucaauguggauuuucacucagugccaauaguuaucucugguaggauuaugggugauuuuuuucaaagauagcuuuuuuuuuuuuuuaaguuuagauuuacagaaaaaccacaucuaguagaguucccauauacgccacgcuguuucuaugaauguugucaucuuaagcuaccaugguacgucaguuaagaaaccaguauuggggucaggcgugguguuucaugccuguaaucccaacauuuugggaggccgaggugggcagaucauuugaggucaaguucaagaccagccuggccaacauggugaaaccccaucucuacuaaaaauaaauuagccaggcgugguggcgggugccuauaaucccagcuacucaggaggcugaggcaggagaaucgcuugaauccagguggagguugcagugagccaagaucguaccacugcacuccagccuaggagacagugacaccgucucaaaacaaaacccaauauugguacaauacucucaacuguacucuagacuccggacuuuagauuucacguuuuuccauuuaacauccuuuuguuuccaggguaccacauugcauuuauuaauaguugucauguaucuuuagucuucugccguccaugguuacuucucagccuguuuuucugagaaaaauuuucuggaaauuuugaagaauacuguucacauauucuaaauaugucuguuuuucucauuagauugagauuacagguuuuuggaaaccacagcaguacaauucacuucacauccuaucggggguacacaucacuggugauauuaacauugaucacuugguuaagucugccagguuucuccacugcaaaguuacuuuuucccuuuccauacucuguucuuuaggagucacuuaaucuagcccacauucaaaaaggagaagauuaagcuccacccuaugaaagggggaauaucuacauauauuuggaaaucuuuaaggaaauucucucuucucccuguggaagacuuuuuaaacucuuugguuuuucaacagucccaagcuccugaguucaaauaauccuccugccucagcuuccucaggaguugggaccacaggugugugucaccaugacuggcucaaccuuugauuuuuuaaaaaaaucuuuucuugggaggcggagguggguggaucacgaggucaggaguucaaagaccagccuggccaagauggugaaacccugucucuacuaaaaauacaaaaaauuagccggguguggugacgggcaccuguaaucccagcuacucaggaggcugaggcagagaauugcuugaacccggaaggcggagguugcagugagcagagauugcgccaccacacuccagccugggcaaaagugagacuuggucucaaaaaaaaaaaaggucauaagccugagucacuuuucuaagaaaaagaacccaagacacaugauuaaaaaaaaaaaaaauucagccaaguauuagguaguucucugcaagacagucaagacacugaguauuugggaucuuuuuuauuuuuauacacaugacaagauuuuacaucaagaauagucaguuaaauaguacaaauuuacauucaugaggaauguuaaaaaaaauucaacuaaaaaacccacuuuuuccugugacccauaaucccacauuuuacagugcaggggagaaggggauuagggggcauccaaaacaagucucucccaaaaagaaaugauguaaauuucacauucccucuccacacaggauccaaauggugagaguauaauuuacaauucaucuuuuucagcuguagauuccuguaaauaaauaaaaaaaacccagaagguauuaaaaguuagcagaaaaaaaaccuagcucacagguuugugcaugaaauaaacaauuuaaaugcucagucugacuucuguaaguuacacagucuuaacuuugccagaacuaaaacucuguccuaacuuugccagaacugaaaaugcaagucacauucuugauuugccauaccuuugcuguuucuucuucuucaucuguucccacauccauuucuucaucuucgucuugcucugugucuucuguugugucuucugcugucucuucagguucuucuucgggcucuucuuccaccuaaacacaacauuuaugggcccauuaaugccuuggauuuauuuccacuuugcucauuuauauguauaaaaucauaauuaaugucacuucuguuuauucagaaccacagacuaaauccucuuaacuagaaugaacagccaagcuaacaaaaggaggcaggcaaaaaggaaagaggacguaaaaggaggacuuaguuucuagugcagugccugacacuacagggauucaaacauucaauaaaauucuuucaaaagguagaaauuaggcaaaugucgcaaagcuacaucccucaaucaugagaggccuauucugaaagaacagaaacaaagaaagccagccagccuuugcgggaagguuggggauacaaaccuuugcaucagggucaauguucaaacugaggcgaagcauucuuucuauucuaucuccauaugcuuuagugucugguaaaagauacccugaccgaagcguugcuguuucaaacaaaaccacagcaagauccaaaacuguuuuaucaucuucaucuuccugaaaugcaagaagaugcacuagauuaauauuaaaagauacaaaguacucaaauuaaaagacaagcaagaggacugcuuuaauacuaccuuaauucgucgaagcaugucucugaucagcgggugucugggauuaauuucaaauguuuucuucugacucgcauaguaacuguuaagagauaaaaaugaacauuaacaaaacauauccaauuuuaggguucauacguuucccuuauucuuucauaauuacacagaacaacucuugguaaaaaaaaaaaaucaaaauguacuauugacacuugaacaccacagguuugaacuuauaugcuauuuuuuuuccaauaaauacaguccgcccuccguaugugcagguucagcaaccaaacucagauagaaaauaccguauucuugggauguggaauccacacacacagagcucccacucuucauauacacggguuccacagggcagacugggggacuagaauauuuguggauuuuggcagggguccuagaaccaaucucccucauacaccuaaggacgacuguacuuuuccagucuacuuuaucugcagagucaaucaaccucggauugaaaauauuagaaagggcaaaacaagaaaaaaauaaaaaacccaauacaguauaauagcuauuuacauagcacuuaaauugcauuagguauuaaaaguaaucuauagauuauuuaaaguacaugggaagaugugcauagguuauaugcaaauacggcacgacuuuaccuaagggacuugacuauguguggauuuugguauccaugggauguucuggaaccaacaccccauggacaaaaagggaugacugcacuguuuccuuauuuaguuuuuauagagacaggguaucacuauauugcacaggcuagucuugaacucuuggccucaagugauccucucaccucagccucccaaaguguugagauuacacacgugagccaugugcccagccuguauugcucccuuuuaacggggaggugggguggggagcaaguggacacgguuagaugaaaaaugaaaugaagggaacuauuuuauuuacugaugagucccaaguaccuggagcacugcugaacagacgaacugauuuaauguccuguuuguucccucuuaguuuauucuuacuaccguaauuguagcucugccuccccaaguucagaaaaaucuauguagccucuggauugugcuccaauaauaauaccuucuccacgaugccuucgccaaugauuccaagaaaaauuaacuuuaucugagcucaguuccaaaugcauuuugaauauaccuucaaaauccuuagcuuuuuacuguugguugugauuauucucucuucucuaguuuaaagcucugaggacagggaggaaccacauccuucccuauccugguguacccauuaucuauguagggcucggauuaugacuugcuuuuuuuccucuuuuuuaaauaaaaaagagacggagucuggcuauguuacccaggcuagagcuagagugcaaugccauuacagcacacuacagccucgaacucuuggaaucaacugauacuccugcaucagccuccugagugacaacaggagugagucaccaugccuggcuuugauuugucauuuucacuagucuaaauguuagaaaagacaggaguuaugucuaccugugaccaucagugcauggacauaguaagucuucauguuuguuggaugcaagguaacuuccuauuaaucauuuccugaaauuaauagguggacauguuuuaaauggcccuuguacuauugcaaugggauaucagauaaacagaacacuauucucugcaugaaauuuauaguuaaaagacauauauggaauuuuagaauugugacaacaauggagacuacauuugugagaaaaggcuuuaagaauaauaauccuggccaggcgcaguggcccacgccuguaaucccagcacuuugggaggccgcagagggcggaucaugaggucaggaguucgagaccagccuggccaacauggugaaacaccgucucuacuaaaaauacaaaaauuagcgggugugcugacaggugccuguaaucccagcuacucaggaggcuaagacaggagaauuacuugaacccaggaggcggagguugcagugagcagagauugcgccacuguacuccagccugggugacagagcaagacucugucucgggggaaaaaaaaaaagaauccuuaagcuaggccuugggaaaaaaggaugaugacuagauagcauaucagaaacauacuccaggugaaagaagagagaauaaaaguaggggagaagucauuuucaagaucauugcugugacauuaaaacauaaacuugaaauacuauauuucuugaaaauaaagaguaccaaagacucacuauaccuccagguauaggcccuugaguucaaauacuguuaauucacagguccuguaccgucuacuuuaugagacauucuaucuggauacccauaauuuaaugcuugggggugugggggacgugauuugaaauggacuuaacucacuugaggaauguugucauuaaccucgugcagcuauuacauuuaaaaauguaaaauaaauucagauauuaggcuaagcauauaauccaaugcaaaaguaaagacuaugcauaacacauuaagaaaauucccauuuacauaucaaauacaauaaaaucagaaaaucaugagucaaagaccuuuucuuucucaaucaaauguaggagaaaucccuucguaaacuuguugucuaccuuauaguagacagugguagacauuuaaggcaauuuuacucuuuguauugaagcugguauuaucuccaaaacaaagauuggguaaggggcaacgcccuggcagggacuuucccgaggaugcuuacuuuguagagauguccuugcccguuugguacgcuugugcuuucaugauucucuccauguugccagaccauccguacuggcuggccaccaaagcacacggagauucugucaggcgcugagacaccacagccuuuucaaucuuagggaaagaaaucaagucauauaaauuaauaucaacagguaaggucauugagcaauugucuuucaacugucuaagacuuuaucacuuaagaucauaaacacagaagcaggucauaaaaauagcuuuucuuaagguuuaggagaauuuguaggggcacuuacuugauaaucugaauuuucuagucagaaguuuaaauaccaccuuuuaaaaacauaaaauuuaauuuguaacaaguuauuaacaaagcaguauugucgaaaguuuuaagcuuucucccaauaauuuaauuacauuaauuaaauuuuuaccauucuaaugguuacaaaguaaccagcugcagcuuaauuuguucacaaaauaacuuucucuuaaaugcugauacuaauauuuccacaauuuguaauuuccacaguaccuuguccuuaagggcuuuaucuuucauccaauucagcagaggcucaaauucuuucucaacugcuucacgacucuccuuaguuuucucacuuucaucgaacuucacuccuuccuuggcaacauucuggaaccucuucccaucaaauucgggaagggccugaauacaguauucauccacagguucugugagguaaauaacuucauagcccuuuuucagaagucgcucaacaaauggagaagauucagccuacaaaauuaagaagucacaaaguuuuccaagucuggcccugguguauuuguuuauccuagcagcugcuauguuuauacauuauuaaaaacuccauuuuacaggugaagaauuaagagguucagagaauauaaaugaccuuccugucagugacugaccaggccuuauaacuacuccaguuacacaauuaaguuuuccuuuucucccccucaagaguuggcuauaaaucccuagcuaccuuccagaauggcugacaacacuuaugaguucaucucaccucuuuucugcuggacccagccaugaaguagauuuugucuuguuuuuccuucauucuuuccacauacuggucuaggcuaguaaugucaguuggaugaugagaagacuggaaccuaagaaguuuagcaagacguguucgauucgaguggucuucaaucacaccaagcuugauguugguaccaaauucuuuccaaaaaguaucauuguauuuaucaucagcaaucuucuugaucauguccagcguuuuacgaacaagcuucuuccuaaucaccuaaacacaaugaaagaauaacugauuagagaaguuaaucuccaacuuuugagaauguaagguacccaggcaggagugugaaaaacacaaagacgauaucguuauugccauuuauugaggggcaggaaauggugaagcacuccaauucauucagauugggcugaaauucagcuguccgugcaaauagccacaagauugccuuaauguuuauauucuaaccuuaggacucagugauacucucucucuagcaucuaaaugaagugaacaaauaugcuacuuucaaauacuuuuaaauucaaaaacuaaagagucuucuaauuauggaaguauuggaggggaaagguuuaaugaaaggcuugauaaaaagguggcuaugugucuagaugacaaaauguuaauccuggaccuguacaauucuuuaauuuuuuucuagauguuugaaacuucauuauuaaauguugggagaaaaagaaucagauucuuaggaucugauaacuccagaaagaaagga

SEQ ID NO: 16350 - RNA, 15225 nt, Homo sapiens
uccuuucuuucuggaguuaucagauccuaagaaucugauucuuuuucucccaacauuuaauaaugaaguuucaaacaucuagaaaaaaauuaaagaauuguacagguccaggauuaacauuuugucaucuagacacauagccaccuuuuuaucaagccuuucauuaaaccuuuccccuccaauacuuccauaauuagaagacucuuuaguuuuugaauuuaaaaguauuugaaaguagcauauuuguucacuucauuuagaugcuagagagagaguaucacugaguccuaagguuagaauauaaacauuaaggcaaucuuguggcuauuugcacggacagcugaauuucagcccaaucugaaugaauuggagugcuucaccauuuccugccccucaauaaauggcaauaacgauaucgucuuuguguuuuucacacuccugccuggguaccuuacauucucaaaaguuggagauuaacuucucuaaucaguuauucuuucauuguguuuaggugauuaggaagaagcuuguucguaaaacgcuggacaugaucaagaagauugcugaugauaaauacaaugauacuuuuuggaaagaauuugguaccaacaucaagcuuggugugauugaagaccacucgaaucgaacacgucuugcuaaacuucuuagguuccagucuucucaucauccaacugacauuacuagccuagaccaguauguggaaagaaugaaggaaaaacaagacaaaaucuacuucauggcuggguccagcagaaaagaggugagaugaacucauaaguguugucagccauucuggaagguagcuagggauuuauagccaacucuugagggggagaaaaggaaaacuuaauuguguaacuggaguaguuauaaggccuggucagucacugacaggaaggucauuuauauucucugaaccucuuaauucuucaccuguaaaauggaguuuuuaauaauguauaaacauagcagcugcuaggauaaacaaauacaccagggccagacuuggaaaacuuugugacuucuuaauuuuguaggcugaaucuucuccauuuguugagcgacuucugaaaaagggcuaugaaguuauuuaccucacagaaccuguggaugaauacuguauucaggcccuucccgaauuugaugggaagagguuccagaauguugccaaggaaggagugaaguucgaugaaagugagaaaacuaaggagagucgugaagcaguugagaaagaauuugagccucugcugaauuggaugaaagauaaagcccuuaaggacaagguacuguggaaauuacaaauuguggaaauauuaguaucagcauuuaagagaaaguuauuuugugaacaaauuaagcugcagcugguuacuuuguaaccauuagaaugguaaaaauuuaauuaauguaauuaaauuauugggagaaagcuuaaaacuuucgacaauacugcuuuguuaauaacuuguuacaaauuaaauuuuauguuuuuaaaaggugguauuuaaacuucugacuagaaaauucagauuaucaaguaagugccccuacaaauucuccuaaaccuuaagaaaagcuauuuuuaugaccugcuucuguguuuaugaucuuaagugauaaagucuuagacaguugaaagacaauugcucaaugaccuuaccuguugauauuaauuuauaugacuugauuucuuucccuaagauugaaaaggcuguggugucucagcgccugacagaaucuccgugugcuuugguggccagccaguacggauggucuggcaacauggagagaaucaugaaagcacaagcguaccaaacgggcaaggacaucucuacaaaguaagcauccucgggaaagucccugccagggcguugccccuuacccaaucuuuguuuuggagauaauaccagcuucaauacaaagaguaaaauugccuuaaaugucuaccacugucuacuauaagguagacaacaaguuuacgaagggauuucuccuacauuugauugagaaagaaaaggucuuugacucaugauuuucugauuuuauuguauuugauauguaaaugggaauuuucuuaauguguuaugcauagucuuuacuuuugcauuggauuauaugcuuagccuaauaucugaauuuauuuuacauuuuuaaauguaauagcugcacgagguuaaugacaacauuccucaagugaguuaaguccauuucaaaucacgucccccacacccccaagcauuaaauuauggguauccagauagaaugucucauaaaguagacgguacaggaccugugaauuaacaguauuugaacucaagggccuauaccuggagguauagugagucuuugguacucuuuauuuucaagaaauauaguauuucaaguuuauguuuuaaugucacagcaaugaucuugaaaaugacuucuccccuacuuuuauucucucuucuuucaccuggaguauguuucugauaugcuaucuagucaucauccuuuuuucccaaggccuagcuuaaggauucuuuuuuuuuuucccccgagacagagucuugcucugucacccaggcuggaguacaguggcgcaaucucugcucacugcaaccuccgccuccuggguucaaguaauucuccugucuuagccuccugaguagcugggauuacaggcaccugucagcacacccgcuaauuuuuguauuuuuaguagagacgguguuucaccauguuggccaggcuggucucgaacuccugaccucaugauccgcccucugcggccucccaaagugcugggauuacaggcgugggccacugcgccuggccaggauuauuauucuuaaagccuuuucucacaaauguagucuccauuguugucacaauucuaaaauuccauauaugucuuuuaacuauaaauuucaugcagagaauaguguucuguuuaucugauaucccauugcaauaguacaagggccauuuaaaacauguccaccuauuaauuucaggaaaugauuaauaggaaguuaccuugcauccaacaaacaugaagacuuacuauguccaugcacugauggucacagguagacauaacuccugucuuuucuaacauuuagacuagugaaaaugacaaaucaaagccaggcauggugacucacuccuguugucacucaggaggcugaugcaggaguaucaguugauuccaagaguucgaggcuguagugugcuguaauggcauugcacucuagcucuagccuggguaacauagccagacuccgucucuuuuuuauuuaaaaaagaggaaaaaaagcaagucauaauccgagcccuacauagauaauggguacaccaggauagggaaggaugugguuccucccuguccucagagcuuuaaacuagagaagagagaauaaucacaaccaacaguaaaaagcuaaggauuuugaagguauauucaaaaugcauuuggaacugagcucagauaaaguuaauuuuucuuggaaucauuggcgaaggcaucguggagaagguauuauuauuggagcacaauccagaggcuacauagauuuuucugaacuuggggaggcagagcuacaauuacgguaguaagaauaaacuaagagggaacaaacaggacauuaaaucaguucgucuguucagcagugcuccagguacuugggacucaucaguaaauaaaauaguucccuucauuucauuuuucaucuaaccguguccacuugcuccccaccccaccuccccguuaaaagggagcaauacaggcugggcacauggcucacguguguaaucucaacacuuugggaggcugaggugagaggaucacuugaggccaagaguucaagacuagccugugcaauauagugauacccugucucuauaaaaacuaaauaaggaaacagugcagucaucccuuuuuguccaugggguguugguuccagaacaucccauggauaccaaaauccacacauagucaagucccuuagguaaagucgugccguauuugcauauaaccuaugcacaucuucccauguacuuuaaauaaucuauagauuacuuuuaauaccuaaugcaauuuaagugcuauguaaauagcuauuauacuguauuggguuuuuuauuuuuuucuuguuuugcccuuucuaauauuuucaauccgagguugauugacucugcagauaaaguagacuggaaaaguacagucguccuuagguguaugagggagauugguucuaggaccccugccaaaauccacaaauauucuagucccccagucugcccuguggaacccguguauaugaagagugggagcucuguguguguggauuccacaucccaagaauacgguauuuucuaucugaguuugguugcugaaccugcacauacggagggcggacuguauuuauuggaaaaaaaauagcauauaaguucaaaccugugguguucaagugucaauaguacauuuugauuuuuuuuuuuuaccaagaguuguucuguguaauuaugaaagaauaagggaaacguaugaacccuaaaauuggauauguuuuguuaauguucauuuuuaucucuuaacaguuacuaugcgagucagaagaaaacauuugaaauuaaucccagacacccgcugaucagagacaugcuucgacgaauuaagguaguauuaaagcaguccucuugcuugucuuuuaauuugaguacuuuguaucuuuuaauauuaaucuagugcaucuucuugcauuucaggaagaugaagaugauaaaacaguuuuggaucuugcugugguuuuguuugaaacagcaacgcuucggucaggguaucuuuuaccagacacuaaagcauauggagauagaauagaaagaaugcuucgccucaguuugaacauugacccugaugcaaagguuuguauccccaaccuucccgcaaaggcuggcuggcuuucuuuguuucuguucuuucagaauaggccucucaugauugagggauguagcuuugcgacauuugccuaauuucuaccuuuugaaagaauuuuauugaauguuugaaucccuguagugucaggcacugcacuagaaacuaaguccuccuuuuacguccucuuuccuuuuugccugccuccuuuuguuagcuuggcuguucauucuaguuaagaggauuuagucugugguucugaauaaacagaagugacauuaauuaugauuuuauacauauaaaugagcaaaguggaaauaaauccaaggcauuaaugggcccauaaauguuguguuuagguggaagaagagcccgaagaagaaccugaagagacagcagaagacacaacagaagacacagagcaagacgaagaugaagaaauggaugugggaacagaugaagaagaagaaacagcaaagguauggcaaaucaagaaugugacuugcauuuucaguucuggcaaaguuaggacagaguuuuaguucuggcaaaguuaagacuguguaacuuacagaagucagacugagcauuuaaauuguuuauuucaugcacaaaccugugagcuagguuuuuuuucugcuaacuuuuaauaccuucuggguuuuuuuuauuuauuuacaggaaucuacagcugaaaaagaugaauuguaaauuauacucucaccauuuggauccuguguggagagggaaugugaaauuuacaucauuucuuuuugggagagacuuguuuuggaugcccccuaauccccuucuccccugcacuguaaaaugugggauuaugggucacaggaaaaaguggguuuuuuaguugaauuuuuuuuaacauuccucaugaauguaaauuuguacuauuuaacugacuauucuugauguaaaaucuugucauguguauaaaaauaaaaaagaucccaaauacucagugucuugacugucuugcagagaacuaccuaauacuuggcugaauuuuuuuuuuuuuuaaucaugugucuuggguucuuuuucuuagaaaagugacucaggcuuaugaccuuuuuuuuuuuugagaccaagucucacuuuugcccaggcuggagugugguggcgcaaucucugcucacugcaaccuccgccuuccggguucaagcaauucucugccucagccuccugaguagcugggauuacaggugcccgucaccacacccggcuaauuuuuuguauuuuuaguagagacaggguuucaccaucuuggccaggcuggucuuugaacuccugaccucgugauccacccaccuccgccucccaagaaaagauuuuuuuaaaaaaucaaagguugagccagucauggugacacacaccuguggucccaacuccugaggaagcugaggcaggaggauuauuugaacucaggagcuugggacuguugaaaaaccaaagaguuuaaaaagucuuccacagggagaagagagaauuuccuuaaagauuuccaaauauauguagauauucccccuuucauaggguggagcuuaaucuucuccuuuuugaaugugggcuagauuaagugacuccuaaagaacagaguauggaaagggaaaaaguaacuuugcaguggagaaaccuggcagacuuaaccaagugaucaauguuaauaucaccagugauguguacccccgauaggaugugaagugaauuguacugcugugguuuccaaaaaccuguaaucucaaucuaaugagaaaaacagacauauuuagaauaugugaacaguauucuucaaaauuuccagaaaauuuuucucagaaaaacaggcugagaaguaaccauggacggcagaagacuaaagauacaugacaacuauuaauaaaugcaaugugguacccuggaaacaaaaggauguuaaauggaaaaacgugaaaucuaaaguccggagucuagaguacaguugagaguauuguaccaauauuggguuuuguuuugagacggugucacugucuccuaggcuggagugcagugguacgaucuuggcucacugcaaccuccaccuggauucaagcgauucuccugccucagccuccugaguagcugggauuauaggcacccgccaccacgccuggcuaauuuauuuuuaguagagaugggguuucaccauguuggccaggcuggucuugaacuugaccucaaaugaucugcccaccucggccucccaaaauguugggauuacaggcaugaaacaccacgccugaccccaauacugguuucuuaacugacguaccaugguagcuuaagaugacaacauucauagaaacagcguggcguauaugggaacucuacuagaugugguuuuucuguaaaucuaaacuuaaaaaaaaaaaaaagcuaucuuugaaaaaaaucacccauaauccuaccagagauaacuauuggcacugagugaaaauccacauugaccuauauuuugaaauguacucuuguuuaugaaacaauuuuuaauuucacuagucuguuacagccaacugaaaugguagucuuaaguuuuuguuguuuuuacugugggcuagagagagaugucuuaacuguacauuuaaggaucauguguguauuagaaaauuuuacacaauuuaugugcuacaaaguuucauuagagacuuuacaguuuuucugaugaucuaguacuucucuauggacuucuuuuucuguugaugcuucccuacccccucccuaccuuaagguauuuuucuagaauuaguuugcaauaaucauuaccagcuucccuacuugagcguacgucuucugaaaaccacccugcuuuucccuuugugguagaauggcagcucaguuacagaaacaugcuauaauuaagguauauauagcuuccuuuuaugauacaggcuuauauuaauugcuacuugaaauguuucccauuuuggggccacuaugcauuaccauuguuaauacugcuaugauauacucauagaaaucaaagccaucagaucacauugaauuagugauaucugacacuuuagcuccucagaauccuacaauuucuaaauuucugcuguuccuagcaggaaagcaucauacuccuucaguuuuugauaaacagcucaaucauaccugucuugcauaaaaacuguuuaacuggccuaauuuaauuaccaaacagguugcaacuggucuaucuuggccuuuuaaguuaaaaaacauuauuaggggauaauauaguacugccuuuaauuuuuaaugcauauauguuacagauuugguucuccaagaaacacugaggugcaguuuagcagggggucuaugaaggcacacccuucgaucaacaccugagaaaggaaacaggacugagcagagguauaaguugaguugcaaugcagauccaaagacagugucccuaaaccccauagggaguuguggugggcccagcagaguugcccaccacucacgugcugaaguggccaggccuuucuauucucaccuccaacagucacuggauuugggccccuucaggaggcauggcuuugagcaaggccaccauagccgaggcaauccuucuagaagcugaccauugaaagcugcuggcaugcuugauacuagggcaacaagccugccuuagggaguauggauggcgcauuuccaugaccacuacaauguauauuuuucacaauggggaucaacuucaaaacaggaagaaaauguaucuuauuggaagucacuuagaaccaguacuuaaugaaauaaagauggcauuuuuacccaagguaaauuuuuacuuuaauaaccauaaaacugauuuuucaccuucaugaagucauugucuuacagaagacucggauucaaaucaugacucuuucccucaguagccagaccacuuacucuguaccuguaaaaggagguaugcggugcuucuaaagcaugcacugcauccauucauucacgugguccacugggugacgacggucuguccuccccuuaagcaaaaacuggcucuaagggacaggucuuuucuucacgcaaaaggugagcaaugcccccagccuuucauucuagaaagugaugaggcgaugauuuuguauccacaaaaugcauuaucaaagcucaccacuuuaguguucauuuacuaaaguuagcagagaucuagaauuugaaaaaaaacaguuuagcaaugagaaauaacuccacuuagcaaauucaauuaaugaaacuaguucauaguuuuaaauaauuucuuaauuuauaugaaauaaagacaacccauauaguagacuuacaaauauucuauuucgcguuauauucaagacuaaacaucuuccaaaccauauucaugaaaugguuugaugauaugugcuuuggcaguuuucaagaaauaucaaucaaaccguaauuaaauuucaacguaucggcuaaacauccacugagcaccuccucuugcaguuagcauuagacuaagugcuuaaggacaaguaguuugaugcaauaaauuaagaaauacauauuuaagacuuauauuauucacagaauucuuggcauaguuauuuaaguuccuccuguugagaaacuugagguuuguguuuucuuucuuucagucccaaaagcuccguuuugaguucuccacgcuuugguggaauuucagguauugucugcaaaaaaaacaaaacaaaaaacauaaaugucuaacccuuaauaaggcuguaauucaauguaaccuagaagacuuuaaagaguaaaaaauaacaaaaaguucccuugcuugcuacucaaugauaacucuuuauuaugagaagcucugguugaucuaagucccuuucuaacccuguguuuauaugagucuaucauccuggcaaggucuucagcauuacguacugcaggacucacaaaggauagcuggcaucagaaucaauugacagguucacagcuuugaauaaaacuuuccacaucuggaaauucauuccugcaccaucuacugacucucuaccaugugccuggcauagaaaauaggcguuaggaauuaauuuauuaauucaaaaauauuaagugccuauuauaugcaaagcagaaagcaguaugcaaaaaaauacaaaaucccugcauuccaggaagguauucacagaguucugcaucuaucaccacaauaaauuuuagaaaauuuucaucaccccaaaaagaaaccccauacuuauuagcagucacuuucauuuccauacaacccucccccacauagccauagauaacuauuagucuucuuuuugucuauauagauuugccuauucuggauauuuucuauaaauggaaucauauaauaugugguccucuguguucuuucagguagaauaauguuuucaagguucauccauguuguagcuuguaucaguauuucauuuuuuauuacugaauaaugcuccauuguauggauauacaauuuauccauucaucagcuaauaggcauuuggauuuuccaccuuuuggauauuaugaauaauacugcucugaacauucauauacaaguuuuugugugaauauguguuuucaugucuauugggcauaaaccuaaaaguggcauugcugggucauauggaaacuguuuaacugcuugaggaacuaccaggcuuuucugaagccacugcacuauuuuauauucccaucaacaaugcgugaggcuuucaauuucuccacauccuugacaauacuuguuacucucuguuuuacuacagccauuguaguggguaugaagugguauuucacugugguuuugauuugccuuucucugguggcuaaugaugcugagcaucuuucugugugcuuacugguguucagaagaugacugcugaacaaagacauggaggaggaugagggaggcagccaugcaguuaccuaggagcauuucaggcagauggaaccacaagugcagaggaccuaaggcaggaguguggcuucagguucaagaagaagcaagguugucaguauagcugguacaaaguauucacagagagguuaagaggagacaagggcagaggaaaaagggaguggggagauaaagucuccaguguuuuucacucugaaaugggaagacacuggagaguucugagaagaguggcauguccucacucaaguguacagagaugauaaugguagcuuugcugagaauagaccacaggagagcaagagucgaaggcagaagacaggucaggaagcuauuacaauaacaggugaaagugacugacaguggauugaacuggguaguagcaaaagagguggugagaagcaggcagcaucuggauguaccuuucaaguuaauccaaugggaucugcucauauguacaguaugagagaggaauuaaggaugacuccuagcuuucaaccugaacuacaacagagucaucuccuuugcuauucagaugagcugagcuggacaacuaaaagcaccuguagcaguucuccccaacacagcacugagcacaagucuaggcagucaucauggucuccucugcucgacucugcccagaccuuccaguucuccgaccgaaagacuugugauccaguuuugcuacaaagaacaaagugguugacaacagugacaguaauugcuggagcaaaaccaaaagacauagguaaagaacauauaaauguuaauaaagcacacugcuuucaacacacagccagccaccugggccuucaaguuccuacagagauaccccauugccaaugucaccacccaaucaaacugaggugaguuuagacccuucaauauggcccuucuaaaggcuguggcuucauucuaucuccucccaagguacagguagcugcuguaacaacccuugcacauucccaauuauaaugaaaugggugaaucaaaggucaacuucccagggucaaaucccaggcauuccuucuuuugcaaggccugccugaugucuauuccugcacaagcuauagacuaaacugcauuacuguggaagguucuugucacuuugucuccacuagguauucuugcugcucaauagaacccuuuuuaaaagagaagcacucugaaguuguaagaaagagcucuugcagcauuguuuguacaaaaacuacauacuaccuaaaugucaauaagggauugaucaaauaauaugucacagcuauauuaugaaauacuaugcaauaguuaaaaagauuuaauauacacaaaugucuauuuauguagauguuaaccaaaacaaggaaguugcagagaaauguguacgugaacuccuauucacaugaaggaaaaacacuccacaaacuguguguguacacaugcaugcacagguguauuuguccauuuugcauugccugaggcuggguaauuuauaaagaaguuuauuuggcucuugguucugcaggcuguacaagcauggcaccaacaucaguccagcuuccggugaggccucagaaagcuuuuaacucauggcagaaggcaaagugggagcauguguaacacaaggcaagagagggagugagagagagagccagguucuuuuaaacaaccagcucucaugaacuaauaaagugagaacucacucuucaccacagggagggcaccaagccauucaugagggauucguccccaugacccaaacaccucccgccagguccuacuuccaacauuggggaucacauuucggcgugaaauuuggaggagacaaauauccaacccguaucaguggacauucaacaacagugagaaguaguaaaggauauucaccaaacaagaaacaguaguuaacgugucgugagcagacaggagaaaggagguuauaagaggggggauuuucacuuuuuacucuacauacuugaacucaauuugaauguuuuacaagaguauuggauuauuuuaugaacaggagcaaaaaagagacauaccaaacagaaagcuugggcuucagauccucaaaucgucucacuaagcuaugugacuuugagaaaucaacuucacucuucucaaccuguuucucaucugaaaacagaaauaacaccuucaaaauuguagugacaauuaacugauguuaaaaauacaaaugggccaggcacaguggcucaugccuguaaccccagcacuuugggaggcagaggcgggcggaucacuugaggccaggaguucaagaccagccuggccaacacagugaaacaccauaucuacuaaaaaauagaaaaacuuagccacgcauggugguguaugccuguaaucccagcuacucaggaggcugaagcaugagauuugcuugaacccggaaggcagagguugcagugagcucagauugugccacugcacuccagccugggugacagagugagacugugucucaaaaaauaaaaauaaaacauaagugcaaauacaaauggagccaggcacaguggcucacaccuguaaucccaacacuuucagaggccaaggugggaggacuacuugaagccaggaguuggagaccagccugagcaacauuuugagaccuugucucuacaaaaaauuuaaaaauuagcugggugugaugguacacagucaucucagcuacuuaggaggcugaggcaggaggacugauugaacccagaaaugugaggcugcggugagcugauugcaccacugcacuccaaccugggcaacagaaugagaccugucuaauuuuuuuaaaauuauuuuucaauaaaaauuucuaaaaaaagaaacacuaaugguugacucucugaaaguguuaccuguccaggcagaguccaaacagaaaugacugcucccaacauugugcuccaaaccacuauucacaccuauagcauaacagcacauucuuguaauuauuugugccauacuuucucaucuccaccuccccaagacucuaauuccugaaaagaaccuuuaauucuaguuccuaaugaaugcuuauuaaaauuaauuuaaauuucuccuuccuuugaaugccuauagucacucauccuucauucaacaaauacuuauugagugucugcuacauuccaagcaguugagauacaagacugaaccagacagacauagucuggagcuuacauucuacugaagcaaacugacaaagaacaaauaaauagacaaagaacugcagacaagugcucuauggaaacaaaagaugagacggaaucgcagaggaggaauucuuugggagcuaacccaaggacccucauugcuggaggagagacuugugcuaagacuugaaguuuugaagaaggaaaccaagccaaguuguugggggggugguggggggaggaggacaugccaaggauaaugaaaagaauggccucgaaauggggacagguuugaugaguuggagaaacagcaaggaagcaggcgugaauguuaacaggggaaagaacugguaaaaugguggcagauaggccacagguaggcagcggccagacuguguaagaccucacaggccaugcauugcccuagaugcaaugggaugccauccaaagguuuugggcccagggcaaaugugauccuaauuucguucaagaucacuuuugcugccacgaggagaauggagugguccaggagcaucugcauugcuauaaaggaaugccuaaggcuggguaauuuacaaagaaaugagguauauuuagcucaaaaauaaaauaguagcccucccgcacucaccagguccggucgguaguaccugugcaccacuucugccccugcgcacauggccaggagacuggcugcgaacauuuucagguagguggacaugggcacgcccgcgggcauggucggcaggcuggacggggaaggaaggggcagugucagaaguuccagcucacgacuacaccgcgccagggcugaggcgcuccagccagcgcuggacacgagacacacggcggcgggggugcaggaggaccccuggguucucgcccaaccccacgccucgguuuccuccuuuacgagcugagggcacugagaggacgaacgcccuccaggccgaggcccagccccaaucguuuaucagugaggggcgccggccugcgugcggcauuaaagggagcucuugaucagcaagcggaaaaccgauaccaggucguuuccccgcgccccuucuaccucuuggaggagaggaacuguggacuucacuccucucugccucuauacacgcgcucuacuagagacuguaccgcgaacugcagggaugcugggcaacaggucuaagggcggacggagcggacggcgagcaggccggacccaaaauacagggacccggggccgcaccggacag

SEQ ID NO: 16351 - RNA, 18188 nt, Homo sapiens
agauuaagcuccacccuaugaaagggggaauaucuacauauauuuggaaaucuuuaaggaaauucucucuucucccuguggaagacuuuuuaaacucuuugguuuuucaacagucccaagcuccugaguucaaauaauccuccugccucagcuuccucaggaguugggaccacaggugugugucaccaugacuggcucaaccuuugauuuuuuaaaaaaaucuuuucuugggaggcggagguggguggaucacgaggucaggaguucaaagaccagccuggccaagauggugaaacccugucucuacuaaaaauacaaaaaauuagccggguguggugacgggcaccuguaaucccagcuacucaggaggcugaggcagagaauugcuugaacccggaaggcggagguugcagugagcagagauugcgccaccacacuccagccugggcaaaagugagacuuggucucaaaaaaaaaaaaggucauaagccugagucacuuuucuaagaaaaagaacccaagacacaugauuaaaaaaaaaaaaaauucagccaaguauuagguaguucucugcaagacagucaagacacugaguauuugggaucuuuuuuauuuuuauacacaugacaagauuuuacaucaagaauagucaguuaaauaguacaaauuuacauucaugaggaauguuaaaaaaaauucaacuaaaaaacccacuuuuuccugugacccauaaucccacauuuuacagugcaggggagaaggggauuagggggcauccaaaacaagucucucccaaaaagaaaugauguaaauuucacauucccucuccacacaggauccaaauggugagaguauaauuuacaauucaucuuuuucagcuguagauuccuguaaauaaauaaaaaaaacccagaagguauuaaaaguuagcagaaaaaaaaccuagcucacagguuugugcaugaaauaaacaauuuaaaugcucagucugacuucuguaaguuacacagucuuaacuuugccagaacuaaaacucuguccuaacuuugccagaacugaaaaugcaagucacauucuugauuugccauaccuuugcuguuucuucuucuucaucuguucccacauccauuucuucaucuucgucuugcucugugucuucuguugugucuucugcugucucuucagguucuucuucgggcucuucuuccaccuaaacacaacauuuaugggcccauuaaugccuuggauuuauuuccacuuugcucauuuauauguauaaaaucauaauuaaugucacuucuguuuauucagaaccacagacuaaauccucuuaacuagaaugaacagccaagcuaacaaaaggaggcaggcaaaaaggaaagaggacguaaaaggaggacuuaguuucuagugcagugccugacacuacagggauucaaacauucaauaaaauucuuucaaaagguagaaauuaggcaaaugucgcaaagcuacaucccucaaucaugagaggccuauucugaaagaacagaaacaaagaaagccagccagccuuugcgggaagguuggggauacaaaccuuugcaucagggucaauguucaaacugaggcgaagcauucuuucuauucuaucuccauaugcuuuagugucugguaaaagauacccugaccgaagcguugcuguuucaaacaaaaccacagcaagauccaaaacuguuuuaucaucuucaucuuccugaaaugcaagaagaugcacuagauuaauauuaaaagauacaaaguacucaaauuaaaagacaagcaagaggacugcuuuaauacuaccuuaauucgucgaagcaugucucugaucagcgggugucugggauuaauuucaaauguuuucuucugacucgcauaguaacuguuaagagauaaaaaugaacauuaacaaaacauauccaauuuuaggguucauacguuucccuuauucuuucauaauuacacagaacaacucuugguaaaaaaaaaaaaucaaaauguacuauugacacuugaacaccacagguuugaacuuauaugcuauuuuuuuuccaauaaauacaguccgcccuccguaugugcagguucagcaaccaaacucagauagaaaauaccguauucuugggauguggaauccacacacacagagcucccacucuucauauacacggguuccacagggcagacugggggacuagaauauuuguggauuuuggcagggguccuagaaccaaucucccucauacaccuaaggacgacuguacuuuuccagucuacuuuaucugcagagucaaucaaccucggauugaaaauauuagaaagggcaaaacaagaaaaaaauaaaaaacccaauacaguauaauagcuauuuacauagcacuuaaauugcauuagguauuaaaaguaaucuauagauuauuuaaaguacaugggaagaugugcauagguuauaugcaaauacggcacgacuuuaccuaagggacuugacuauguguggauuuugguauccaugggauguucuggaaccaacaccccauggacaaaaagggaugacugcacuguuuccuuauuuaguuuuuauagagacaggguaucacuauauugcacaggcuagucuugaacucuuggccucaagugauccucucaccucagccucccaaaguguugagauuacacacgugagccaugugcccagccuguauugcucccuuuuaacggggaggugggguggggagcaaguggacacgguuagaugaaaaaugaaaugaagggaacuauuuuauuuacugaugagucccaaguaccuggagcacugcugaacagacgaacugauuuaauguccuguuuguucccucuuaguuuauucuuacuaccguaauuguagcucugccuccccaaguucagaaaaaucuauguagccucuggauugugcuccaauaauaauaccuucuccacgaugccuucgccaaugauuccaagaaaaauuaacuuuaucugagcucaguuccaaaugcauuuugaauauaccuucaaaauccuuagcuuuuuacuguugguugugauuauucucucuucucuaguuuaaagcucugaggacagggaggaaccacauccuucccuauccugguguacccauuaucuauguagggcucggauuaugacuugcuuuuuuuccucuuuuuuaaauaaaaaagagacggagucuggcuauguuacccaggcuagagcuagagugcaaugccauuacagcacacuacagccucgaacucuuggaaucaacugauacuccugcaucagccuccugagugacaacaggagugagucaccaugccuggcuuugauuugucauuuucacuagucuaaauguuagaaaagacaggaguuaugucuaccugugaccaucagugcauggacauaguaagucuucauguuuguuggaugcaagguaacuuccuauuaaucauuuccugaaauuaauagguggacauguuuuaaauggcccuuguacuauugcaaugggauaucagauaaacagaacacuauucucugcaugaaauuuauaguuaaaagacauauauggaauuuuagaauugugacaacaauggagacuacauuugugagaaaaggcuuuaagaauaauaauccuggccaggcgcaguggcccacgccuguaaucccagcacuuugggaggccgcagagggcggaucaugaggucaggaguucgagaccagccuggccaacauggugaaacaccgucucuacuaaaaauacaaaaauuagcgggugugcugacaggugccuguaaucccagcuacucaggaggcuaagacaggagaauuacuugaacccaggaggcggagguugcagugagcagagauugcgccacuguacuccagccugggugacagagcaagacucugucucgggggaaaaaaaaaaagaauccuuaagcuaggccuugggaaaaaaggaugaugacuagauagcauaucagaaacauacuccaggugaaagaagagagaauaaaaguaggggagaagucauuuucaagaucauugcugugacauuaaaacauaaacuugaaauacuauauuucuugaaaauaaagaguaccaaagacucacuauaccuccagguauaggcccuugaguucaaauacuguuaauucacagguccuguaccgucuacuuuaugagacauucuaucuggauacccauaauuuaaugcuugggggugugggggacgugauuugaaauggacuuaacucacuugaggaauguugucauuaaccucgugcagcuauuacauuuaaaaauguaaaauaaauucagauauuaggcuaagcauauaauccaaugcaaaaguaaagacuaugcauaacacauuaagaaaauucccauuuacauaucaaauacaauaaaaucagaaaaucaugagucaaagaccuuuucuuucucaaucaaauguaggagaaaucccuucguaaacuuguugucuaccuuauaguagacagugguagacauuuaaggcaauuuuacucuuuguauugaagcugguauuaucuccaaaacaaagauuggguaaggggcaacgcccuggcagggacuuucccgaggaugcuuacuuuguagagauguccuugcccguuugguacgcuugugcuuucaugauucucuccauguugccagaccauccguacuggcuggccaccaaagcacacggagauucugucaggcgcugagacaccacagccuuuucaaucuuagggaaagaaaucaagucauauaaauuaauaucaacagguaaggucauugagcaauugucuuucaacugucuaagacuuuaucacuuaagaucauaaacacagaagcaggucauaaaaauagcuuuucuuaagguuuaggagaauuuguaggggcacuuacuugauaaucugaauuuucuagucagaaguuuaaauaccaccuuuuaaaaacauaaaauuuaauuuguaacaaguuauuaacaaagcaguauugucgaaaguuuuaagcuuucucccaauaauuuaauuacauuaauuaaauuuuuaccauucuaaugguuacaaaguaaccagcugcagcuuaauuuguucacaaaauaacuuucucuuaaaugcugauacuaauauuuccacaauuuguaauuuccacaguaccuuguccuuaagggcuuuaucuuucauccaauucagcagaggcucaaauucuuucucaacugcuucacgacucuccuuaguuuucucacuuucaucgaacuucacuccuuccuuggcaacauucuggaaccucuucccaucaaauucgggaagggccugaauacaguauucauccacagguucugugagguaaauaacuucauagcccuuuuucagaagucgcucaacaaauggagaagauucagccuacaaaauuaagaagucacaaaguuuuccaagucuggcccugguguauuuguuuauccuagcagcugcuauguuuauacauuauuaaaaacuccauuuuacaggugaagaauuaagagguucagagaauauaaaugaccuuccugucagugacugaccaggccuuauaacuacuccaguuacacaauuaaguuuuccuuuucucccccucaagaguuggcuauaaaucccuagcuaccuuccagaauggcugacaacacuuaugaguucaucucaccucuuuucugcuggacccagccaugaaguagauuuugucuuguuuuuccuucauucuuuccacauacuggucuaggcuaguaaugucaguuggaugaugagaagacuggaaccuaagaaguuuagcaagacguguucgauucgaguggucuucaaucacaccaagcuugauguugguaccaaauucuuuccaaaaaguaucauuguauuuaucaucagcaaucuucuugaucauguccagcguuuuacgaacaagcuucuuccuaaucaccuaaacacaaugaaagaauaacugauuagagaaguuaaucuccaacuuuugagaauguaagguacccaggcaggagugugaaaaacacaaagacgauaucguuauugccauuuauugaggggcaggaaauggugaagcacuccaauucauucagauugggcugaaauucagcuguccgugcaaauagccacaagauugccuuaauguuuauauucuaaccuuaggacucagugauacucucucucuagcaucuaaaugaagugaacaaauaugcuacuuucaaauacuuuuaaauucaaaaacuaaagagucuucuaauuauggaaguauuggaggggaaagguuuaaugaaaggcuugauaaaaagguggcuaugugucuagaugacaaaauguuaauccuggaccuguacaauucuuuaauuuuuuucuagauguuugaaacuucauuauuaaauguugggagaaaaagaaucagauucuuaggaucugauaacuccagaaagaaaggaaauucaucugaagaaucauggaccagacccaaaaucugguuuuacuccacaaauggagccuguccucugaaccccaaucaaacagcaaaguggagaguuucuucccagagacacuuaccuuaagcaguuuauguugcugaagagucucgcgggaaacauucaaggggagaucaucugaguccaccuucagauggcaaaagaaaguucagugagcaauaaaaccacuggaagaaagcaaagccaaacaaacacucuacacugccagacccccacaacaaucaccccuucucccaaacuucagauacuuaccacacccuugacaaaauugagguauuuaggcaucauaucauggaagucgucugugaugaauacacggcgcacauagagcuaaagagaccaaaaaaaagucacuuucuggaaauuaaacuuucaaauuuuaaacgcagcauguacuacuuaaaaacucaccuuaauguaaucgcucuuuuuagauccauauucgucaaacagaccacguggagcagauguggguacaaauaaaauugauuugaagguaacuuccccuucagcaguaaagugaauauaagccauggggucaucacuuuccuguggaaaguugguaucuuagucauucaaacgacacaggagaaaagcagugcaagaacuaagcaauguacuaugugguacauauucaguuuagcaauuaacuaacaaaaaauuuuccuuuacuggcgggagguggggaagagaaagaaaaggguggggggaagagaaagaaaaggguggagugaagaaauaucuagaauugcaauucuaauucacuagacaugguuguuuugaugaugauugucaauaacauuauuuccuaaacucucagaaggaaggaugaguuuauacuucuuacguaugagagaagugaauaggaaaaccaccacccugccuaaaugacaaaauuacauacaacacuucagugugcccuugaacuacaguaaguacucaagaacauguuucuuccauggaacuuagcucuaagaguggcuacaaagauguauguaaauaccuguaaaacaaaguuggaaauucucuugaucugcauuaucuauuacuguauauggcuguuaagcacugaaauguagcuaguucaaauucagaugugcuauuaaaguguaaaauacauuuugaaggcacaguacaaauuuuaaaaaggauauaaaaugucucauuauuaguuuuuauauugauuauguugaaauaauacuauuugggguaugcuggguuaaauaaauuauacuauuaacauuucaugguuccuuuuuuuguauggcuucuaaaaaauuucaaaucauguguggcucacauuaauuauauuucuaauacagcugcuuuauaugaaguaaguuuauagacacuaggacuuuagaguuuauggaaauaaaagugaaggcagaaccaacaguguuuuaagaguugaaauuuaaaggauauggaauagagaaaagaacaaauacagacacagaauauuaaguuuuauuuagcuaugguuaaguccacuagagcauucuacugcuuguacuaaaugcugcuggggaaacauuaacuuuaaacaaacuuuaucaaugcuaguuuugcauccuuaagaguuacaagaagggaucaauaaaagaagaagaaaaaaaaaaacaggcaaggaaacauaaauuuaguaauuauucccaggcauaggaucucacaauaaguguuugaugucauaagcaagcucuuuaaagauuauauuaaaagccacuuaacaacaugauuucauguuuuacggguuuugugguggaaaucacacaucuaccuauguaggugguucuuaaucuuuuuuugucacacaaaacccuuggcaagcuggugaaggcuacagaugccuucucaaaauaauuuuuuuaaaaaaaucacauauuacaaaauacacaggaauaaaaaggaaaccaauuguguuuaaacagccauaaaacuguuucaaacauucuugauuuuguaguuucacuauucacuaagagcuaggacuaauuuuaauaacugcugcaauuuugaaguagugaugaguauaauaauucaacuuaaguaaaaaugguguguucuggaaaccaauuacucucaaagaccaucucuacugaggugucaaucucaaagguucauaaaugugauuuuaauugugacuaggucaauaaaccagaaguagacauauuauaguuggccuaaaggucuuuuuuugaauuuucucacugggaaaaaaugggaauggaccaucucauauucauggucacauaccauauacaauuaaacuaagagggugauauuuugucuauucauuaauaaccagaaacuagggaauuauaaauauuuaccuuugaaaaugauuuguagaaagcuuuguauucaucuucuucuacuucuuuugauggucucugccauauugguuugauaucauucauaaguucccagucccagacaguuuuuucaaccugaaguuauuauaguauuugauuagucucucucagcacucaccaagguuauccuagcaguaaccauggcuucaguagauuucaaaagacuauguaaagacccagaggacuggugugguggcucacgccuguaauccuagcacuuugggagguuaggguaggagaacuguuugagccuaggaguucaagaccaguccaggcaacauagcaagaccuccaacuauacaaaaaauuuuuaaaacuuagccagucaugguggcgugugucugugguccuagcuacuugggaggcugaggugaaaggacugcuuaagccuaggaguucaaggaugaagggagcuaugaucgugcuaccacacuccagccuggguggcagagacucugucuccaaauuaaagaaaaaaaaaaaaagggcaccaaaggauaccuguuaucuaguaagguuucugccaacuguaucaaaagcaaaguauuuuucucaauauuuaauucaaaaagacaauuguuaacugaugaaaagccacuuaaguuuuucuucauuguuauuuuuuaacuagcaaaaauguuucuugaaaauauuuguuuugagguuagaaggaaauacauauuauauauucccauuucaugacuuaaagaaauccaacauuuuacaaaaauauuucucaaccaccaugaucaauacuucuuagucugcuaccuaagcaagccagagaaccauuuuuaugguuaaucucugcaugauaaaaagacaaaagaggacucagaaggcuuuuuaagauuuuaaaauuccaaacauauaagccaccaguccuaggcaauauauaaaaguuagaaaacucuucauaaaaaugaccuggguuugauacuuaaaacuuucuacaggacaauguauucaacauacaaacaaaggccuuauuuuaaaagcuggcuccauggacuuagcaccugaacugaagcugacuucaaaucagccagugcauacuuagguuuuccugguuuugccuauacauguuaaacaauaucuuaugcagggagauaaaccagacuuacuuuuuuagucuuugguuucuuuucuucuucuucuuccucuacugcagcuucaucaucagauucuucuuucucuucuuuggcugcuucuucuuccuccaugggcuccucaacaguuucagucuguugaaauaagagaauuaugguuaaacucauuuguuuaacaauucugauuuugucuacagaauaugauauaacauuacaggucaaaaaauagguuuuuguaagaaaacccugagaguauccuuaacuaauagaccacauuuugccuucauucuuuuuuuuuuuuuuugagacagagucuugcuuugucaccuaggcuggagugcaguggggcgaucuuggcucacugcaaccuccgucucccggguucaagcaauucuccugcuucagccucccgaguagcugggauuacaggcgugugcuaccacacacccagcuaacauuuuuguauuuuuaguagagacaggguuucgccauguuggccaggcuggucucgaacuccugaccucaggugauccaccugucucggccucccaaagugcggggauuacaagcaugagccaccgcgccggccugccuucauucuuuuaguguugaauauuuaaauacgugccaagguaauacauauaaguuuuuaaucaauauagauuuaccuugcugcuccauacauaaauaggaaaguuuaugaacugugaauauuuuuugacgagauuuuuaauuguauccaauucaagguaaucagaugcuucuucuuuuaagacaaggcugcaagaaaaauucgauguuuagagacaccuaacauuuagaagaucugauuauaaauucauuuaaauaccaugguaauagccagcaguucaguauaauccaagauguccuaauuauucauguuaacucuccaucaccaacaaggguuugugagcuaaaauguaacacauguagauacaguaaagagaagaaucuccucuacauuaccucaaguggagaauaaccuuaguuuuaaguagaaaauuaaaauauucccaaccgucugaauagauuguuuucauuuuucaaggugagaaagcacugaaauauucuggagagaaauggaaucaugcacucucauagcucuuacuguuauuccagaaaccuaaugauuauuguagauaacuauuccuaauuaaugaaaacauuuuccuuaaaaaagcuagaaaauuaaucugguuuauauuuauaucugcacuauccaaaauggcagccacugggcacaugugacuuauuuaaauaaaauguacaguucaguuccaguuaugcugccacauuccaaguacucaacagucacauguggcuggugaucgccaaaauggaaaagugcagauauagaacauuucuacuauuauauaaaauucuaccgggcagugcggggauuacaggugugagccacugugcccggccuagaaccuacucuuaagcacaguagguaguccauaucuugauacuuguguucccaauuaaguaugggaaauggucuaucuaugguucccucccugucucaaaaggcucauuaguuuagugguaccuggccaauaaguagccaugauaugacaaagccuagugagugacuaggccccuggucucagagcacauguucuagugauuuggggauuaagaguucaguuuuggaugcaaguagaagcugcugguuagauaucuuagguagaagcauuuaaaaggcaauuaaacacaugaacacagagcccaguagugagaccuagacaaggggcuggcaagcuauagcuguacagcuggcacccauuagaaauuuuauugggacacuuuuuuuuuuuuuuuuuuuuuuggaccucugucacccaggcgugaugauggcucacugcagccuugaccugccaggcucaagcaauccuccuaccucagccuccugaguagcugggacuacaggcaugcaccacugugccaagcuaauuuuuuauuuuuuauuuuuguggagaugggaucccauuauguuguccaggcugaccucaaacuccuggguucaagugauccucccaccucagccucccgaggugcugggauuauagggaugagccaccacacuuggcugggacacauccuuauguauugucuaugccugcuuucaagcuaaacagaguugggacaugugacagaccauauagcucacaagcuaaaaauauuuacuagcuggcucuuucuuucuuguuguuuucuuuuaucuuuuuuucuacuagcuggcucuuuuaagaaaaaguuugcuaacuccugaucuaggcuaagaauauaaauuugagaacuagagauggaaccugaggccguggcaguggauaagacuacauaaagaucacauggacaaugagaaaagggcugaaacuuaacuuggagaaaauguauguuaacauuuaagaagugggcaaaggaaauuuuuaaaaagauaugcauggucauggaaacuagguccuggauagguguuagcagccaucguucccugcauggaacuguccuguuuaaccucacuuauucauacaaauggcugccaauuaaguguuaagcuuugggaauggagcuuccaacaaaauguuugccuucauggagcuuauauccagauaauuucaccugcuucuuagcaaccugacauuaacaucucuugggacaucacuuucuaucuuuccuugggaaugauugcccuauccuucuccaacaucuagcccagugcuuaaaaagagagggcacuggggcauaacucuuagugaugccuccaaaugaaaccuggagacaucaauguuagugacgaaggcaggggaagguaaauugggaacacaaguuaaaaaaguacuaaaaugcagucaucuaauuagucuucauuaaaagaacaucugcugcaguaaaaacaggaaauguuacuuucuaggaugaagaaaguuggucacaaugauaaguaugugcuucuuucccuuaauguuaagaaaacuuaaaacugaauuaagaaaaaaaaauugaagcugugggcacauucuguuacucacuuagcaggaguuggcaagccaacugaccucugaaauagaauuuccucaucuccaagaugguaaaauuuuaaaaaggcaaaaagcugcccugucuacgucacagugcuauaagcaacgagagcuacuguagggcacuggcucugucucacccauacaaacaacaguuacuggcuuaagagggaucuuaauucaaauuuaaaaacuuguaacuauccuuaaaugacguauuuuauuccacagcuuucacaacuuucaugaacuuucuuuaagcccuuuaucucuacaagccagccccagcccugguugcuaccacucaucuugaauauuuucaagaggaauauuucccccaaagagucuccccuuguccacuccucacauccuccacaccaccuugagaaucuuaaaaaguucaucacauucuggcugggcacgguagcucaugcuuguaaucccagcacuuugggaggccgagguggguggaucacgugaggucgggaguucgagaccagccuggccaacauggagacaccccaucucuacuaaaaauacaaaauuagcugggcgugguggcacaugccuguaaucccagcuacuugggaggcugaggcaggagaauugcuugaacccaggaagcggagguuguggugagccaagauugugccauugcacuccagccugggcaacaagagugagacuccgucucaaaauaaauaaauaaauaaaaguucaucacauucuauccauaacugccaccgaaaagaacucuguucaucuagugagcaugcuaugccuccaugccuuuauucaggaugcuccacagacaaauuacucuucuaaccugggaaacugaccaagcagugccuccucuguggguacccaagaagccuucucccuuggggaagcugcugcuauuuccuacuuuauacccuccauguacaacagcaaucacaaaccuuugugccuggcccuuugcagguccucaaacauuucuucaagugacaacaguucuguuuccucauuuuauaaggcaggaaaauuaaggcccagaauaagucauuugcucagagaauagaacuggagagucaagauccucaccaugacuauuaauucuuauaaggaauuggucauacucacguaauugucguuccccguccuagaguguuuccucuugggucagcaauuacagaaaauucauuggagucagacucccagaugugcuggguaucguuguuguguuuugaagugacaauaaccuuaucugcuacaaggaaggcggaauagaaaccgacaccaaacuggccaaucaauucagaaguugacuggccaucuuccugugcuucagucauuuuguuuaaaaacucgcuugucccagauuuggcuaugguaccaagguuuuuaaccaacucuucucuggucauuccuacaccggugucugugacaugcagcagguucuucuccuuaucacacuaaaugcaagacaagaaccagauaguuguauuuaauauuuacauuaugccaaacaaauauugaggaacuaaccagcuuugggucccaucaauuccaauacagaaaacuaaacugagauauuuuccuccacauaguuuuuuauggccuuuucugaaaguguacaucuuaaaguaauuuauguauuugagaaaguauuaauaucaaaugggcagacuggccuaaaugucaaagguuagaggcugaccuaaauaaaacaaguuaccuuugaaggaaaacaauucaagaaaaauaaaauuuuaugucuugccuauuucuuuacuagaauacaaaacaacuugaaugauuccucuauuuggaaucugugauggaucauuaauauucuucacucaauauuccuggcugucugccuuccagaaacuuaggaguacucuacuuuccauuuaagaauggcuaaggccaugugacuaguuuuggccaaugaguuauaaauggccaaugaguuguaaaggagagcucuguuuucaggcugagccuuuaauuauaauaguaugagacccucuaagcuugcucugcaccauggcaaccggcuacacacuccagguggcugcccacgccucugucccagccugaggaugaggcagagcaaagaccacaggcagccugugaucaaugauuuaagccaggggcuggcaaacuuuuucuguaaagggccacacaguaaauauuuuaggcuuugggagauuuauguucucuguuaaaacaacuugacucugcuguugaagcacagaagcagucacagauaauaaacaaaugggcauggcugcauuccaauaaaacuacuuagaaaaacaagucaaguuagauuuggccauaguuugaugacuuucaagccacugagacuugggguuuuuuugccacugcaaaauaaucuagccuaucuugacugauagggauccucuaccuuuaaggauuccuuuuccuuuaaaagaaagaaaaacugccuuacacuuaccuuaauuuugacuguuaguuccucauuuccagaaagagcauuuucaucagucagugauauuagccuuaucuuaucuaaagcaucagaagcauuugaaaucaguucucucaggaaaaucuaaauggaagccagagggaauacacuuagacuauccucaagaugcauuaagauauucgauuuuaugccaaacccauuuauuucuucucuguaccuuauaaaagcacucuuauucaccuaacagugaucuucagguaugcaaugcaagaaguuuaguuuaugugacugcccuuagacucacaacuauuaucaggccgugaaccuauuuagagguaaaggaaaaggaaaaugucugacacucccuuucuucccagauaucugguagcaauucuuggacauauuagguauuuaaagguuguuaccuacuuacuuggauacuacauuacuuuugcaguaaauuaagcaaauuuaaguaaacaaguaugccaccauacagagauaaaauauucuaaccacauguugcuuaccucuuuauuuuuauacaaugaauugaugauaaguuucaucauucuguuaacuucggcuuggaaggcaaacuuuuccgacuucucucuaaguucucuuauuugugaugcauuuaauccauccaacugaauagcuucuuccucucuaaggaaaucaguuagguaagcaaauauugcauggcauaguucccuucaaaacuagaggaauuaugaugaaagcacaggggccucugaauauugucuuggggguuaaaauggaaaccuuuauaaaauauaacugauauaccgucucauuauguuagcacagcaguaggcuaccuuuaacauuacacuggaaauacucgguucuuaaaauugccagaaaaaaaaaaaucccaacuuuccucuacuaaaaagcaaagucauacucauuuaugcuccacagugaggacuucaaaacugucaauaagucccaagaggccaaauuuuaaaauauuguucaacugacagaaaucccauuuuuaaacuuacucgguguacacaguuaaugaauacaaauccaacugaaaguaucuucuauaaagucuuacaaaguuuauggugcuaguauucugcaauauaguuuucaaaggaauucacucaguuuucaucacuccuagggacaaguuaggagguauguaugcacacaacucaccggguauuuaaauacaggguguuagacuuuaucuggaccuuuggagaagagauacauaagaagugaccguaacucacaagguucacacggcuuaucuguauacguaaguucaaaugaacacaaaccucuguacuacuucaucauccguccuugauccuucucuacuuuuacccagauccucuucuacuguaccauccacaucaacuucaucgucagcucugaccgacccugaagauuuaacacgggcaaacucuucaacaucacacuucuccaaggaggaugaucaaauagggaaggguagggguugcaaaauucaguugguaacuaagggagguggggaugaaagagugcauucccugguuuaaauaccaaagguaaagccaagacagaacaucuauuuaaguucagaugcugaagucuccaguagauccugaaauacggaggcagucaccacuucuaaacagugugucuccgaucauuuauaaauaacguuaagcagacugauaccaggccucuucuacacccacacguguugcgcgcaggccgagccaaggccucccaacugaucaagccaaaacuucggccuucguuagcacaggucagaaugcaaauaggauuuaugcaaccucuggcgaggggaacugaaauugagcccagaggcaugagaagggggagaaauguuaagaaccgaacuccagcaaaacugaaucaaacacgcugacacugccauuccgcuggccccaggccucacgcucccgaggccagcaucuaagaagggacacgggcuugcgaggagucggagucuggggaauuaggggacgggaaagcugggauggccgaagguugcgguggccgaaaaaguccuccgggcggggaggggggagggacucgcacagcucccgggggagccagagccucagagaggccccaccccgaggucgcugagaccuccgggcgagauacuauuagaucuguagggcaguuagaugauguugcucucuuuuuuuauuuccagaggaagaagagaauaaacguaauucccuugcccucuuucgaggaauggugacgucccuuggcccaccgcaggccccgggauccccccucccacguucaacgcccccaggaccuucgagaagcggccgcguguguggaggggggacgucugcuccuccagaaucacucaccgaaggucagcaggacgcagcagaggcccagcacccacagggcccucauggcgugcggccggugagucucaaguccccuucgaucgcaggagccgccuccaccccccaccccuggguucggauccucacaccuccagccgcgcgguccgcccacuacaccgcaagcaggucgggccgcuuuucacccccacuucccgcgggcgggggacgggaaacaugaacccaccaaucg

SEQ ID NO: 16352 - RNA, 18188 nt, Homo sapiens
cgauugguggguucauguuucccgucccccgcccgcgggaagugggggugaaaagcggcccgaccugcuugcgguguagugggcggaccgcgcggcuggaggugugaggauccgaacccaggggugggggguggaggcggcuccugcgaucgaaggggacuugagacucaccggccgcacgccaugagggcccugugggugcugggccucugcugcguccugcugaccuucggugagugauucuggaggagcagacguccccccuccacacacgcggccgcuucucgaagguccugggggcguugaacgugggaggggggaucccggggccugcggugggccaagggacgucaccauuccucgaaagagggcaagggaauuacguuuauucucuucuuccucuggaaauaaaaaaagagagcaacaucaucuaacugcccuacagaucuaauaguaucucgcccggaggucucagcgaccucgggguggggccucucugaggcucuggcucccccgggagcugugcgagucccuccccccuccccgcccggaggacuuuuucggccaccgcaaccuucggccaucccagcuuucccguccccuaauuccccagacuccgacuccucgcaagcccgugucccuucuuagaugcuggccucgggagcgugaggccuggggccagcggaauggcagugucagcguguuugauucaguuuugcuggaguucgguucuuaacauuucucccccuucucaugccucugggcucaauuucaguuccccucgccagagguugcauaaauccuauuugcauucugaccugugcuaacgaaggccgaaguuuuggcuugaucaguugggaggccuuggcucggccugcgcgcaacacguguggguguagaagaggccugguaucagucugcuuaacguuauuuauaaaugaucggagacacacuguuuagaaguggugacugccuccguauuucaggaucuacuggagacuucagcaucugaacuuaaauagauguucugucuuggcuuuaccuuugguauuuaaaccagggaaugcacucuuucauccccaccucccuuaguuaccaacugaauuuugcaaccccuacccuucccuauuugaucauccuccuuggagaagugugauguugaagaguuugcccguguuaaaucuucagggucggucagagcugacgaugaaguugauguggaugguacaguagaagaggaucuggguaaaaguagagaaggaucaaggacggaugaugaaguaguacagagguuuguguucauuugaacuuacguauacagauaagccgugugaaccuugugaguuacggucacuucuuauguaucucuucuccaaagguccagauaaagucuaacacccuguauuuaaauacccggugaguugugugcauacauaccuccuaacuugucccuaggagugaugaaaacugagugaauuccuuugaaaacuauauugcagaauacuagcaccauaaacuuuguaagacuuuauagaagauacuuucaguuggauuuguauucauuaacuguguacaccgaguaaguuuaaaaaugggauuucugucaguugaacaauauuuuaaaauuuggccucuugggacuuauugacaguuuugaaguccucacuguggagcauaaaugaguaugacuuugcuuuuuaguagaggaaaguugggauuuuuuuuuuucuggcaauuuuaagaaccgaguauuuccaguguaauguuaaagguagccuacugcugugcuaacauaaugagacgguauaucaguuauauuuuauaaagguuuccauuuuaacccccaagacaauauucagaggccccugugcuuucaucauaauuccucuaguuuugaagggaacuaugccaugcaauauuugcuuaccuaacugauuuccuuagagaggaagaagcuauucaguuggauggauuaaaugcaucacaaauaagagaacuuagagagaagucggaaaaguuugccuuccaagccgaaguuaacagaaugaugaaacuuaucaucaauucauuguauaaaaauaaagagguaagcaacaugugguuagaauauuuuaucucuguaugguggcauacuuguuuacuuaaauuugcuuaauuuacugcaaaaguaauguaguauccaaguaaguagguaacaaccuuuaaauaccuaauauguccaagaauugcuaccagauaucugggaagaaagggagugucagacauuuuccuuuuccuuuaccucuaaauagguucacggccugauaauaguugugagucuaagggcagucacauaaacuaaacuucuugcauugcauaccugaagaucacuguuaggugaauaagagugcuuuuauaagguacagagaagaaauaaauggguuuggcauaaaaucgaauaucuuaaugcaucuugaggauagucuaaguguauucccucuggcuuccauuuagauuuuccugagagaacugauuucaaaugcuucugaugcuuuagauaagauaaggcuaauaucacugacugaugaaaaugcucuuucuggaaaugaggaacuaacagucaaaauuaagguaaguguaaggcaguuuuucuuucuuuuaaaggaaaaggaauccuuaaagguagaggaucccuaucagucaagauaggcuagauuauuuugcaguggcaaaaaaaccccaagucucaguggcuugaaagucaucaaacuauggccaaaucuaacuugacuuguuuuucuaaguaguuuuauuggaaugcagccaugcccauuuguuuauuaucugugacugcuucugugcuucaacagcagagucaaguuguuuuaacagagaacauaaaucucccaaagccuaaaauauuuacuguguggcccuuuacagaaaaaguuugccagccccuggcuuaaaucauugaucacaggcugccuguggucuuugcucugccucauccucaggcugggacagaggcgugggcagccaccuggaguguguagccgguugccauggugcagagcaagcuuagagggucucauacuauuauaauuaaaggcucagccugaaaacagagcucuccuuuacaacucauuggccauuuauaacucauuggccaaaacuagucacauggccuuagccauucuuaaauggaaaguagaguacuccuaaguuucuggaaggcagacagccaggaauauugagugaagaauauuaaugauccaucacagauuccaaauagaggaaucauucaaguuguuuuguauucuaguaaagaaauaggcaagacauaaaauuuuauuuuucuugaauuguuuuccuucaaagguaacuuguuuuauuuaggucagccucuaaccuuugacauuuaggccagucugcccauuugauauuaauacuuucucaaauacauaaauuacuuuaagauguacacuuucagaaaaggccauaaaaaacuauguggaggaaaauaucucaguuuaguuuucuguauuggaauugaugggacccaaagcugguuaguuccucaauauuuguuuggcauaauguaaauauuaaauacaacuaucugguucuugucuugcauuuagugugauaaggagaagaaccugcugcaugucacagacaccgguguaggaaugaccagagaagaguugguuaaaaaccuugguaccauagccaaaucugggacaagcgaguuuuuaaacaaaaugacugaagcacaggaagauggccagucaacuucugaauugauuggccaguuuggugucgguuucuauuccgccuuccuuguagcagauaagguuauugucacuucaaaacacaacaacgauacccagcacaucugggagucugacuccaaugaauuuucuguaauugcugacccaagaggaaacacucuaggacggggaacgacaauuacgugaguaugaccaauuccuuauaagaauuaauagucauggugaggaucuugacucuccaguucuauucucugagcaaaugacuuauucugggccuuaauuuuccugccuuauaaaaugaggaaacagaacuguugucacuugaagaaauguuugaggaccugcaaagggccaggcacaaagguuugugauugcuguuguacauggaggguauaaaguaggaaauagcagcagcuuccccaagggagaaggcuucuuggguacccacagaggaggcacugcuuggucaguuucccagguuagaagaguaauuugucuguggagcauccugaauaaaggcauggaggcauagcaugcucacuagaugaacagaguucuuuucgguggcaguuauggauagaaugugaugaacuuuuauuuauuuauuuauuuugagacggagucucacucuuguugcccaggcuggagugcaauggcacaaucuuggcucaccacaaccuccgcuuccuggguucaagcaauucuccugccucagccucccaaguagcugggauuacaggcaugugccaccacgcccagcuaauuuuguauuuuuaguagagauggggugucuccauguuggccaggcuggucucgaacucccgaccucacgugauccacccaccucggccucccaaagugcugggauuacaagcaugagcuaccgugcccagccagaaugugaugaacuuuuuaagauucucaaggugguguggaggaugugaggaguggacaaggggagacucuuugggggaaauauuccucuugaaaauauucaagaugagugguagcaaccagggcuggggcuggcuuguagagauaaagggcuuaaagaaaguucaugaaaguugugaaagcuguggaauaaaauacgucauuuaaggauaguuacaaguuuuuaaauuugaauuaagaucccucuuaagccaguaacuguuguuuguaugggugagacagagccagugcccuacaguagcucucguugcuuauagcacugugacguagacagggcagcuuuuugccuuuuuaaaauuuuaccaucuuggagaugaggaaauucuauuucagaggucaguuggcuugccaacuccugcuaagugaguaacagaaugugcccacagcuucaauuuuuuuuucuuaauucaguuuuaaguuuucuuaacauuaagggaaagaagcacauacuuaucauugugaccaacuuucuucauccuagaaaguaacauuuccuguuuuuacugcagcagauguucuuuuaaugaagacuaauuagaugacugcauuuuaguacuuuuuuaacuuguguucccaauuuaccuuccccugccuucgucacuaacauugaugucuccagguuucauuuggaggcaucacuaagaguuaugccccagugcccucucuuuuuaagcacugggcuagauguuggagaaggauagggcaaucauucccaaggaaagauagaaagugaugucccaagagauguuaaugucagguugcuaagaagcaggugaaauuaucuggauauaagcuccaugaaggcaaacauuuuguuggaagcuccauucccaaagcuuaacacuuaauuggcagccauuuguaugaauaagugagguuaaacaggacaguuccaugcagggaacgauggcugcuaacaccuauccaggaccuaguuuccaugaccaugcauaucuuuuuaaaaauuuccuuugcccacuucuuaaauguuaacauacauuuucuccaaguuaaguuucagcccuuuucucauuguccaugugaucuuuauguagucuuauccacugccacggccucagguuccaucucuaguucucaaauuuauauucuuagccuagaucaggaguuagcaaacuuuuucuuaaaagagccagcuaguagaaaaaaagauaaaagaaaacaacaagaaagaaagagccagcuaguaaauauuuuuagcuugugagcuauauggucugucacaugucccaacucuguuuagcuugaaagcaggcauagacaauacauaaggaugugucccagccaagugugguggcucaucccuauaaucccagcaccucgggaggcugaggugggaggaucacuugaacccaggaguuugaggucagccuggacaacauaaugggaucccaucuccacaaaaauaaaaaauaaaaaauuagcuuggcacaguggugcaugccuguagucccagcuacucaggaggcugagguaggaggauugcuugagccuggcaggucaaggcugcagugagccaucaucacgccugggugacagagguccaaaaaaaaaaaaaaaaaaaaaagugucccaauaaaauuucuaaugggugccagcuguacagcuauagcuugccagccccuugucuaggucucacuacugggcucuguguucauguguuuaauugccuuuuaaaugcuucuaccuaagauaucuaaccagcagcuucuacuugcauccaaaacugaacucuuaauccccaaaucacuagaacaugugcucugagaccaggggccuagucacucacuaggcuuugucauaucauggcuacuuauuggccagguaccacuaaacuaaugagccuuuugagacagggagggaaccauagauagaccauuucccauacuuaauugggaacacaaguaucaagauauggacuaccuacugugcuuaagaguagguucuaggccgggcacaguggcucacaccuguaauccccgcacugcccgguagaauuuuauauaauaguagaaauguucuauaucugcacuuuuccauuuuggcgaucaccagccacaugugacuguugaguacuuggaauguggcagcauaacuggaacugaacuguacauuuuauuuaaauaagucacaugugcccaguggcugccauuuuggauagugcagauauaaauauaaaccagauuaauuuucuagcuuuuuuaaggaaaauguuuucauuaauuaggaauaguuaucuacaauaaucauuagguuucuggaauaacaguaagagcuaugagagugcaugauuccauuucucuccagaauauuucagugcuuucucaccuugaaaaaugaaaacaaucuauucagacgguugggaauauuuuaauuuucuacuuaaaacuaagguuauucuccacuugagguaauguagaggagauucuucucuuuacuguaucuacauguguuacauuuuagcucacaaacccuuguuggugauggagaguuaacaugaauaauuaggacaucuuggauuauacugaacugcuggcuauuaccaugguauuuaaaugaauuuauaaucagaucuucuaaauguuaggugucucuaaacaucgaauuuuucuugcagccuugucuuaaaagaagaagcaucugauuaccuugaauuggauacaauuaaaaaucucgucaaaaaauauucacaguucauaaacuuuccuauuuauguauggagcagcaagguaaaucuauauugauuaaaaacuuauauguauuaccuuggcacguauuuaaauauucaacacuaaaagaaugaaggcaggccggcgcgguggcucaugcuuguaauccccgcacuuugggaggccgagacagguggaucaccugaggucaggaguucgagaccagccuggccaacauggcgaaacccugucucuacuaaaaauacaaaaauguuagcugggugugugguagcacacgccuguaaucccagcuacucgggaggcugaagcaggagaauugcuugaacccgggagacggagguugcagugagccaagaucgccccacugcacuccagccuaggugacaaagcaagacucugucucaaaaaaaaaaaaaaagaaugaaggcaaaauguggucuauuaguuaaggauacucucaggguuuucuuacaaaaaccuauuuuuugaccuguaauguuauaucauauucuguagacaaaaucagaauuguuaaacaaaugaguuuaaccauaauucucuuauuucaacagacugaaacuguugaggagcccauggaggaagaagaagcagccaaagaagagaaagaagaaucugaugaugaagcugcaguagaggaagaagaagaagaaaagaaaccaaagacuaaaaaaguaagucugguuuaucucccugcauaagauauuguuuaacauguauaggcaaaaccaggaaaaccuaaguaugcacuggcugauuugaagucagcuucaguucaggugcuaaguccauggagccagcuuuuaaaauaaggccuuuguuuguauguugaauacauuguccuguagaaaguuuuaaguaucaaacccaggucauuuuuaugaagaguuuucuaacuuuuauauauugccuaggacugguggcuuauauguuuggaauuuuaaaaucuuaaaaagccuucugaguccucuuuugucuuuuuaucaugcagagauuaaccauaaaaaugguucucuggcuugcuuagguagcagacuaagaaguauugaucauggugguugagaaauauuuuuguaaaauguuggauuucuuuaagucaugaaaugggaauauauaauauguauuuccuucuaaccucaaaacaaauauuuucaagaaacauuuuugcuaguuaaaaaauaacaaugaagaaaaacuuaaguggcuuuucaucaguuaacaauugucuuuuugaauuaaauauugagaaaaauacuuugcuuuugauacaguuggcagaaaccuuacuagauaacagguauccuuuggugcccuuuuuuuuuuuuucuuuaauuuggagacagagucucugccacccaggcuggagugugguagcacgaucauagcucccuucauccuugaacuccuaggcuuaagcaguccuuucaccucagccucccaaguagcuaggaccacagacacacgccaccaugacuggcuaaguuuuaaaaauuuuuuguauaguuggaggucuugcuauguugccuggacuggucuugaacuccuaggcucaaacaguucuccuacccuaaccucccaaagugcuaggauuacaggcgugagccaccacaccaguccucugggucuuuacauagucuuuugaaaucuacugaagccaugguuacugcuaggauaaccuuggugagugcugagagagacuaaucaaauacuauaauaacuucagguugaaaaaacugucugggacugggaacuuaugaaugauaucaaaccaauauggcagagaccaucaaaagaaguagaagaagaugaauacaaagcuuucuacaaaucauuuucaaagguaaauauuuauaauucccuaguuucugguuauuaaugaauagacaaaauaucacccucuuaguuuaauuguauaugguaugugaccaugaauaugagaugguccauucccauuuuuucccagugagaaaauucaaaaaaagaccuuuaggccaacuauaauaugucuacuucugguuuauugaccuagucacaauuaaaaucacauuuaugaaccuuugagauugacaccucaguagagauggucuuugagaguaauugguuuccagaacacaccauuuuuacuuaaguugaauuauuauacucaucacuacuucaaaauugcagcaguuauuaaaauuaguccuagcucuuagugaauagugaaacuacaaaaucaagaauguuugaaacaguuuuauggcuguuuaaacacaauugguuuccuuuuuauuccuguguauuuuguaauaugugauuuuuuuaaaaaaauuauuuugagaaggcaucuguagccuucaccagcuugccaaggguuuugugugacaaaaaaagauuaagaaccaccuacauagguagaugugugauuuccaccacaaaacccguaaaacaugaaaucauguuguuaaguggcuuuuaauauaaucuuuaaagagcuugcuuaugacaucaaacacuuauugugagauccuaugccugggaauaauuacuaaauuuauguuuccuugccuguuuuuuuuuuucuucuucuuuuauugaucccuucuuguaacucuuaaggaugcaaaacuagcauugauaaaguuuguuuaaaguuaauguuuccccagcagcauuuaguacaagcaguagaaugcucuaguggacuuaaccauagcuaaauaaaacuuaauauucugugucuguauuuguucuuuucucuauuccauauccuuuaaauuucaacucuuaaaacacuguugguucugccuucacuuuuauuuccauaaacucuaaaguccuagugucuauaaacuuacuucauauaaagcagcuguauuagaaauauaauuaaugugagccacacaugauuugaaauuuuuuagaagccauacaaaaaaaggaaccaugaaauguuaauaguauaauuuauuuaacccagcauaccccaaauaguauuauuucaacauaaucaauauaaaaacuaauaaugagacauuuuauauccuuuuuaaaauuuguacugugccuucaaaauguauuuuacacuuuaauagcacaucugaauuugaacuagcuacauuucagugcuuaacagccauauacaguaauagauaaugcagaucaagagaauuuccaacuuuguuuuacagguauuuacauacaucuuuguagccacucuuagagcuaaguuccauggaagaaacauguucuugaguacuuacuguaguucaagggcacacugaaguguuguauguaauuuugucauuuaggcaggguggugguuuuccuauucacuucucucauacguaagaaguauaaacucauccuuccuucugagaguuuaggaaauaauguuauugacaaucaucaucaaaacaaccaugucuagugaauuagaauugcaauucuagauauuucuucacuccacccuuuucuuucucuuccccccacccuuuucuuucucuuccccaccucccgccaguaaaggaaaauuuuuuguuaguuaauugcuaaacugaauauguaccacauaguacauugcuuaguucuugcacugcuuuucuccugugucguuugaaugacuaagauaccaacuuuccacaggaaagugaugaccccauggcuuauauucacuuuacugcugaaggggaaguuaccuucaaaucaauuuuauuuguacccacaucugcuccacguggucuguuugacgaauauggaucuaaaaagagcgauuacauuaaggugaguuuuuaaguaguacaugcugcguuuaaaauuugaaaguuuaauuuccagaaagugacuuuuuuuuggucucuuuagcucuaugugcgccguguauucaucacagacgacuuccaugauaugaugccuaaauaccucaauuuugucaagggugugguaaguaucugaaguuugggagaaggggugauuguugugggggucuggcaguguagaguguuuguuuggcuuugcuuucuuccagugguuuuauugcucacugaacuuucuuuugccaucugaagguggacucagaugaucuccccuugaauguuucccgcgagacucuucagcaacauaaacugcuuaagguaagugucucugggaagaaacucuccacuuugcuguuugauugggguucagaggacaggcuccauuuguggaguaaaaccagauuuugggucugguccaugauucuucagaugaauuuccuuucuuucuggaguuaucagauccuaagaaucugauucuuuuucucccaacauuuaauaaugaaguuucaaacaucuagaaaaaaauuaaagaauuguacagguccaggauuaacauuuugucaucuagacacauagccaccuuuuuaucaagccuuucauuaaaccuuuccccuccaauacuuccauaauuagaagacucuuuaguuuuugaauuuaaaaguauuugaaaguagcauauuuguucacuucauuuagaugcuagagagagaguaucacugaguccuaagguuagaauauaaacauuaaggcaaucuuguggcuauuugcacggacagcugaauuucagcccaaucugaaugaauuggagugcuucaccauuuccugccccucaauaaauggcaauaacgauaucgucuuuguguuuuucacacuccugccuggguaccuuacauucucaaaaguuggagauuaacuucucuaaucaguuauucuuucauuguguuuaggugauuaggaagaagcuuguucguaaaacgcuggacaugaucaagaagauugcugaugauaaauacaaugauacuuuuuggaaagaauuugguaccaacaucaagcuuggugugauugaagaccacucgaaucgaacacgucuugcuaaacuucuuagguuccagucuucucaucauccaacugacauuacuagccuagaccaguauguggaaagaaugaaggaaaaacaagacaaaaucuacuucauggcuggguccagcagaaaagaggugagaugaacucauaaguguugucagccauucuggaagguagcuagggauuuauagccaacucuugagggggagaaaaggaaaacuuaauuguguaacuggaguaguuauaaggccuggucagucacugacaggaaggucauuuauauucucugaaccucuuaauucuucaccuguaaaauggaguuuuuaauaauguauaaacauagcagcugcuaggauaaacaaauacaccagggccagacuuggaaaacuuugugacuucuuaauuuuguaggcugaaucuucuccauuuguugagcgacuucugaaaaagggcuaugaaguuauuuaccucacagaaccuguggaugaauacuguauucaggcccuucccgaauuugaugggaagagguuccagaauguugccaaggaaggagugaaguucgaugaaagugagaaaacuaaggagagucgugaagcaguugagaaagaauuugagccucugcugaauuggaugaaagauaaagcccuuaaggacaagguacuguggaaauuacaaauuguggaaauauuaguaucagcauuuaagagaaaguuauuuugugaacaaauuaagcugcagcugguuacuuuguaaccauuagaaugguaaaaauuuaauuaauguaauuaaauuauugggagaaagcuuaaaacuuucgacaauacugcuuuguuaauaacuuguuacaaauuaaauuuuauguuuuuaaaaggugguauuuaaacuucugacuagaaaauucagauuaucaaguaagugccccuacaaauucuccuaaaccuuaagaaaagcuauuuuuaugaccugcuucuguguuuaugaucuuaagugauaaagucuuagacaguugaaagacaauugcucaaugaccuuaccuguugauauuaauuuauaugacuugauuucuuucccuaagauugaaaaggcuguggugucucagcgccugacagaaucuccgugugcuuugguggccagccaguacggauggucuggcaacauggagagaaucaugaaagcacaagcguaccaaacgggcaaggacaucucuacaaaguaagcauccucgggaaagucccugccagggcguugccccuuacccaaucuuuguuuuggagauaauaccagcuucaauacaaagaguaaaauugccuuaaaugucuaccacugucuacuauaagguagacaacaaguuuacgaagggauuucuccuacauuugauugagaaagaaaaggucuuugacucaugauuuucugauuuuauuguauuugauauguaaaugggaauuuucuuaauguguuaugcauagucuuuacuuuugcauuggauuauaugcuuagccuaauaucugaauuuauuuuacauuuuuaaauguaauagcugcacgagguuaaugacaacauuccucaagugaguuaaguccauuucaaaucacgucccccacacccccaagcauuaaauuauggguauccagauagaaugucucauaaaguagacgguacaggaccugugaauuaacaguauuugaacucaagggccuauaccuggagguauagugagucuuugguacucuuuauuuucaagaaauauaguauuucaaguuuauguuuuaaugucacagcaaugaucuugaaaaugacuucuccccuacuuuuauucucucuucuuucaccuggaguauguuucugauaugcuaucuagucaucauccuuuuuucccaaggccuagcuuaaggauucuuuuuuuuuuucccccgagacagagucuugcucugucacccaggcuggaguacaguggcgcaaucucugcucacugcaaccuccgccuccuggguucaaguaauucuccugucuuagccuccugaguagcugggauuacaggcaccugucagcacacccgcuaauuuuuguauuuuuaguagagacgguguuucaccauguuggccaggcuggucucgaacuccugaccucaugauccgcccucugcggccucccaaagugcugggauuacaggcgugggccacugcgccuggccaggauuauuauucuuaaagccuuuucucacaaauguagucuccauuguugucacaauucuaaaauuccauauaugucuuuuaacuauaaauuucaugcagagaauaguguucuguuuaucugauaucccauugcaauaguacaagggccauuuaaaacauguccaccuauuaauuucaggaaaugauuaauaggaaguuaccuugcauccaacaaacaugaagacuuacuauguccaugcacugauggucacagguagacauaacuccugucuuuucuaacauuuagacuagugaaaaugacaaaucaaagccaggcauggugacucacuccuguugucacucaggaggcugaugcaggaguaucaguugauuccaagaguucgaggcuguagugugcuguaauggcauugcacucuagcucuagccuggguaacauagccagacuccgucucuuuuuuauuuaaaaaagaggaaaaaaagcaagucauaauccgagcccuacauagauaauggguacaccaggauagggaaggaugugguuccucccuguccucagagcuuuaaacuagagaagagagaauaaucacaaccaacaguaaaaagcuaaggauuuugaagguauauucaaaaugcauuuggaacugagcucagauaaaguuaauuuuucuuggaaucauuggcgaaggcaucguggagaagguauuauuauuggagcacaauccagaggcuacauagauuuuucugaacuuggggaggcagagcuacaauuacgguaguaagaauaaacuaagagggaacaaacaggacauuaaaucaguucgucuguucagcagugcuccagguacuugggacucaucaguaaauaaaauaguucccuucauuucauuuuucaucuaaccguguccacuugcuccccaccccaccuccccguuaaaagggagcaauacaggcugggcacauggcucacguguguaaucucaacacuuugggaggcugaggugagaggaucacuugaggccaagaguucaagacuagccugugcaauauagugauacccugucucuauaaaaacuaaauaaggaaacagugcagucaucccuuuuuguccaugggguguugguuccagaacaucccauggauaccaaaauccacacauagucaagucccuuagguaaagucgugccguauuugcauauaaccuaugcacaucuucccauguacuuuaaauaaucuauagauuacuuuuaauaccuaaugcaauuuaagugcuauguaaauagcuauuauacuguauuggguuuuuuauuuuuuucuuguuuugcccuuucuaauauuuucaauccgagguugauugacucugcagauaaaguagacuggaaaaguacagucguccuuagguguaugagggagauugguucuaggaccccugccaaaauccacaaauauucuagucccccagucugcccuguggaacccguguauaugaagagugggagcucuguguguguggauuccacaucccaagaauacgguauuuucuaucugaguuugguugcugaaccugcacauacggagggcggacuguauuuauuggaaaaaaaauagcauauaaguucaaaccugugguguucaagugucaauaguacauuuugauuuuuuuuuuuuaccaagaguuguucuguguaauuaugaaagaauaagggaaacguaugaacccuaaaauuggauauguuuuguuaauguucauuuuuaucucuuaacaguuacuaugcgagucagaagaaaacauuugaaauuaaucccagacacccgcugaucagagacaugcuucgacgaauuaagguaguauuaaagcaguccucuugcuugucuuuuaauuugaguacuuuguaucuuuuaauauuaaucuagugcaucuucuugcauuucaggaagaugaagaugauaaaacaguuuuggaucuugcugugguuuuguuugaaacagcaacgcuucggucaggguaucuuuuaccagacacuaaagcauauggagauagaauagaaagaaugcuucgccucaguuugaacauugacccugaugcaaagguuuguauccccaaccuucccgcaaaggcuggcuggcuuucuuuguuucuguucuuucagaauaggccucucaugauugagggauguagcuuugcgacauuugccuaauuucuaccuuuugaaagaauuuuauugaauguuugaaucccuguagugucaggcacugcacuagaaacuaaguccuccuuuuacguccucuuuccuuuuugccugccuccuuuuguuagcuuggcuguucauucuaguuaagaggauuuagucugugguucugaauaaacagaagugacauuaauuaugauuuuauacauauaaaugagcaaaguggaaauaaauccaaggcauuaaugggcccauaaauguuguguuuagguggaagaagagcccgaagaagaaccugaagagacagcagaagacacaacagaagacacagagcaagacgaagaugaagaaauggaugugggaacagaugaagaagaagaaacagcaaagguauggcaaaucaagaaugugacuugcauuuucaguucuggcaaaguuaggacagaguuuuaguucuggcaaaguuaagacuguguaacuuacagaagucagacugagcauuuaaauuguuuauuucaugcacaaaccugugagcuagguuuuuuuucugcuaacuuuuaauaccuucuggguuuuuuuuauuuauuuacaggaaucuacagcugaaaaagaugaauuguaaauuauacucucaccauuuggauccuguguggagagggaaugugaaauuuacaucauuucuuuuugggagagacuuguuuuggaugcccccuaauccccuucuccccugcacuguaaaaugugggauuaugggucacaggaaaaaguggguuuuuuaguugaauuuuuuuuaacauuccucaugaauguaaauuuguacuauuuaacugacuauucuugauguaaaaucuugucauguguauaaaaauaaaaaagaucccaaauacucagugucuugacugucuugcagagaacuaccuaauacuuggcugaauuuuuuuuuuuuuuaaucaugugucuuggguucuuuuucuuagaaaagugacucaggcuuaugaccuuuuuuuuuuuugagaccaagucucacuuuugcccaggcuggagugugguggcgcaaucucugcucacugcaaccuccgccuuccggguucaagcaauucucugccucagccuccugaguagcugggauuacaggugcccgucaccacacccggcuaauuuuuuguauuuuuaguagagacaggguuucaccaucuuggccaggcuggucuuugaacuccugaccucgugauccacccaccuccgccucccaagaaaagauuuuuuuaaaaaaucaaagguugagccagucauggugacacacaccuguggucccaacuccugaggaagcugaggcaggaggauuauuugaacucaggagcuugggacuguugaaaaaccaaagaguuuaaaaagucuuccacagggagaagagagaauuuccuuaaagauuuccaaauauauguagauauucccccuuucauaggguggagcuuaaucu

SEQ ID NO: 16353 - RNA, 646 nt, Homo sapiens
uuuuucuuuuuuuggccuuggaucugcuuuguugaccucagagcacacuuugaaugccauuaaaaagcaaaccacauacacaacaggaacuagaacuggaucugaagucuucugaggcacaugaccucagaagaauucuucaacaagguggauuuauacaaaaugcaggggaaauaaaugaggcaauguggugcugagucaaaggguaacagaggaacagucagugacagcgcaggcagacgauaccucuuucucauaagugcgaguguaaaccgcagugcccugggugagugucaggaugaguuucccaucacuuagcucuggcacaaguguccucucuugcccguuacacuucugcaggugaaaaaguuugcuuccauccagugucacaauggacuugaccuuuuugucaucugcuguugucucaucgaaccccauccccagcuuaaagcugaucucuguguucuugaacaugcucuguguuuuuaaggugauaauguccccauucuuuuugaugauugugguaggcuuugucaugcuagccaccugccugauagcaaaacuugcaccgauuaacuucauguagucaucaaaauucuugcugucugagagcuuccaggugcacaggaaggcaucuaccauggug

SEQ ID NO: 16354 - RNA, 646 nt, Homo sapiens
caccaugguagaugccuuccugugcaccuggaagcucucagacagcaagaauuuugaugacuacaugaaguuaaucggugcaaguuuugcuaucaggcagguggcuagcaugacaaagccuaccacaaucaucaaaaagaauggggacauuaucaccuuaaaaacacagagcauguucaagaacacagagaucagcuuuaagcuggggaugggguucgaugagacaacagcagaugacaaaaaggucaaguccauugugacacuggauggaagcaaacuuuuucaccugcagaaguguaacgggcaagagaggacacuugugccagagcuaagugaugggaaacucauccugacacucacccagggcacugcgguuuacacucgcacuuaugagaaagagguaucgucugccugcgcugucacugacuguuccucuguuacccuuugacucagcaccacauugccucauuuauuuccccugcauuuuguauaaauccaccuuguugaagaauucuucugaggucaugugccucagaagacuucagauccaguucuaguuccuguuguguaugugguuugcuuuuuaauggcauucaaagugugcucugaggucaacaaagcagauccaaggccaaaaaaagaaaaa

SEQ ID NO: 16355 - RNA, 2846 nt, Homo sapiens
cagcacucucucacuucuggccagggaacguggaaggcgcaccgacagggauccggccagggagggcgagugaaagaaggaaaucagaaaggaagggaguuaacaaaauaauaaaaacagccugagccacggcuggagagaccgagacccggcgcaagagagcgcagccuuaguaggagaggaacgcgagacgcggcagagcgcguucagcacugacuuuugcugcugcuucugcuuuuuuuuuucuuagaaacaagaaggcgccagcggcagccucacacgcgagcgccacgcgaggcucccgaagccaacccgcgaagggaggaggggagggaggaggaggcggcgugcagggaggagaaaaagcauuuucacuuuuuuugcucccacucuaagaagucucccggggauuuuguauauauuuuuuaacuuccgucagggcucccgcuucauauuuccuuuucuuucccucucuguuccugcacccaaguucucucugugucccccucgcgggccccgcaccucgcgucccggaucgcucugauuccgcgacuccuuggccgccgcugcgcauggaaagcucugccaagauggagagcggcggcgccggccagcagccccagccgcagccccagcagcccuuccugccgcccgcagccuguuucuuugccacggccgcagccgcggcggccgcagccgccgcagcggcagcgcagagcgcgcagcagcagcagcagcagcagcagcagcagcagcaggcgccgcagcugagaccggcggccgacggccagcccucagggggcggucacaagucagcgcccaagcaagucaagcgacagcgcucgucuucgcccgaacugaugcgcugcaaacgccggcucaacuucagcggcuuuggcuacagccugccgcagcagcagccggccgccguggcgcgccgcaacgagcgcgagcgcaaccgcgucaaguuggucaaccugggcuuugccacccuucgggagcacguccccaacggcgcggccaacaagaagaugaguaagguggagacacugcgcucggcggucgaguacauccgcgcgcugcagcagcugcuggacgagcaugacgcggugagcgccgccuuccaggcaggcguccugucgcccaccaucucccccaacuacuccaacgacuugaacuccauggccggcucgccggucucauccuacucgucggacgagggcucuuacgacccgcucagccccgaggagcaggagcuucucgacuucaccaacugguucugaggggcucggccuggucaggcccuggugcgaauggacuuuggaagcagguagguugcauuuuggggugggcagggggguauucuugccuucguccucccucugagugucuguggaaguggggaugucuccaaggagauaaggggauuuuuauuuaaagaauuugugaaaguuggucgauuucaaguccuaguuuguuaguuucagcacuggccucugaaaauggccuugcccaggucuccaaggagugaaggguaguagugaggugcagagauacuggugaaccgaauacugggacauguuaaaagagaugucuaccugacagacucuuuccccagaccuccaucucccucuaccacuagccuacacguucaaauuaaccucuccuguucuuuuccuuauguuauagggugaucgcacaaccugcaucuuuagugcuuucuugucaguggcguugggagggggagaaaaggaaaagaaaaaaaaaagaagaagaagaagaaaagagaagaagaaaaaaacgaaaacagucaaccaaccccaucgccaacuaagcgaggcaugccugagagacauggcuuucagaaaacgggaagcgcucagaacaguaucuuugcacuccaaucauucacggagauaugaagagcaacugggaccugagucaaugcgcaaaaugcagcuugugugcaaaagcagugggcuccuggcagaagggagcagcacacgcguuauaguaacucccaucaccucuaacacgcacagcugaaaguucuugcucgggucccuucaccuccucgcccuuucuuaaagugcaguucuuagcccucuagaaacgaguuggugucuuucgucucaguagcccccaccccaauaagcuguagacauugguuuacagugaaacuaugcuauucucagcccuuugaaacucugcuucuccuccagggcccgauucccaaaccccauggcuucccucacacugucuuuucuaccauuuucauuauagaaugcuuccaaucuuuugugaauuuuuuauuauaaaaaaucuauuuguaucuauccuaaccaguucggggauauauuaagauauuuuuguacauaagagagaaagagagagaaaaauuuauagaaguuuuguacaaaugguuuaaaauguguauaucuugauacuuuaacauguaaugcuauuaccucugcauauuuuagauguguaguucaccuuacaacugcaauuuucccuaugugguuuuguaaagaacucuccucauaggugagaucaagaggccaccaguuguacuucagcaccaaugugucuuacuuuauagaaauguuguuaauguauuaaugauguuauuaaauacuguucaagaagaacaaaguuuaugcagcuacuguccaaacucaaaguggcagccaguugguuuugauagguugccuuuuggagauuucuauuacugccuuuuuuuuucuuacuguuuuauuacaaacuuacaaaaauauguauaacccuguuuuauacaaacuaguuucguaauaaaacuuuuuccuuuuuuuaaaaugaaaauaauc

SEQ ID NO: 16356 - RNA, 1859 nt, Homo sapiens
ugguuccuacccucuagaccauuuuaugguccaagaugacuguuggagcuccagccauuauauccauuauauugguauuccuuguaccaagaacuaguaaggaagaacagcacuuugcuuuucucuuaaggguacauagcuuuuucuuucaugucauugccaaaagguuagucacauggccacaacaagcugcaagggaggauggagaauauagaucuuauucuggguaauaucuugccagaauaaaaacaaaagcucuauuacuagggaagaaagggagaauggauauuggcaggcagcuugcugucuuugccucauugaacuaucauaaaaaccuuugccuuguuacagcuuccucaaaacauauccgcacacauguacaacuacacuaugguaaggauacuuguaaagauagcuuuuuaaauucuuccuuagcuauauuuuauuugcuugcuuacagagaugauuuuugucuauuuuucacauaguugauuuagagaggcuuaaucauauaucaguacuggauuguaggacaacaaagaucuuaaaaaccagugacaguauaaucuaccugaggucuuugggcgcauuguuuuccuucuauuccucgcccuugucuaaguccucuaauaaguuuccucauuugaguggguuaaguuauaguaugauauauaucaggguacaaguuugagguugucucugugggauacucucuccaaaugucaucgugucaucaggaguaaaauugaagcugcuaagaugguaguacaugaaguagaaaauguucugcauuuuaaccguggaagaucaacaacuuaaucucugauacuauuguuuguucuagggaaauuuccagugcggggaaaaaguagacaggaaaauauaucccuagauugauuucucaaaaaugcacuaaguauaaucccaauuuuugcugaaagucucuuucaagguacauauuagaauauuccaaacaguuuugaaugucaugauccugaauuuucauaauccugauaaaguuucuuuguuucauauuuguuguagcugaaauaagguagggauuaugaggaauuaagauaaagcuaagucagggcaauuuugggaauguggucacuuaaacagugccccuucccucuucacucccuacuuacgauuccucuccuaaggaaaauggauucagggcccaugggcaucucggagcauacaaggccuuagauuguaacuggagacuaaguagagagauuugauacagggcuugcuuucucaugaacugagcaaguaucuggaagacaggaucagagaccuggggugaggagcagaaaugguuaauccugagaagagcuuagccucagagaucuguggacgucuuugggggaaggucagcaaaugaccucuguagguacgcucauauucccugacccucaagccaagaaguagcugaauagaugggcucacuucuuguuggugaggcuugggagaacacaagacucuuccuuagccucagcagaugacugguagccuguuuguuuguccacugcugcucuguaaguauagauacaauuucaacuucuauuacuuguagaacugucaucacuuaagcuacuucagcagucagaucugagucccaaaaagcuaaugaagaaaacaacacaccauuuaaggguuuccagcagccagagaaggaugaguuagcugcaacacacgugcguaacagaacagagcuacuggggggaaugacagcaacuugaauacguauaaauguuagguacuugggaaaauucaagaauagcaccucaacauaaaacuauggaucuggcaaaaaagaaggcagugcaccugcgugggccugggucugggug

SEQ ID NO: 16357 - RNA, 808 nt, Homo sapiens
cccuuauaaaagagaucccaggcugggcauaguggcucaugccuguaauccuagcaauuuugggagacuaagaaggauugcuugagccuaaggaguucaagaccagccugggcaacauagugggaaccugucucuaccaaaaaacaacaacagcaaccaaaaaaacacacagcuggacauggugguaugugccuguaguccuagcuacuugggaggcuaaggcaggaggaucacuugagcccaggaauucaaggcugagcaguacuccagccuggacaguagaacgaggccuugccucaaaauaauaaauaauagcaaaagagacuccagagagcucccucugcucuccaccaugugacguuaugagaagaugccaucugcaaccuagaagaguacccucaccaaaacccaagcgugcuggcacucugaucucagacuuuggccaccagaacugugaaaaacagauuucuguuauuuauaagacaacagaugauuugggcagauaauggaauuaaaaugguaauuccuggcauaaaacugcacccacauccuuagagaucccauucucccacuugaccaguguacugcugagcccauaaccugcgucuucugcucuagccucuugucugucucauuccuccucugcauggauugucucuauuuggaagguccgugguuuuuauguguaaaaugaaagcugccguguucccuuuccaacaccaagucuaguucucuagcucccauucuaucagugucauaccucccagcuuaaaucuuuggaaccaucuuugacuccuuacuuuuuaca

SEQ ID NO: 16358 - RNA, 32597 nt, Homo sapiens
uuccccuacagguuaagauucugugucaccaguugcugguccagguuugugaccugcucaggcuaaaggacugccaccucuuuggacucaguguuauacaaaguaagucuuagagcccucucugauggauuuagccaacuaucccugaggaaaugacaucuuauagcuauaacuuaaauugggccuauuguuauaaaacugugauugucaaaauacccauggacugauuuucauuuuuaguguagguguaguauuuaauuuuuuaaucucaauuucuauguauuuuuuacaauauuuaggauuuuaggcauuuauuuauuauaguuugaacuuaaaaauugauuccucuuugggaaucuagauucuauguguuugcucuuccauguuuuaaugaagcaagcuugauuuuuguuuccuugcauucagggagcagcuggaauacuuaggaaaguaauuuaauuuguuuuauaauuuuugacauuaaacugacuucucuuuucaaguuaucuugcuauuaacuauauaguaucacaaaguaauuauuaauuuaaucuuauuuuuuauuuuucucucguaccccuucucuuuuuuccagucagacuauaugacuuggaaauaucgggucaguuucuucuauauucuuugugaggagaagauuuuuaaguaaaggacuucauauaagcuuucuucucucauaacaccuuaguuagaguuaaauuucugggacuucucuaaagccauuuauuauaagcuuucuuccuucaaaugauauuuuuaaauuucucuaauuuagucuucuauauaucuuugcucauuuugucaagaagaguuuuuuuuggugcgguguauuuaauucuaauucuugaauaugguuuauuuucuacugcuggaauugguuuaaauuucaaggcuuaagauaucuuggaaaucuggucaauacaauaauauguuuacaccugccaaguuggaaaggauaucaguauaaaguuggucagcugauaaacaaggccccuuucccccaaaauguagacuguuuucaguugccuuuuuaggagaggcuaaagagcauggagcagggaacacaucaggaccuugugaaucagccauuugcucuucaguuucuuccugugguaguuaaaacaauaaaacacaguugcuaagcuccauccuuguguuagugcauacuucagucguucuuucagggaagagucugagagccauaagaggcucuauagauucuaaguaacuuuuaguauuccaugcucaaaguuaauucuucuuacaacaacuacugcuagauccuuauuguucaacaaauaaguccaauaaaaccaguuuauagcuuccuuagguuucaaaauaauuuuuaagauguccuuuuuaaaaaagagauaguaguauggcgaaagaacauugaaacaggaauugguugaccugguucuaauuccgguugcaccccuaacuagcacuugacuucucucaaugucaguuuuuucgcgucaaauggaaauuacuacuccaccagcuuugcaggauuaaugugcuuugagaauucuuaagguauaaagcucuggucagauuguagguggcagagguauaguggcaguuuaaaaauauauauauguacuauuauggugaacagucuuaauucuauucauuauguugcuucuuuaggugggaacucaagccaaacacaaaucaguuucgacaggaagauugucuggucuuguuuauuucauguuuaaucagugauaugagagaugggagauaguguuaguugaccuaauaacuggauuuaaguagcauuccuuuuuuugucucugggaucucuuuucuaacccuuucauuaaaauugguuaacuuaaugucguuuauaaccaacgaguaacuuuacccuuccuauuuucuucuggcauuuuuccagucaagucccaguauucagcuuggagucaaaguguagcaaagugugcacaucuuuggaguagucaaagagacacacuuccagaacagguacauuuuuaugcagagcuuuccgugaagaugucuccuuagugauaguuagaauaaaaggaguuuaaaaaagacuugaaacuuuguacaguauaggaaugccaaagacuucuuuugugaaauagcucucucuuuuaaaagauuaucuuugggaaauaugaaaacguuuguuuucuaccagcuucuuuucacguguuuagaucacuuuaacauagguuuuagcggucuuauuuucuguucaccuuaugagcaucauccccuggaagggauguuuuggcauccauacuuguuuuucauaaaauguuucuucucuuuuccaugaaauugaucccaaaggcagugcgaguaaggguuuaucauuuugucaugcuguguuuugcuguguguggaacacggacaagaaauagucuuaaagauuagucuucacaaaaugugggucagacuucucacuuggaaaugagcugauaccguguuuucuaauuucuuacauagcaauuaagauaguguuucugcccugcuuuauuauuuuguaccuauaagagcaggcuucuuugagcugaacaaaagcauguuuuccuaagacuaacacccacaguguuagaaguuagacuguaagucauaaugacccuagaaacuaagaaaaagcagaaguuggaaucuaagauuucuucuaaauauuauauacuuuaauaguauguguucuguauugcaaaagcaaaauaauucacaaguaucucauuaaugucuaguucacagaaccuuuugucuucuaguaucucuuuggguuuucuaguaugugcauucagacuacauucacaagucuugaggcuuuaaaagaaacuuguuucuuucuauauuuuuuuucuuuuaaaaauccuuucuuuagcaugucgucuccuuuuuuuuaauguacagauaaugaacauguguauauggaguugucacaaaagcuuuacaaauauuguccaaaagaauggaagaaagaggccagcaagguacgacaauacgaagucacuugggugagauuacauuuauaagcaaaauuauuuugauuuuuuuuaaaaaauguuuauuuuagcuguuauacauuagaagaaaacuguaagcaauacuuuauguacuauacuauauuuucuacuuuaucuacuaaguuauauauaguauauguauaguauauauauauauacacuuuagaacuuauaauuuucuuuucccauuuucuauauaugcugaguauauauauaguaguauauauacuuaguauauauauauaguaauauguauaguaguauauauagaaaaugggaaaauaaaauuauaaguucuaaaauguauauauauauauacuuaguauauauagaaaaugggaaaagaaaauuauaaguucuaaaguguauauauauacuuaguauauauaguagaaaauauaguauaguauauaaaguauauauaguauauauacuuaguauauauaaaaaaugggaaaagaaacuuauaaguucuaaagugucacauuaaucaaguauuaauagcuuauagaaaauaauaaauagaaucuggauuaucuguuaaauaauguuggauaauaacuuuaguaaucuuggaauaaugcuuuuaaaugaaaaguauggaaaaauuauuugcucuucuuuuuuggcuaugcuaggugucaaaauugcuguucuagaaguuauuacuaauuuuuaaaucuacuuuuacuguacuugcauuugaugcuuuguccauucauuguacuggugcuuuauuucacaaacauuaauuucauuuacaugagagaacauuaauagggaauucaccucguguuuccagaaccucccuaguaagucaggaauaguaauccuagauccucuaauuuguauuuaagaagucuuggaguaaacuagaaggcuacuucaaagccagcugcaaaguaaagaacaugaaugucuaaauaaacaaacagcauauuagaauuugguauguggaaugucagaggaacaagagaacauuuguaauaaggagcaaauggucaccacagggaacagagcugagcgaggagcugggucucagcuagaaauuuccacuggcauuuauuuuuaucuucccuuauguugucauuggcauuacagugaaugaaaaucagauagaaggauggugcccuguuucgcuuuauaacuuccuaauuguauaugaaccugguaucuauauaggacaacugucuaccuacuacaagccccuacucauuauaaguaaauaaaaccuaucagugaucaaaaaguaucuugcaaauaauuguauuuugguugcuuuugaaacccauuuucaaaguaacuagaaauagcuugauuuuugugugugcuuuuguuucuaggguaucgaccaauuugggccuccuaugaucauccacuuccgugugcaguacuauguggaaaauggcagauugaucagguaagaggacagggggugauucuaaacgcuuuuuuuucccccauagcacuuuuucuaacauaccaaauaaguuacguguguuuauucuuugucuucaccuuuaggauauaaacucuguaggagcagcaauuuuuuucuuuuuaauauuuuguacgcugguauauccucagucccuaaaacagagauacaauaggcauucaguaaauauuuguuaaaugaaagaauguuagacuguugauaaaaauauuaacaguaucuauuggcccacauuuucuccacuccacguuuucauaaccaaaucagucuccaaaaagauacuuauuucaagaagaaacuagcacuuuuguaaagagugaggagguugauuaaaagauuauguucuuuuccagugguaaggugggagugggucagaggcaggaacucuccuauaaaaguggauggguguuuauauaaucgguuuucuuuucauguuuggggucuuguuuauauucuuggcaguagccuuaaaaccaagauuaagcccagugaagcuauccuaucagaaucuuagaugcaauuugacaagggcagguaauugauucuuuuucuggaggugugugcaugaacaguaguaggcucaggaugcaaauucagaauucaccauuucagaagcucggucuguauaggaggauucagugcuagaaaacuuucagaagugauuucuuggccgauagaaaauacuagaaauaugaacucuguuuugcuuauauauuuuuaaacuuugagaaguuccaugugaaagaaacaaaauacauauggcuagugaguuauauguaaaauuagcucuugauauuuuuaucaaugccagaugcaaauuaaaaaguaaaaaaauuagcccauaaggauuuuuuuuaaaaaaggcuaagacacuuuauuaguuauccuuaguuuacauacaauuuuuacuuauuuuaccugguaaguguggcaugaccuggaaagaaggaauauauauauuuaacaaauaguuaacccccuggggcuaaguuuuaaugcaucccuauacuucugccccuuuuucccaggcaugaaccaguccaaaccaucugugguuggcauuauaaacaaaagugcucugaaaaguacucuguccuaaggggggaaaauuuacauaaaugcuuuauuuuuaagcucuuucuacuuaaccauggucuuaguuuaaauaaacccauauguguuuauuguuaucugcuaaugacaucagcuaugaaucucagguaaacauucaaccugaaauaauguagaggcaaaugagcucauuaaaauauguacacacacauuuuuacuuugaucacaaaagcauccuauuugccaguaaauauuuuuuggagcuuuuaccauguuuuccccagucagcauuucuuaacguauuuaaugaugacuguauuuauuucugaucucaagagauuguaaugagugcucuguuaguauuuccuuuuguggggaguauaauaauugucgugacaugugccuguaaaaacauaacaguaauguaacauucacuucaaaaaaauccccaaaaaaagauuuaaggaaagcauucauugcauuucuucuuggagaaguuuaaaaaacggaaaagaaaccuuuguuaagcaaauuuuuuuccagaagaguauauaugcaaauacuuauaaagggccuuagaguauuuguaguguguucaguuaaaaaauaauaaaaagaacagcaaaacacugaagcaggauugcuccucagauuuuuccuuauuuaugucacguguguagcaucauuguagcaacauuaguacagacaacacaugucuaguuucuauucuaauacuuguucagugaaauauuuaccauuuuagaguggaaugauucagaccuuuuucuucucugaaugaaucaaaugcuguaagccuuaggaaacguuauuuuuauugucuggauagucugauuugggguucugacccccugcaaccucagugaggcagcuaucagauauuagcuacaaccgcuuccuuuucagugaggugggagggaggagcagaaacagaaggguuccugucaccagauggagagaaggauuuggguucuguuuacaugucauuggauuauuccaucaaaaugugaguucuguuuucuuuuauuuuucuagugacagagcagcaagauacuauuauuacuggcaccugagaaaacaaguucuucauucucagugugugcuccgagaggaggccuacuuccugcuggcagccuuugcccugcaggcugaucuugggaacuucaaaaggaauaagcacuauggaaaauacuucgagccagaggcuuacuucccaucuuggguaagcacuguuuucaaauucgaaagaguguuuucucucgggcauuucuaguucguaguguugcuacucauacucuuuaagaaaugggaacacagauguucuguggccaaauucuuugugaugcccagauauuuaaugcuuaagaacguggugcacaucaugucuucauguacuuagucugcuuauggugagugggguagagaauugccauccauccugauaauacaguggagcuuggaauuuaccagccuccuuucagcauugacaugcccuugaccuucuugccuacucuuaccgaagcaguauuuucucccuuugaaggcagaaaaacauaacucuuuaaaaaguaagauuauuccucgcuuuccuuugcugcgagaacaaguaugucaacuucuggcuccggccuccauguccuccacucucggggaggaacuaaccccuucuuucagcaagaaaauguggguuauuccaacgugaacugucucagcugcgcuuucuccacuccacccugucuguuucucuucccguccuuccuccaugucuaggcuguauuuucugucucucuucuauaucauuagccccuccccaaaguaacucuucuucagugagaacaugcaaaacauguuugguucucacccacccauccuugagaaagaaaguggggagggaaagaagagcuacuacucuugccuuuccuucucaguaaagcaucuugaagagguaguguguauuugauuuuuucagcuucuuuacuucccacaaguguuccucaagccauuuccaucugccuucuuuccccaucaguccacucauggugcugccuguuagguugcuuuauaucaauacaguaaagaaguaaaaaauuaaauaugcacuacuuuugcuuuauauugacaccaguugcuuuauauuaacauauccagcagacucuuuucacuaaauuuugcugcuguaccugacacuuaacuacucacaucuugggagaucucauccaaauuaaugcuuuuaacgaucaccuaugugaaggcaagucccaaaucugguuuuuuccccuauauccauaagguagcuguuuacccauaggccguucaaacucaagauguccuaaaucaaauucauuuucuugccaccucauuucuacguauuccuaccucugaguacgugggagucauacggaacucugccuuaucaccauuccuucucccuguccugucccaucaacuguaacaccuuguaaugucugugcuugaauaccaaucacccagcuuaagaaauaaaauuaucuucuauuuuuauugccauuagccuuccuaaauguccauugccuccucucccugucuuagcuccugcuguuucuagguucguguucucagcagcacuguugcagaaacuugucccugcuucggucuuuacuccacagcuugcagaugagaugauuuugcuucugacuuaaacuuucagggccuccucugucaccuguggagugaagcucaggcucccaugcauaaccuagaaacucuccagauuauagucccugccagccauuccagcuuccuuucugguuguccugcaccuugaacuuuaggcucuggcaacauccagccauuggugugucuccauacuuacugugguguuucaugcuucaggucuuucuucuugcaguuccuuuagccagugaagccccucucuguuucaccuggcuaacuccuacucauccuccgagacucagcccaggugucgcuccuucugggcagaccaucuaggugcccagugcucaagaagaaccugggaauaguguuuuacaucuuauuuuaaaaugauuuauuucuugcucccaguaaacuguuucuuaguguguucugaaagacgggcauaaccuuaaccuuuucuauuucaucagcucuucauauugagguacucaguaauuuuuuguugugugacuuagagugcuucauuuuuuuggagagaaaucacaaugucugucaaacuauugcugucuguagcauguuugcauucucugguugucaucaggugcucauugaauauugauuauugaaauccaguuaguaugccagggcaaccagugugcugagauaucaguuucccccacccuugggaucaccaaagccaucugcuuuagugcccuuacaaauacuguuuucagugugcuuuugaccugaaaaaaagguugauaaauaacugauuuaacugauuaccaugugaaaagaaccuggaaagaaaaaucuguguaacuugaguucuuagcagaacuugacaacugacuauuaauucaucauauuuaauucucuguaaaauauucaauaggaagaaacaaaaugucaauauaaagacauuuuaaaaccaaaaagucuguaauuuuuaaauuuugauuauuuuaagcacgacucuugcucacauugcauaauucuuuccaucuguuaaguuccuuauggaaucagcuaagacuuuaaucaacaccuuucucuuagccugcagcugcuggauacuauauauuugacaucugaaagcccagaguacugucugaugaaaaucuaagucacagugaaucacaaugaguguuugaaugaaacgguuuucucauaaguauuccagcaguguucauaucagccucuuaugcaagaaccaaaaauguuuuagagaauuucucccaguacccugccuucuuuugauuaacauuuagaaccucccagucuguggcugaaauuuucuuaagaguuagguaggauccagaaccugaagaugugccuacuauagauguauuucaugguaccaaguauaaacuugcaaguauaaacaauuauguguacaaaauuaugaaaguuuguguaguguuuuucucuuggugacuuuaaagcaaagauaacuuauuuuuccuauuuguugugauuuuucuucuuagguauucagcaguacaacuaaauugacucuauagcuucuaguauuagcugauuuagccuaguaacauaacagauggugaaaacagaaugaauuuucaaugcaaaccaaccaguuuacauggccuauuuuagcuucucauucuuucaucauuuuggggguggggguagaacuuacaucucuccaacaaauguugcauugcacaccccuuguaucccaacagguuguuuccaagagggggaaggacuacauccugaagcacauuccaaacaugcacaaagaucaguuugcacuaacagcuuccgaagcucaucuuaaauauaucaaagaggcuguccgacuggaugacgucgcuguucauuacuacagauuguauaagguaugaaacggcaacuaagucuucagcuucugagaaaaaaacaucuucucaauaggauugagaaggaaaaccgaaggauuucauuuccauuaaaacuuauuucauuuuuuacaugcuuuuaaaagaguuucauugaacugcuuuuuguuaucgcacgucagucuuggaggccauggugcuuuuacucuggccuggaagcgggguggaguauuuuuuaaugguucuaauagugagaugacaauuggcuauaagauguuaaucugacuuuuuuagugauuauggcauuguuauuucucuccuccccaaaucugcuuuucugcuuuggggaauagcauuugcaacuucuuugauaaguaauuuuuaauauuccucaaagugaagcuauaccugcguuguauccgucaguuacaagaacauuaccacaacagguaauguuuauggaguccuguguuuacugggcacacuuuauauguguuuuuuuuaauccucauaacuuuauaugaaagguacuuuaaucuuuauuuuacaguccaggaaacugaggcuuaaagagauuaaaugaaucaccuaagaucacaaaacuaaauggcaaagccaggauuuagucaaggccuucuugauaacauaggcugugagccuaaggcacuguauuccacacguuccucacucucggaaguuacucuccuuugugucccguguaucucuagccucguuuuuccuuucuggggcagaggucacacacccaaauaacaacuggggccaugcucugcagggaaucacucacaguacucuauaucaucuugucuucucuuccccuccuccuccuaaccccuuucacuauuccauaagugccacuuuguuggcaagaacuccugaauacccacuuaaguauucaaagguguauucucaaaccaaauggaugaagugguuaagagcacuguaaguugagccuaacugccuaggauugaaucucaguuuggccucuuacuaugugaccucaggcaaguuacuuacuuaaccgcucuguacuucaguuuccccauaguuaaaggggacagcaacauaccugcuuuuuaggauugcugaauacuaaaggaauuguuggaugaaaaacugcuuaaaacagugcccagcacauguuaagcaugauguuaaguuggcugcuguuaccauuaccauugauaguauuaugcuuguuaucucuacuuugccuuuugugguaggauuagcauagcuagaccauuggaaacugggcuuuaguuuggauguauugcucaguaaucuuguuagcugguucagaaaacuuaagggaccaacugauguuuuuucuaucucucuucuaugcccaagagaugcauuauuaaugccccaucuuccuugaaaggcauaauugaguuccauaagaucuguuuggcuaaauuccuaaaggacugaguuguaauuuuuuuuuagccugaagagauuuuauuugugacaccucaauugacacaagaaaaugcaaauaaaugacaguuuugauaauuaguuuauauuuuaaaauguauuagaaguaugaaugauauguuggaaagaguaagaguguggcuuuggaaucagaugucaauuagaaacccuaugucacuacucgcuauagcugggauccuaggcaacuauaauccugagcugucuauuaaguggggaugauacaauaugcuucacaagguugggaggcuuuggugagauaaugaaucugaaauaaugagguggaauaccuggcacauuagugagugcucaauaaccauuaauugcuuuuugccuuauuugcuggggaagcuugcuauuuuaaagaauccuauuaagaaauaagaaucuuuuguugaaguagauauccccaauuuaucuucuguguaaaacuuaauuuucaaguuuacuuaaaguauggcgcuucugaauugcauagaaaaugacucuuaucugcuaaaaagauuuuuaguaaaaauguaacauaaugaagugggggaaaagauauuggcugauucacaguuuuuauucuuuggagaaauucagcggcagccauuaaaucugcuucauuuaggagcugcucauaaacgggaaauaagguagacaaaggacaagggaacauucuggaaaaaaaacccguuuugugccccuuucccaccaauauauaccguauacuugaaaaccagcauuuuuaugagcauagccuuauuuuggaaagcaaucuguacauccuugaaagcgaaauugaccaaaacucauauaaugauggauuaguuucuccucuuaaagcuuaugcuauauguguuuuucuugauguaaaaauauacuaguuggaaagaaacagccuaaauaguagaaauaggcugugucuuauauuuauaaugccaggugaggacacauguuuuaaaaauauuucaucccauguucaugggaaagcuggcacuaagcuuaaaaagaucucugcauacucauuguguuuauugggaaaucucauaaugaaaauauuuacuuaguaauuucauuucuauuuugaacuuuauacacuauauauacuuauuacagaugagcacuuaaaggauguggcugaauuuuaaagugaauuuuuaauuguggagguuuuuuuuuccccuuaugcucauuguaguuuauuuucuacaguuuaugguuuagcugguagauuguguaucauauuggcaagugaucauugaacuucuuaaaaauaaguauuuccaaacuaucugaauacaccgcuuguacagcuuuauuauccucaugagagagccuuaaauauuuggucacuugccccuaauuuuggcuacagagcuggaagaugugcccaguuuuaaacauauaaagucuuaugcaucucagaauauaacuauuacauuugauuuaagauucuaacaucugagaaaagaguaauuaugagauggaaggucaaaaaaaucaaacaaugcaaaagcagcaaaaauagccuuguuaacuggaguugucaauaacaaguauuuagaauauugucagauacaaaaguguauguaauauagugaaaacacuaaaacuuugaaaucucaggaauuuaaaaaguagaauauaccauucuugauuuaauaugugcccaugguuuucuuaauucuuguaggaaacuagguauguggaaaggcuugagcaaaguuauuuuaagucaaaaacuuuucaguccugaauuucaauccugaaauguuucuuuggugcuaaauuguccacuguagaaaaaauauauaaaaacauuuaauuuuuuauaaaauccuauuccuacaggauaaaagggaaauugaagcaucgcugacucuuggauugaccaugaggggaauacagauuuuucagguugguaaaugagaauugugucaaaugcugucagccaugucuucuguuuacagcaugccucugugguccugccacagguucaguaguucauuuuuggccacuggcuggucaucauuucccauuugucuagcacagauguggaugauguaggauggaugaagugacucagccugauuguugacaguaauaagaaauaacagaaaacaauaaguaauaagaaauaacagaaaacaauaagucaaagauuagcccagguucaucacuaacaggucacuaacagaucauuaauauccaaacguuucugugugucagugauuuuaaauauucuuuuauccuuuggagcauuuguaaguggaaagaaaaacaacauuuuaauauugugccugaccagacguuuuaauuuccguuauacuuuagugaugaaacuuaccccuuaaauaaguagaaacugucaccuuuuagcaggugagacaguguuauccugcagccaucaaaaagggagacagauaccucuuucagcaagacacaggaaagugaaaggaugucuuaucuuugauguaggcaaaauauccaguuaugaaagucugagcgccuuauugcaucucuugaauaccugaguccuuuggacuuuuuauuuaaauuuaggcauacaccagaagggaaaagauugccuuaaaaggguuaguuaauacagucacacaggaaccaaaagccacagaauuguuaucaugaaucuuuuaauuauugucuguauuucuccaaagagaugugggggcuuuuuucagauuuuaauuacuguauuuugguuuucagggaaagaaguuagagccauuuuacaguaucuaucauuuuucccauuaacuccauaugcauauucuuuucacagaauuuagaugaagagaaacaauuacuuuaugauuuccccuggacaaauguuggaaaauugguguuugugguaaguuuaaaauaacuggcuuaaaagaaaagucucauuaauugcuuacuuuuuuggguuucuguuauuuuuuguuuuguuuuuaaacaauauugucucaggcacaaaagcuguuauuuuuaagaaguugacacugaagauaauuugcuuucuuguauucuaaugcaugugcuauagauucuuugucacacauaucaguagugaacuuaaaaucaaagaaucuuacaguaaagacucuuauagcaaaagaaguuaguaauuuuaauuuauguuugguccguagcacaugacccuaaguuauucuaguugcagaagguauuucgcguagagguuagccaguucuuuugaaaguuaccucucuugagcaaagaauaaagaauuauauaaaaagauguuucuauuaauauuugacuauuuaaaacccauuauuuuaaagagaggucugcaguucuuaacaugaaaaauacucuuacaauauugagaaugauacauuuucuuuuguuagagcaacgucuugauuuuucccaaguauuucucuuuugccagcuauauccguuuuuugguaggguucaaagaauuauaguuaauaauguguacauuuggucauaaaaauucauaguucuggccgggcacaguggcucacuccuauaaucccagccacuuugggaggccaaggugagcagaucaccugaggucaggaguucgagaccagucuggccaacauggugaaauccugucucuacuaaaaauacaaaaauuaguugggcauaguggugggcaccuguaaucccagcuacucaggaggcugaggcaugggaaucucuugaacccgagaggcgaugguugccaugagccaagaccgcaccauugcacuccagccuagguaacaagagugcaacuccaucucaaaaaaaaaaaaaaaaaaaucguaguucugcuuuguucagaaauuacugaaaaaaauacaugaggaaaggaagauaaggauuuguagacaugggcuucucuccuguaagaaagauggccuauguaaauaaagggccauuucuccugcugggauauauagcuccaugaggcuauauugcaaauagaaugugggcauugacuccaugcugcccuguaagucaaaagauguguuucugacuucacauuacuuuaauuacuugggcacgauucaaucugauuucacuuuacuuauacauuacauggggccuaaccugucuccuccuaacuggcucuuuuuuguuucaagcuauuugugaaaggaucugagcuguuugaaaaugagcaaauuaugacgcacuugccccuuucaugccccaaauuaaguuauaauaaaguacauuuaugaaauugaggguuuuuuaggguccuggacuuguugcuugcugaaucuguuuguguauugcccuuaucugaggagucuucuuuaaagauacauauuuuugggccucaugcuccuccuccaggagauuuuugacucagugggucuggaguagagaugaggaaucuauuuugacaaguuucucagaugaugcuucuugaagccaacucagcucugccuagcuguaugaccuugagcaaguuacauaaacucugugccuugguuucauucuaaaauguagauaauuaacucccucccuagacuugcuuugaggauuaaaugaguggauacaugcuuagugcucaauaaaugucaguuguuacuauuucaguauugggguccacugguaguuccuuuaaaaugagggaaaucucagagauuuaaaaaaaaaacaccuccaccuuaucccugccugggcuauacaagcccauacugcuccauacagaccuuaagguguguaguuagaauaugucuccguucuugcuuuaccuccacucucuggcugagaaucauuauaucugaaauacuccuuuuuguauuucggcugcccuauucauuauuaggaaaguuaaaagaguucauaauaucccauaacuguaagaaacuuugucaaagccuugcccucaacuuaggacuuuaucuuagugaucagauuugaagaaugagacuccuuauaugucuacugauagcuguucuuguucuuucccaucucauaccuccaacuaccagcucucucuauguuuagcuagggaaguuuuccauuucuucuaaaccccaaauagauauccuguauuguucacuauauaacuccuuauuuauuuccaauaauuuaucauaaacuuauuauuuuguguguuucuuugccauuucuccugcugggauauauagcuccaugaggguaggaaccuugucugucguauucacugccuauuuuuuuuucagugccuagcaagguguuugguacauuuuaaguguucaauaaauauuuuagaauugguaaauaauuuagaaucuuuuagaauugguugccuuguugcugaguuaggguguugggauuauauuugaugguucuuuuaugauggacccuucucuucugcauuauacaaauaaccugaccagccagagaaaccaaagauauuccucagcuguuuuggauagucaguguuuacugacagacccuuguggcuagaugcuuuccugaauuucuggucauccccuguccugugacauuuuugaaaggaaaaacaauaauuuaucccacaaggaauuuuaaaugaaacuuuauacauuucagaaucuauaauuuuccuuacuaaauaggaaacaaaggggacuuuggcaaaucagagauuuuucuuccugaauuugauucaugguuuccuuccaaaggguaagaaauuugagauuuugccagauggcuugccuucugcccggaagcucauauacuacacggggugccccaugcgcuccagacaccuccugcaacuucugagcaacagccaccgccucuauaugaaucugcagccuguccugcgccauauccggaagcuggaggaaaacgaagguauugcagggucugggguguggaagcaaauuguaccuuugccaccuguggccucuuacucugaauggggguuuugagcuccuacagaauuggauuuugggacugggacacuccagauugagagcagcauuacuauuuacaucucaguauuuccagaaggcaaaggguuaggcuugagccccaccuacuguagcacuuauucagaauaucugaggugacugcauuuagcuaucucucaaguacagucucuaagguuuucccaugccugacuugaaaauacuugcaaaaagccacccauaaaggcacagggcaaggguuuaucugcaacucagauuuuaucugcauuuuagagcuuuguauuuacacugacccaccuuagugcuauuauccacagguggucuggaauucuuuccaaugugauuauuucuuaggguuagagugacaauaaagguaggucacagaugugucugcagccucugauugacggcugggaggcccccaagucuguucuagcaagagugccaaacaaaggagagggaagucagcugguccuguggggccuuugcugagaugcagaugaaauaaagcagucugucuggggccucagaguacuggacccugaaacggggaucaugucagggugggaaagaaggcagugcuaagggucuguaacauccgacuucaacuuuacauuaaucugauagcccuuuaucuugaguuguggcacccuggauuuccuccauuuaacacaccccaacccuaauccucaaaacugcuacauuacguauuuggguuuguuuuuuuuuuuaaugcuuugggguuuuguuuaugcuuucaaagauuuguuuugcaaaaauuaguuuuauaaauucauguuguaguaauaucuaacaguaauuugauuagauuggauuugguguauuugugugaauaucagggugaagauucauauuuuagguucaugucugagacaaguuuugacaccucagaccucaucuuuccuuuagaaaccaggcaaauacccauccuuucuuaaacaaacaaaagaccuuguagagguuugugcuucugauagauuucucucaaaaauucucugucaauccaaaugagacccgguuuggcaauucuuuuguaauuucguagcgauuagaacaugaaucauuccucacugucugccacaaacugccugugucuucagagagaauugguauaacugucagguguauuggcuucagcugcugcuagacugccacuucuuccccacgaugacucaucaguguaacaaauauaucucuccuaugcugacaugaauaugaaaaggaauucagauggggacaggaggaggaugaagaagcaggagaaccugugagaauaggugacauaauuacgugcagagcccauaauuugccaagucagcuucauuccuaaacgucuaacauggcaccuugagaaguugauuuguucuaucagcuuucugccugcagcauuuuaguacauuuuuuuuguucagaugaccuuaagagaucccuucagagccuuaaagaauuaaugaccuuccucuauagguucuaagguaaaaauugcaaagaauuuugaguuuucagagagacagggcguuguucauugccaaccauaguaccaaguguauucggaggcuuaagugaguaggugucuuuguuuguuuugugcugcuguaacaaaagaccacagacuagguaaguucuaaagaacagaacuuuauuuccucacaguucuagaggcugggaaguccgggauugaggggccagcaucuaccaagggccuucuuguuacuucaucccaugauggaagguggaaggguaaagagagggugagaaagaguaaaagggggccaaacuccgccucucauaaugaacccacuacugcaauaauggcacuaacccauucaugaaagcagagcucucaugaucuaaucaucucuuuaaacucccaugucuuacuacuaugauauuugauaucauaugauuuaugauagcaauuagauuucaaccugaguuuaggagggaacagacauucaaaccauagcaguagaggaaugaagaaaugacacaugcuuaguuucuucuacuuagggguuuuccaggucugaaaaaggccugaaauuaaguuucucugggucaacuuuggccugaauccaagaucucacccccauuuaagggcuuuaucauuuuaacaugaaaagcccuuuuuugggcauuaguuuagcaaaaaacagcauaaaaagagucuguguuuuucuuaauuuuauguagagucaccuugucuaaaacacuauuuuagcauuuuaguagaaaaugaucacaaggauuuuuccauaggguuuagaagagaaacaaaaacaugccuugcgucauuuaaaaaaauguuaaagccuaacuuuauucaacagcuggagcuuauuccuaggauaaguauucacauuuacugcauuauuuuccaaaguagcguaugaaaaaccucauugucucugggcuuuuacaacagagggaguaaaaagagcacaggcauguugaugaucugcacuguugacaccagugauuauuagggggaugagagguugcauuuuacauuucuuagaaaacauuucagaauuauuuaauguuucucucaguuuguaacugaacggugugaagcuuccuaaaugucuggaaagggucugguacagcacuagggagggaagagaagccagccauguggaacacccaggccaugcuaacauguugacaggaauagguagaaaacaggcuggcaaguacuugucuucucgugagcauacuagugaauauagaggaacuauagugaucucugaaccuaucaggaaguugagaguaaaaaggcuauauguaaagauacagaaaagcuuuuaaauuauuagguccacaguuccuaauuauuuuagaacaauggaacuccaacaacuuagagacuuuuacuuuuuucucuucacuugccacucauccaagggccacauggcuauugcugugaaaccacagugaauaaaaacuacaguaauuuuugcaaacugcuuuagcuguccaccuucaucucacaccugcugauucagaagauggggauuguuaggccccagucugcucccugacaaguuguacauggaugcauuuuuguugugaugauaugugcguggagcucuggugucugguuucagccugcuuucucuguagcaacacauacucaccuuuguguuucagccaguuccuuagaacaaugugaauaggcuggaaccuggaaaugugcacauagccuucuccaagcauuuuuuuuuugcauuuugcauccuagaaggcgcaucuuuucuuucuccuccugcucauuuucucucuagggacccugugaugauuauacuuccgagcuggauucagacaucaggcaugcaaguauuuucacuuaaccaagaaacaagacaauuaaaauccauuaacaggccccugagaacccaauuagucuacuaguuucuaaaaucagaucaacuucacauuccccaaaugcacucuccauuuuuaacauuguuuuauuguauuauuucucaccaguauuaaaaaggcaaggaaucuaaacuucuuccuuguuuuacauuucugaccugaaagacaagaauaauauuuuugugucaguugaguuguaacuggcagcuggguuguaacuuugugccuuaauggaaugguuaguuuauauguaauaaaagagacuuugcaguguuguguguuugacugcguuaaagaacagcacugacaugugaaaucaaagaacagcuuuaccagucagaguuggaaaucaucaaaccaguagugauuacugguauuuucuaaguagaugauaaagccucacuaauucagccuaaguggagaaaaucaaucuuauauuaaugaaaauccaaauuuuagaauauucacaagaaauucucagaagaauaguuuuauuuuaaauuguauucagcagcuagagcuaagcuaacaguggaacaaauugaacaaaugaacaaauaaaaugaauggcaauuagcauaauuguauuuauuaaguagucuucuagagcagugcuucugaaauuaucugcagaaaagggccagauuuuuaaaauauuuaauaugcuauggauacuuucgcaaaauacaaaaucacauugguggcugucauggcaaugucacauagcucuggaaguuucuaaauguucauaucacucacugaauuuauuucacuauggaccaauaaauuugcagacaagaaguggucuguaacugcacuuuaaauaccacucuucuuauacugcuugaagcuuucaaaaaacuaaguaguuuaaauaucccccucaaaucuguugcacugguuuuuauucauuuuucagucuucugaagucaaauuccuaucuaaauuauuacuacuuuccaaucacuagauucugaauuugaaguuauccuuguucuuggccugaugagucacuuaagcucaccagccguuccuucugucuugguuaaugaacuguguuccccaccacguagagaagaagcaguaccgggaaucuuacaucagugacaaccuggaccucgacauggaccagcuggaaaaacggucgcgggccagcgggagcagugcgggcagcaugaaacacaagcgccugucccgucauuccaccgccagccacagcaguucccacaccucgggcauugaggcagacaccaagccccgggacacggggccagaagacagcuacuccagcagugccauccaccgcaagcugaaaaccugcagcucaaugaccagucauggcagcucccacaccucagggguggagaguggcggcaaagaccggcuggaagaggacuuacaggacgaugguaacaguacuguccccucacuggcucucuguuuagucucccaguuuuuucaagcauugguucuauagaacuggugucuggagagcaacuuuaggcaguaguaauaaaguggaagaggugucuuguugucuuccccaaugacuugguugaguugcuuguguuuggcugugaacaaaacaucccucuaguugugauccuuugcggccacaagacuggaugguuguagacucagucuuagcuguuucuaugaaguagauuggaaauuaguccugcugcccuugugucuguauuucugcuucccagauuaaauaaaacagugguuaggacagcacaguggagugcaguaauagugacagaaacaucuugaacuucuggaccccuccccacaaaguaaagauuggaguccaugccauugaguuacuuaguaauguuuuucugaagcgccucccauguaaccagaacuauagggaggauaaaagaaauauagcaccugguugauaggaacuuacugcauguuaaggagauaagaugaauccuauggcuuaucuuagccaaacuuaacauuugugucccucuuuuauauuauuuuucugucucaaauaagugcuguagcauucaggcuugacggaaaagauagacuuuguuaaagaaaagugcagaccaucuuuuugguuucuguagaauuuguguggcucucaagucacucagugcccuucagaauaggcagcuauggacauggggggcuuugugaacugucaucugccugugucagugagccuugcuuugguaucaggcaaagggcccaucaguuucgguuuguccuuugucauugcagcaaggugguauaguuuuucuucuuaaaaaauacagaauaaugggcaaauuauaguauuaaaacacauauagguaaugcagcaauccgauaagaaagaacaaguaggccaggcaugguggcucacacuuguaauccuggcacuuugggaggccaaggcaggcggaucacgaggucaagagaucaaggccauucuggccaacaugaugaaaccucaucucugcuaaaaauacaaaaauuggaugggcguaguggcgcgcgucuucagucccagcuacucgggaggcugaggcaggagaaucgcuugaacccaggaggcggagguugcagugagcggagaucacaccacuccagccuggugacagagugagacuucgucucaaaaagaaagaaauugagaaagaaagagagggagggagggagggaaggaaggaaggaaggaacaaguaguaccuguugaaaauggucccaggaaggaaggaaggaaggaaggaagggagggaggaagggagggaggaaggaagggaggaaggaaggagggaaggagggaaggaguaaacaaguaguaccuguugaaaauggucccuggaguuuccuauuggagucucauuagcaaauuuauuuucaaauaggaauaauuacauagccacccucaaaauaugguugcauauuaugauggucauuucccuuuuugucauuaacuaucuuuuccuucuucugugucagaaauagagauguugguugaugacccccgggaucuggagcagaugaaugaagagucucuggaagucagcccagacaugugcaucuacaucacagaggacaugcucaugucgcggaagcugaauggacacucuggugagcucuuacgggaaguuauucuuccuugguagcagguuauccaggacugaaaaacacaugccucagaaaauagaaggggugagcugggggcccuagaccagagacuggacugcacuaagagucucuucaggucaguguuguaaacugcaggauccugugccuucuguggaaggcagggaagaggagaaacacccaggacugggaauuagcauuuugugcuccaugcuuuggacaaaagguaguugaacaguaggguucucuuuauguuaugcugugucgagaaucauauaauguaucuggaaggccuuguagaccccuucagucuggccuccuuuuuacagauaaguuaaccuauaguucaaagaggacaaauccaacauggcuagaaacagaaguaggccuccagguuuuugggguuuuuuuguuuuuuguuuuucccacuguguuauacugguagaggagucugggaggaaaagugucaaaauggguugaccuaaaaagacacucuuaaauuccauauucguaugaauuccuguagaaaacaugcauucccuauaguuauauaauacaucauauauauuucuguuacauguaagauacuaucuuuaaaaaacggcagcaguaucaguuuuguuuauagacaucagucagaucuaacugcuuuugucacacaucaugaaucagucuguucuuuagagaaauaugccucaggaaccagcacuauugaaauggccccuuccagcuuugauugaaugaagggccugacugagguagccugucccugcucuggcaaauccacagcuccugauguucaucgagccuccuccuccaggugccaggcacuggaaaucagagaggaaccagaccgauacacagucacuaccauccuggcacuuagucuucaagagcaggaggcaucuuuuauuucagaauucuguucgcuaacccaacagaacccuggcuucccagaccugccuguagcugcagggaaucaucucucugaccaacacugacucauuaggcugcuuacccuaaacaugcuuagaguucauauaccaaacuuugccccuuuuugcccauguacuuuaugauauugaauuuucuccuauaauuacauuuuaauuuaaauucacaauuauaugcacauuauagguccauguauauagcucuguguguuuaugcuuguggaaaggaaauggucuaaaaacuguguaugccgcagugccuuugggaagggagguaugagggaagcugaccuggacuuugcguuuauauauuucugcauuuaauuuuuauaagacuguuaauuuuaaauagaaauaaaauuuaaguaaaaagccuggcuguuuaagaagauuuauauauaaaaaaaguuuguugaaauguuauaaaaauaauuaaagaaugagugguaaggccaggugugguggcucacacguauaaucccagcacuuugggaggccaagguggguggaucaccugaggucaggaguuggagaucagccuggccaacguggugaaaccccaucucuacuaaaaugcaaaaaaaaaaaauuagcugcaggccuguaaucccagcuacauggguggcuggggcaggagaaucgcuugaacccaggaggcagagguugcagugacccaagauugugucacuguacuccauccugggcaaaagagugagacucugucaaaaaaaaaaaaaagaaaaagaacaagugguuaaauuauaccuuauucauacaaugguauauaaccauuaaauucgagauuuucaaacaauauuuaauaacauaagaaggauaguuaagguaaauaguaaaaauuauauaaaaugucaucuaauuaaaaacaagaauauuuauuuguguauuuuaaaaacguaaaacuauuaauagccuuuuauuuggauguuaggguuauagauauagaugauuuuauuuucuuucuuacaucaucuuaguuuucuaaauucucuauuaauuugagcauuuaaacguugcuuauaaaacauucagcuaaguacucgccuuggcagcacauacacuaaaguugcagugauacagagaagauuagcauggccccugggcaaggaugacaugcaaauuugugaaguguuccauaucuuuaaaaaaaaaaaaaacacucagcuaagauugaguagugaugaaguauaccacacugucuuucauucuuacagaguuugauaggaguugguuaaguguuuugagcaucagcucgguguugacuuuuccaguggugggucugaguuuggagaauacucuuuacaggcaugauagcugagggcacauuuaccaggaaaucgaaaaggaaccaugacaacuuguuuaaagguuuaaugcucuuuagaagauaaagaucguucuagauccucuacuaaagccauuuguacuaacuccuaaaacaugaguauccccugaguuuuuaaagugucuacuuguaaaccaguaaugucuucauauuucauguuucaauugaacuaauuauugaauacuuaauauguuuauggcauaugcuagacacugagucauuaugagauguuucuaaagaguuaagggauagaacacaagucauucuguagacuacuagcaguaguugaauaagaaucacauuacuuaaaggguuuuuuguuuuuuuuuuuuaagaagccauuuggccuuauggaucuagggcuugaccuguaguacacuugcuucauccauuggcaagaaaaauuucagcgguguucacuuacaccucuaguucuuauugguaauuuuaccuucugagacauguuucuacucagugcuucacucauaugccagucacauagggaaaugucagcccuggauuucugcuucugaaauuuuggcggguuuccaccgagugcuaaagugcuuagguuaggugcucuguuguucucaaagacccaguacugaauuuucacuguggccucccaguuugucuccucccagggggaucugcugcaggagguaugugccaagugucccaucacccaaaaagagcugcugugaacugaguguauccauguauagucccuguaccucacccuuuuaugcauucacuguguaauuauuaaaacuagcaggcaggugcuguuauuggcccgauuuuauacgagaaggagacugagacacugggaggcuaaguaacuggccaggacacauggcuaauuaguuaucugggccaggauccagccagaucuaucugacuucagaggccagagcccccacaauucaccacuauacauccaagccgaaccaaaucuagaaggcauguguucaguaaggguuaaguuuaauguugcugcugaauagaaaggggaagaggggaagcuuuaugagaugcaguaaagaggcugcuuuauaccuauagucuuugcuucuuuucuauaacuucaucauaaauagcuuaauuagaaguuuguuuuagaaaauucagacuaaacaucuucuuacacucuaacccuacuuugacucauuaaccucuauuuacuguaagaugagagagagugugugugcuguucugguugucugccaccaaagagucacagugaaacuuuuugguaaugguuaauauuugauuuuucauuccugauagcaauaugucagaauauauggcaagaggugugaauaauuugaaguauuuauuguuuuuaucucuguguuuuauuucaggguugauugugaaagaaauugggucuuccaccucgagcucuucagaaacaguuguuaagcuucguggccagaguacugauucucuuccacagguauuaaaggaauugaaaaauaucaguuaggaaacugaaguuauagaaaauuuuaaguaguaacuuacauuuauacaaaugagcaaaaauuaaaaacccuaaggaaaugauccuuccuagauacguacauucuagcuuuauucugaauuuauuuccaucuuauuugcuaguucugcuuaucuuugaguugauuuuuacuuagauaaguuauagauuuugcuucacauuuuauaugguugggaagccucuguucuucaggcuucaggcgaaccacgugugcacaugcaugugucuguguguguugcuuguccucaaccugggagaauaauauuuuuugucaguguguucuggcagaaauguuuccacacucugguuauuccauucagauugaauuuucaaaguaugcugagccuagagcauuugacaaccugugaucauugguuaaacuauuaaauguccagcaauauagauaaaauacucugaaacucaugguuucagcauuuggauguaauguaugacuaauggcccuaauuccugagcacuuccucccuccuccugccuuucuuucuugggcucucuuugugucuuguuuuuuucccuucuguguguguuucucuuuuuucauuugcauucuggcucuccuugucccuacuuuucucuuccucuuuccucccuuuuuucucauuugucuuuucuuucucuuacuugcguugaaguaaccauaaugugaaaaugauguuuaugaaauauuuuccugaaaacugcaaugaguaaucuacucuuaagagauguuucuggggcacagcugauagucagauuccacaccuacacuauggggagaacuuugugugccuuccuugagaguuuguggggaugaccaaaugauucuaugugugaaauccuguuggagucugggaagacagcaucagcacaagggaucacucggaugugacacuuccuaguaaaacaugcuucuggaacuuuugccucuagcaaaaauuguaucuuauucuaacaggguuguccuuuguggugggaagcagcaaaauuuaaagauauaauaccugguuuccuuaaauaacccauugcauaucuuccauucauauaauuaucagaaucauuuuuaaccuauuucuaauaccaccucuugggauaauaaaaaaaagucugcccccugcuguguacagcauuuggcggaacccccccacccccgacucguguucgggaacuuaguccuggugccugccucccagccucuucaacaccaagaacacccuauauccuacccagcaccaagaacacuuuauauucaacccaagaauucuggccuuuuaaagagaaaaacuguguuucuugguaauaauugguuuauuuuccuauuucuuaauaaaauaauaacagaccuuggccuaaaaggucugaauugccauauccuacugaaaaaaaaaaaggaagccaugucuuuaccuauaugaccuuauuucaagauaauuacuugauuucugaaaugcuagggauaguuggauuccuguuguauuugcaccucugugcuuuggauuauuuguaaaaugaggagaaugauagugccugcuuccuaggacuguuaggaagauuaaaugaguuaaugcaugccgaguauuuaggucagggccuggcacauaguaauugcucgguaaauguuagcugcuauuauuacugauggaggugguguugaugauauauuuccccauacagcccagaaaccacagauuggaaaccacuuucuaacauguaaggauuacuuaaccuuuugugguucuguagcaucucucuuuacaaggcaaauauucuaaccuuucacuuuaaaguuguuucauccuucccuuaucuugcagacuauaugucggaaaccaaagaccuccacugaucgacacagcuugagccucgaugacaucagacuuuaccagaaagacuuccugcgcauugcaggucugugucaggacacugcucagaguuacaccuuuggauguggccaugaacuggaugaggaaggccucuauugcaacaguugcuuggcccagcagugcaucaacauccaagaugcuuuuccagucaaaagaaccagcaaauacuuuucucuggaucucacucaugaugaaguuccagaguuuguuguguaaaguccgucugugugcagcuguacaggcagcuuacuguuugcuagaggaugcgaaagucauaaguucuuuacauauuacuugugccauaucuucuucacccuaaacauagcucuuucuuuauaauauuugugaugauggaaacaaaagccuuggaacaauugcacuuuaaguauuacacagaaguaaaagaacuacagaaaauguacagcaagacaagugcccggaaguucacugauccuucagaaggaaaugcgcuuuacugauugcaaagccuucagaauauuggagugugguguguuugcucaucugaugcuuuuuaguucaguuacauguaacaucacauuuuuuuaucacgugaaagauguuagauuuguuugcuuauaaauuuuuuaccacucccacauaaaaugcucauaguuugggagaggaaagagggaagauucucucuucuuuuaacagagagaugauugcucuguauacccauugcuuccucccugaggcugucccaaagugaacacugauggaguggucaaaaucauaagguuguagcaagccaaagauacguaugugacagaagcacauaagcaauaagcagaaaaccagaagugcaugcugugaugccugugacuccuucaucccgcucagugccauguccucuuuugugaucuuccagaaagcuccaggauucauuugaguuccacauccaaguaacagaugaauuauauucauguuguaaugcauuuuguggaguuuacaaaaccagugucuguuaaaacuuuggaaaaugucuuagaaaacguuggugcuuggugaugcuuuauuuguuuaauuaucaagaacaaauuauggcaaugcuaguuucugcuuaaccaaaauacucuguguauauauuauacauauauaaauacaugggauuguguaugucuauauguguuuaaagcuuacuaugucuucauuuuggcuuccaugacuaucuuuuauacauggaauuccuuaagauugagaauaugucacugagugaaugauaccugcagacagucaguugauauauguagaguucagaaugacuguuuucucaugugccuuuggccaugauucucaacacugauuguauaacagaauuuuggggggagcuuuuaaaaaauaaugacugagucucccaccagaccgauuacaucauucucuuguggcgggacccaaguagaauugccuuuucuuuuaaaguucuccagauggagcuaauaugcaacaaaguugaaaaccacugauccugggggugucuuguuaauuuugaaguaaaaguguacagaagacguaguguaugagaaagggccauuuuuaagacaguuaccuguugugcugcuguuacaauauauaaugaaaccaagucaggggagugaauuuaucaaucuuuugauguaaaguaaaaacguaguucacacuucaggagagaacuucauagcacaaugucuuucuauaagauauuuuuaaugauuuaguauuuuacaacauuuguuuaccauauuuugauauaccauuuuuuucuaucugcccaguuuuauuaaaaaaacuauauauuauuuucuaaagaaacaaucauauuuuuauacaaaauuauguuuucagguaacgaaauagauguaggguacaguggaacauaagcaguguuaccccuggcugggagucaguauuauacaacaaauggugagcuggaacaugcccugucugugcugucccuccugugcugggucgcggauguguaggcaacauugccuuaucacgcuagguucaccugacacuuuaaaaggaaaaaaaguuccauagaguucuguggucacaaaauuguuuugcuuuuaucaaauacuuuaauagaaccaaaguugcagauauuggaauguauggaaguaucucagucucugcauaagaggauuaaaguaugaaaggaucauuuaaugacuguuuuacuuauaagucauuaaguaauccaccauuucuuauggaugaugcuuaagccuggugagguuuguacucuaaggagcccagaucauaaugcagugcauuuccuuagcccuuagaguuucuugcaaacauuuaaaaaaagacauauuuaagaaagaaagauaaagaaaaaacauauuuaauuacuguaaacagguacugcuuuauguuuauuuucucucuacuucaaccaaaaucagaucuuugagguuuugcugacauuguuggugguuuugcacauguucuuucuaauuggauuuaugaauaguucuauggguuuucaaagaugaaucaugcuaagaacacuucugcuuuuugauccacuguuugcagcagaauuauauauauguauaggaaaaauccacuuugaauaauccauguuuuguauuuggaaauuguuuuuaaaaauaaaaaggaaaggaaauauauaaagcuguuauuuauucugcauuucuuacauaucuaucgcuugucaguauacccguuuugguauauauugccucugcacaucuacauuuguauaugcaacagugagcuuuauaucuacauaaacuguaaauaauccuuucugugaaaggaucaucauaucaagaugauaccaaaaguauguaaaaagaaaccugcauuauuuuguaauuauuucuuauagauauuucaugguaagauuagcagucaauaaaguuacuuuuuugccuuuaaa

SEQ ID NO: 16359 - RNA, 8943 nt, Homo sapiens
guucagcugucaagcaguaccuuucuuaaaauaccagacugaaaauaguucaauuuucuguaaaaagucagagccgggcacgguggcucaugccuauaaucccagcaguuugggaggcugaggcgggcggaucaccugagguuggaaguucgagaccagccugaccaacacagggaaaccccgucucuacuaaaaauacaaaauuagcugggcgugguggcacaugccugaaaucccagcuacuugggaggcugaggcagaacaaucgcuugaaccugggaggcagagguugccgugaggcgagaucgcgacacuacacucgucugggcaacaagagugaaacuccgucucaaaaaaaaaaaaagucagaucuguguaaagagaauuaguguaccugaaaauuguuuucagcugucaaucacuuugguccuuuacugucauucuaagaaucagccuaauuugguuuaccuugucuuacaaauaaggauuagcaaacucaccaacauaaaaaagguguaguacaugcugcaaaaauguaaguauacacugacauuuacuugccaaaauaaccacaaaugacuacacauauuuaacuauaauuaaaucaaguuuuuagaaauuuaaagucugcuucccuagaaauacaggaacuuugugugauaaaacuugagacauaugacaauuucugaauagcaacuggaauauucaaccaacaauggucauggucaguuuuguauuuuuuccuuaacuuauauacuucauucuuuccaacuauuuuaaagcuaaaucuuuuuuaaaaaaguuuuaaaaauaagucacaggcaaaucaugaagaguuggguuuauuucaacaguaaaucugaaacucuugccuuaagcaagaguacuacaguaauuauaucaggaauagacaauuuccuacacugucaaauauauaaaaguuccuuuugcacuuucuucaacacugaucaacaagcagauucaguccacauuugcuuugaucuaacuacugaguuaacccaagcuucuucuucagagacucuggcaucucggguggaggagggcgaggaagucugaaguagaccuucacggagucauagauaaaccacuguagugcagucaggguaccaaucaugaugauacgggcaaacagucccuuccauacaccugguucaaacaggaaaagcaaaugaaaaaaaugcaacauauccaaaacuguuguucuuucuuucaagaaaaaaacaucauccuaccuuuaaauccaagucucuugaggaccagagaagcacugcuaccuuuuucuuuauucaacacagauaccacagaaucagcagggugagaaacaauugcacaaaagacuccagcugaaaaaagauaaaggaucccauacagugccaguuaaaaacaaaacuucacagagccaauaaucauuuuuaugauuuuaaaauaauauuuuucuaguucuaaaauaaaaaucagacucagggugacacggguacaguuaucaagcugucuauccuauguaaaacggaacaaucuuuuaaaguuuuucagauuuuauucaacacuuucuguauaaaauucuuaauaaacaacaacaaaaaaauggugcaacaguaagaucaauacauucccaagccuaauaaugacaucccaugaaacagcccuuuuaggaacuaguuagcaaguauuuaugaauccuaaaaagcauauaaaauguuaugggaagauaaaacugcuuuauaggccaggcacaucaccugaggucaggaguuugagaccagacucaucaacauggugaaaccccaucuuuacaaaaaucaggccaggcgcgguggcucacgccuguaaucccagcacuuugggaggccaaggcaggcagaucaccuggggccaggaguuugagaccagccuggccaacauagugaaaccgucucuacuaaaaauacuaaaaauuagccgggcguaguggcagacgccugcaaucccagcuacucaggaggcugagacaggagaaucgcuugaacccaggaggcggaggcugcagugagccaagauugcaccacugcacuccagccugggcaacaaggguaaaacuccaucucaaaaaaaaacaaaaaacaaaaacaaaaaucagccgggcauggcggugcaugcccgucccagcuacuugggaggcugcggcagaagaaucacuugaacccaggaggaggagguugcagugagcuauuaucaugccacugcacuccagccugggcaacagagcgagacuaugccucagggaaaccaaaaaaacaaaaacacugcuuuauaaccuuuggaguauuuuucccucucaaaaaacgccaauaauggaaaugauuauuuguucauaauuucagacaaguguguucuaaguaauucguaccuauguaaccugcuacaaauguuacaaccagcugcucuggcuuugaacauucacugcggggcuuaggaaccacaaacuuguacagugcuucaacaguacguucaaagcaggcgaacuucaucaugguguaugguaucugucucauccagagaggagcaacccccuuguagaaucuaggaaaucaagagacuuguuuuacacaguugcauacacucaucuaucagagacugucauuauuaacagaaauguccgcacacgagucgaguccugauaguaacaaauggcagcauaaaugcaugucauuucuaucagaacguuagacuaacaugcagguauauuucucuuacaugccaaugacucaagcaccuuugacuauacaaccaaaaaaguugcuggauguuucuuugacuacuggaaccacaagaaacaagaaguuuacaaguggaacucaguucaagauucauccacaaagguggaucuaaggaagcauguuguggucauggaaauucuuaacugugaauagaucacaaggauacuaacaagcccucccuaaaaguuaauaguaaauguuuaggccaaacaucaagucauuuguagaccgacaaaugguccuuacucuagggaaaaaaaaaaaacucaguccagggcucaaaccauguauuaacuuaucuuuaccucucaaguuuauguucuacauacagguaaauagacauuaaauguuauaauagucuuuuuaaaaagucugguaggcuuaauacuaaaaaaugaaguucacagccagacgcggugucucacgccuguaaucccagcacuuugggaggccgaggcggguggaucaccugaggucaggaguucgagaccagccugaccaacauggagucucuacuaaaaauacaaaauuagccaggcgugguggugcaugccuguaaucccagcuauucagcaggcugaggcaggacaaucacuugaaccugggaggcggagguugcagugagcugagauagugccauugcacuccagccuggacaacaagagcaaaacuccgucucaaagaaaaaaaaaaaagaagccgggugcgguggcucacaccuguaaucccagcauuuugggaggccaaggugggcggaucaugaggucaggagauggagacggugaaacuccgucuauacugaaaaauacaaaaaauuagcugggcgcaguggcaggcgccuguagucccagcuacuugggaggcugaggcaggagaauggcgugaacccgggaggcggagcuugcagugagccgagaucacgccacugcacuccagccugggugacagagcgagacuuugucucaaaaaaacaaaacaaaaaaaaaaacaaaaaaaaaugaaguucacuuaaaauaaguacuuucauaguauaaauuuuuaaguguuuacuuacgcuuuuaggccuucuuccuuauacauuuugggagcugcaucccucaaaguguuggcauaaccuggcuggguuugaauucgaaccuuagcagcuuccauaggagccagggcaaugucagcaaagaauucagcacuggcagaggcagccaaauauagugaugugcgccagagauaaguauucuccuaaaauccaaaacacaaggaagggaugugaauugcuguuguguugguuuucaauugaagugacaguucuagaaaacaacuaagcuucagacauuuuauaaaguaacacacgaugauauggaauauauauguggucucauaaccucauuaacaaaacacguaacuaugugaacaacaugaauauucaaaaaauaucuagaugccaugccccggaacuacgcaaaggagucccagagcccuucucuaaaaaacucaaaauccaacuuacuuagaaaacaagauaguauauuaaaaggagaauuguaauuuaaugaaauacauuuaucaaccugucucugcugacacaggcauacgauuuaaaacaaguugcucacuuuguaggaccauuuucuucagugcuaaaauaaggcaagacagacaaaaaucuaagaacacucggaaagucuuaaacacucggaacauucaauuuuaaaguuaauuacauaccucuccaagcauauugcuauacaagacuuuaaagacuucauaaaagccaaacuugcagagucccugcauggaguagccaaggaaagucggagcccauccuuuagccaaaccacgaacaccauccucuuuaaguguaacugagaauccguuaaauaugcccuuguacuuuuggggguccaccuuuauuuaaaacaagaaaaaaaaaauuaaaugcaccaaacagcuaacauaaaaauuuaaucucaugauuauuuuuguuuggguuccauaauaaauuucagcaacuacacaaaagguaacuacaguaauuccugccaggcacgguggcucacaucuguaaucccagcacuuugggaggcugaggcagguggauuaccugagcucaggaguucaagaccagccugggcaacacagugaaaccccaucucuacuaaaauacaaaaaauuggacgggcaugguggcgugcaccuguaaucccagcuacucgggagggugagggugagacagaacaaucgcuugagccugagggagggagguggagguugcagugagccacgauggcaccacuacacuccagccugggcagcagagcaagacuccaucucaaaaaaaaaaaaagaaauacaguagcucucccuuauccaagaguucauuuucuguggcuucaguuauccaaggucaacugacaucugaaaauauuaagauauuuugagugaggaacuacauucauauaacuuuuauuaguuuaugcuuaucacuguuuauuauuguucauuugauuacuuuuauaaauagaaacuguuguacauuaaggucuagcuuucugugucaaaccuaagucuuggagugauaguuaagaggguaaaauuucaacaaaagcuuucugugucaaacuuaagucuuggagugauaguuaagaggguaaaauuucaacaaaaauacguaacaaaacugauucuuaacagauuucuuaccacccaacuccuacuacuuuuuuuguguuuuuuguuuguuuguuuuuugagucuugcucuguagcccaggauggagugccauggugugaucucagcucacugcaaccuccaccucccagguucaagcgauucuccugccucagccucccgaguagcugcgacuacaggcacgccaccaugcccagcuaauuuuuguauuuuuagcagagaugagguuucaccauguuggcuagauugaguucugaucucgaacuccugaccucaagugacccaccugcuucggcuacccaaaaugcuggcauuccaggugugggcgaccaugcuuggcccaccuccuacuuuuuaaaagcuacugucuagauaauagauauaacuguauuccuaacauaugcuaguucuuuaaguagcuuauagcauaaaguuuugugaacacuaaacaaacuaaacacaaguuaaaaaaaaaaagcacauaaacuaaauucacuucaagagacaugcauaacacguuuuagcaaagguacauuucauauccauuacauuaacuaauggggggggaggaaaagcuuaucuauuucugccaguacuagaagggaugguauacaucaccuuccucucccuccuaauauuucaaauucauuucucuuuuagguaaguagacuucuaauccaguuuggaacaaauaaauuuucgaugucuuguuuuuguuucaaugaucuuaauuaaaauauauucaaauuauuuuaaaauguuguguaaauaaacaagaggcuaaucugacaaaauuuucauacuaagauauuaagagcacuuuaaauaaaucuacauguacucuuugccuuggucuuauuaguagauaaaggacauuguuacuucacauaauacacagacuuguuuacccacuccaacacauaggugcuuguuaaaugacuauuuggggcacuaguaagcuugaagaacuccggccagaagugaagagcagcagcaaagagccauuuacagccagacucuaaaagugaacaauuuacucaaacaauagaggcauuuauuggauuuaaaacacuagucaaaauaaagcccacaauuuaaagaaauucuaugugguuuccuacugaaguuucuagcaguugugaugucuucaaauucucauuuaagauuuuauuuagaguuaagucacaugagagauacuuucaauguugucaucucaauacaaaccugcauacggcauuucacuaaauccaggggaaccacagcagugugugucagaccacaacuuaagaccccaccaaagccacacagugcauaauacuucgcggagccaaauucacaacuguacucuguaguaagagaagacacaccaugcauuuuaauauaaaacucauguuacuggucauaaacuuaccuccuggacaguuagguuuccacacagcuuguuagaugacuauaucuuauaacuuaacagucagucaugcuucaauaugcucuaguccagcaugcaaaacaaaccugcauucugcauuuaaccagaucuagaggaaccaaugcuguauguguugugccacagcuaauaauuccuccaaguccacaaaggauaaagaaucugccagauccauagucacagcuauacugcucuguuugauuggaaaaaaaaaaaucaaguaaguauuucuucagagaugacuaaggccacuggaaugaaagaaaauguuucccugugagauacuauuaucacagcugaauagcuuuggccacaauuaaguggcuuaaaaaaaaauucacugccaaauucagaucauuuaaaaauuaugaggguucuguaucugauacuauuaauagcucguauucugccauauuaauuuuuuuaaaaguuuucuacauuaacggcuuuuacaauuaaagucaaacuucaaauuauuaaccacugguaagagcacacuucagaguacaaacgaaacucagaaagaucacucgacauguaaaaggcuugcaaacaacuucaaaguuuaucccagccacuaaccaauacuauccccacuuaagaacuccuguaacauaaaaacggauacgcacaaauuccugcagucaaauacauuuaauacacaaauaauguuagcuuuaacuuuuaaacugaacgacagauaguguaaauaaggacucuauccauacuaaagacaacagaagcacaugaaugauuuaaagaaaaaaaucuuucgauuuuacaggcacaagguagauaacauucuuaggacuccuacaauucgguuuucagguuucucuguauguacauacuucacuaggauuuaaaacacacacaacuaaguuaaagcugggcccaaccaccaagaaucccaagagauaaucacaccaaagggacgcccaccaauuaucuccuuucuauugccuauguagggcugcaagcugccuccuccagucgcacgaaaacaggacaucuaguuaucucauauacaauuaagugcaaaaaugacugaccuggcgucgacaaauauaaaacuuaggaaaggacuauuuuuaagaaaacuaagggcaaaucaaaggacagguaauauaguuaguagaacuguggguggucaguaguuucgggaggagaguuuacccaguacuuaguuugcugaccaagcgagcucacggcggagaaagagcuagucacggccucucuucccucgggcacacggaggucacgaagggacacagggccucagcgcuuccacgcccuugagggaaggccaaggaucugacacccgccuaugguggaaaaggccgauaccccagggcaagcaacugggcgccguccuacggugcagcgggcuggacucguccuucccuguccuccaagccggguccaggccucaaaggcugggcggcccacaaguagaccacacgacuguauugggcagggucugaucucaccuuccacggcggcggcugccagguugcgagggcggcggggcuggcccgugggcccuggggagcugcugcggagguccccgagaccaucgugcaccagcugcagauguggcguguugaagggguucgcccgcgccaggugcgccacggacgagaacaucuuucuaggggaggagggagcgacgguuagaggacaggcaaggcgccgguuaacguuaccggcgcccuggaaccccaaccggggccuuuuccuucccgucuccacgcccuugaagaggucacggcggccuucgaaagaggcugcucccggcugggcccaccgccaaagcagcggccccacaggagcucugggcuccgcuccccacacccgccacaggagaaggcccggccacacucacucccuaagauggcgaucacacaaccacucccuuggaaagguugcggcucacagaggccggacguccuccggguccuaagaugugugcccuucgcgcgucgucggcgugacgcacacagcgcgccacugcaaguacgcgucgcccauugg

SEQ ID NO: 16360 - RNA, 813 nt, Homo sapiens
uucuguaagaauucuaaguauuuaaauguguagcuucacauuauacuaccauguuucacccuucguuucccaaauacacaaaaaacauauacauuuuuucaaaaaugaaauaagaugcccacauuaaaaaaauaaagccuacaaaaaguuccagagcuaaaaaagauuauucauauggcacaaagugaucuccuacuaguccaaaguucaaaaacauuuuaaugaaguccauuuauauauauuuuguuugcuuuucaaugaaauacuacauuuauugaggcgaaaucacauuauuuuuaguucuuggagucaacaaguguacacaaauguuuuucaacaguuauugaaaauaggagaccaaguugaacgugccaaagagauaccauucaguuggauuuucuagggucaacaugaagaaaauuagagaagggauuuacuugguugguuuccauagcuugauagaccaaaaacaaaaaaacugccacaacaacaaacagcaaaauuuuuauccauacgggaauggagcgucccuuuuuugucuuuucugacuugacaucugccaagggaacauacuuaggaacauauuuagaugaaaaagacuccuccauccugaaaucacugaguucuaauggccggccugcagccccuuugauuggucugcggcaacuagcacuguugggagugaaaggaggaaaagaaaaauaauuuuagauaaaggcaugauuuagagaaauaacauaaaaugucauugccacuccuaauuccaagcacauucccugagguaacaguagaaaauugauacauauaaagcag

SEQ ID NO: 16361 - RNA, 813 nt, Homo sapiens
cugcuuuauauguaucaauuuucuacuguuaccucagggaaugugcuuggaauuaggaguggcaaugacauuuuauguuauuucucuaaaucaugccuuuaucuaaaauuauuuuucuuuuccuccuuucacucccaacagugcuaguugccgcagaccaaucaaaggggcugcaggccggccauuagaacucagugauuucaggauggaggagucuuuuucaucuaaauauguuccuaaguauguucccuuggcagaugucaagucagaaaagacaaaaaagggacgcuccauucccguauggauaaaaauuuugcuguuuguuguuguggcaguuuuuuuguuuuuggucuaucaagcuauggaaaccaaccaaguaaaucccuucucuaauuuucuucauguugacccuagaaaauccaacugaaugguaucucuuuggcacguucaacuuggucuccuauuuucaauaacuguugaaaaacauuuguguacacuuguugacuccaagaacuaaaaauaaugugauuucgccucaauaaauguaguauuucauugaaaagcaaacaaaauauauauaaauggacuucauuaaaauguuuuugaacuuuggacuaguaggagaucacuuugugccauaugaauaaucuuuuuuagcucuggaacuuuuuguaggcuuuauuuuuuuaaugugggcaucuuauuucauuuuugaaaaaauguauauguuuuuuguguauuugggaaacgaagggugaaacaugguaguauaaugugaagcuacacauuuaaauacuuagaauucuuacagaa

SEQ ID NO: 16362 - RNA, 2124 nt, Homo sapiens
cauguccacuauccagaaccuccaaucuuucgguaagaucccgucgccgccgccucccucccuugcccggcgcgcaucucggccuuuugcccgccuggccaccgccccuaggggcccccuuucugcccuucccgcaccccuaguggggcuuugucucggcgcccagaaaauggcgacggggccccuggcgaccccuuccccgaggacagcgccggacuccgagcccuccucucggagccccggccgcgggcccugcgccacccccugccccguccuugacccggcucucgccuccgcuucugccccuugaaaccuuggcgauccuauuucguggacuccuagaucggcccugcuacuugcaaaggguaugccgggccagggaaaccagggaucggcgcccguucucuggcagcuccugggggcacuuagggaaagaugcggaugcaagccucugaucugucacuggccagugguucagucuucucugcuugcguagcaauuuguuaaauuacgccucuugauauauauguaaucuacuuuuuuuuuggcaaggcacaguuacgguuaaaugauuaaggugggcguauucgaauguuuauguuuucaucagaauguaaucgagaugacgcacauuuuuauagcggcuacaauauuaagguuuucuaaaucuuuuucucauuagaggaccauauugaacgauaacauuauuuaucuauaacagcguuuuucuacaauggacauagcuguucaaauguuucucuuuuugugagaguaucuuggggguuuuauuaauacuccacccccaucuccauuccuaccggcaaaaacagcaaaggcacuagaaccuucauugaugacugucuggauugguaguauaauguauuucuggaaaguacuucuuaaaaaauauuuuucuacuuuggauuuuuuuuuuuuuuuuauccauucgcagaccccuuugcugaugcaacuaagggugacgacuuacucccggcagggacugaggauuacauucauauaagaauccagcaacggaacggcagaaagacacugacuacuguucagggcauugcagaugauuaugacaaaaagaaacuugugaaagcuuucaaaaagguaaagggauuaggaagaaaggauuagaguuacugaugcacaccucugaacuggauuaugauucacaccuuuauaucggcguggaugaaaauaacuagaccaagaaaguuguucucauuuuuguaauuaacauguaaauauuuaguuauucucccaguguggucucucauuuuaaaagaagauucgcguugcuuuuaaauaaauuuaaaugugaaauauuuaguucuugauguuacacauaaaaucauuuccugguuuacaaauuaauuuggaaggauuguggauuauaggagacaaaaucuguuucucuaaauaugaucuagcuuacugaaauggcuaauucuguucauacggugaaauaaaaccucauaguaguugacuaaauuuuguuguauauuuaugcacuuuuccagaaauuugccuguaaugguacugugauugaacauccugaauacggagagguuauucagcuucaaggugaccaaagaaaaaacaucugccaguuucucuuggaggugagugauugggugcuuuauguguaaccuugagauugcuuuuaaaauuguauuuaaaggcaacaugauuuguuuucuacuaaguaaaaaaucauacgaaugaaggaaauuaggugaaauaaagacaugguaguuauuuggaaagcaaagaccuuuaucugguuuauuuugucauuagaguauucugaucauuucuuuauauacacacacaggcuauuucuuggcauguaaaguauucaaauacguguugaauuguuggcuaucagcagugcaugccacagacaacaguguugcaguaagcuguugauagugauucuuuuuaauuacucuuccauguuuucuuaaugaauuuuuauauuucucagaguuauuuugcuaaauuagauuuuauuuuacagguuggcauuguaaaggaggaacagcuuaagguucauggauucuaaaaugaaccuaaauacguggagaauuucuugaauaguuuuguucucuaaac

SEQ ID NO: 16363 - RNA, 155340 nt, Homo sapiens
gcgcugcccccggcgagccgcucaggcgggggugggguaagcucccgcggccggucgcuuuucuccgccgccgcugguuggaucguuucaauaaaaguguuuuuucucuugcacucgcucuccuccggggaacaggcggaggcgucaauccgcagccgccgagugugaaagcgacgcacacgcaaggagcgaacgcggccgcccgcagucuccugagcuccccgcgggccgccgcagagccgcggagaaggagccagcgcccggccagacagucucagcccgccgucggcgcccgccgcgcucgcgcccggcugcuccgaggggauuagugggccguccgcgcggcucgucggcgcgggagccauguugaccgagggacuuggcaacgcgugagacacccgcggccccucccgaggcuccggacccgcggcgagagccggaaggcggcuguggcggcggaggccugcgcucggaagcgccucacgucugccggccgcugagacccggacuugcauccggucgccgcgggcguccgcggagcagcuuccccccgcgccucucuucgccucgccucgggacccgcgguccccgcucuugcuggugaguuggcggcuggcguccgcgccgcgcuuuccccuggugucgggucggccgcggggccgggaggcugcgugggacagaggcgggggcgggggcuacugggggcgcggguggcucaggcccggucgggaaguugagcgaggaggcgcggcgcggggggcuagcgugcgccugucaccucuccgguccagcgaggaccuugggucgcccggggauuuccggggcucggguggggugugagugucugcgagcugcuucccaggaggcgccgacagauauagacgccgccgccuccggugcucgcugccgcuuuggucugcgggggaggccggucuccucgcgaggcggaggaggggaaagaggcagaaagucccccgagacacaaagguccccucggcggggguggagcuggaggcgcaggcgacgcugcccgggaggggaaggaaggggcgcggguccgcgggaggugggcgaggaggcggcggucgcggcgccugcagcuccuuggagacgcuggcgcugugcgcggguggggagcgcggaggaggaggaggagcccgcgcgugggagcggguagagacaaagaucagggcagccuccugcuggcgggucacaccccggaguguuggucaagagcggagguagagggaaggugggaaacccagcaaaccgauggggaggggaaaauggggggaggagggugccuagugcugucuccgucgcaguugcuuuucucagcauuuuugugcccgaugcuaugcccgaugcuuuugcuccccaacucagcuggauagcuccagauucccucccuccugucacccccacacugccacauugacucuccugugguuuuucccucguucucccccuacuuuucacccacuccuuuucggguaagcaguauuuugcuuucagcuuggggaacauuuguuaaugacaggaugucugagcuuguucugacccugaacugccuugaacuucucucucuuccucccacccuuuccuuuucugggaucuauaaugucacauggccguuaacaauuagcuuuucuuuugcaaaaguggcaaaaagcguuuagcugaaaucuguggcucucgccuccuuuacaugaauauguccaccaaagacaccucguuggucauguucuaucaccucuucgucaaauugacaucagguccuaacaggucacuuucaagauacagaagaggcaaauuuuguuuugagacuuggccauuccuagggucagcaaaguguauuccuggcagccagaccuucagucacuuaucaggaaaugcuugaccuaaagacagacaauucuuuccccaaacuuugcuguuucuuuuuugagucuuuguugaaagauuucuuuuaaaaggcguucgugugagaagaucacagcaacaaaucuggcuuguucuguuuuagacuuacuuucuuaacucuugggcagaagaaaaugaaugagauuugaagaccuuugauaccuuggguagacaaagcuugccuugaaacuagaaauaagacgaaacuagauuuuaaggggaaaaaauuugcuagugguaauauaauugguuuuguuucauuuuuuuaugagucugaggaguugacauuaaacguugggauguugcuuuguuaaugaagucauuucaauuuuugcaacucuuaacaucugcaugcuuccauaaacaguggguuggaacaaaagaaaaugugacuaagggauauuccuuaaauucuuuuuuauguuaugagagagaauauuggaauauaaagaauguuacuuuaucugguaaaccaucucauaggccagaagcacuaacaguuugaaugguuggcuuaaaaaaaaacgggagucuuugaauuuaagcuuauguaaaauuacuaugcaaauauagguuauuauuuauuuuuacagugaaaauaaaacacuauugaaguauaaauggaaagaaaauaaaagcaaagccuguuuaauauagagacauuaauguugauaucacuguacgaacagucauagcuugcugcucacugccguuaaaggguugacauacaaacauuguggaagagauuucaguuugagggcuagugucugaauuauggacuccuuacccuacuccaccacuuaaaacauuuuagagacuuuugugaaauuaacaggucauauaauuaauaauuguuguuuuauguacauuuauugaaaggccauauugaggcuccauugauuuuuuuuccugcauauuuaucaguaucgaauuagaaaauugaaccuucaguguuacuagauggaaaucuaccaaaaaguagcaagguuuacgaauggugggauuuauuggugauuaaacauuuuuuuccuguauuuuauaaguuucacauuacauuuacaaugagaaaaaaauguaaauguagaauuaaagucuuguuaauaucguaauuugccuauugcuguacuaaaagaagcuucuauaaaauguaucauucucauccuuagauucaggccagaaaguaacuuucaguguuagguauuugaaauaaugcagccugucauauguacucugguuaccagaaugaaaaaacaaaaagagauacauacauaguaaggaaacaugaaauuggaggaauugauccccauguguauugcagcuucauauaccaguagucucuaauaagucauugcuuuaauaaaaaaaaaaauagaaaauuuaaauuuuauuugcccgguagcacagggauagcuauguugacuaagcgcagauuuuaacguauauguuuguugauauauuuaguuuucagauaccaguucaguccuacaauuauggcgaaacuagauggcauauaaaaucauuuuguugcuuuguugaggcuuguuuuuuuccuuauuuucagcaauauuuuccuucuuuccuuucacugaaaaacaaugcaacuauuuuauuuugaacaauggaagcuguaauggcaacugggguagcuauucaaaaguggagaugacgaugucccuuaauauuauaacaguuaucugugaacacaaaaauuuuuacccuaugauuuucuuuguuauugucuacuaaugcugaauauuuauaagacauuacauuuugaaucuuuauugauguuuccuagucuuuagaaaauuuuaccgucaugggcuagcauucuuuuacauggcauuuagauuuccaggauguucuuuguauuuuuuguuuguuuguuuguuuuguuuguuuuagacuuucaggauggauaauuacuuuauugcuauauuguaaaaauuauauucucuagggaauuuuaccuguuuaaaaaauugucucaguuuucauacaugggaaggaugaauaguuuuagguucuuuugaauuuugaauggauaauuuuugccuaaacuuuuaaacaggaaaucgguauuuaaaguauauuucauaaagugauaauggcauuuugcauuuuaaaugcagaagauaaacaauagguuuauggcauuuaaaaaugugcuuuauguagcauuuuugaaguuaaaaaaacugccuguaauagcgaaccuaguguaguucacuagcauucaaucuacaauguuggcaauuucuuugaacugauggggagaggaccaguuagacuggcuuuuaagaauuuuuauugucaucaguggauucuuugucauuauuuugcuuccaauauaguuaguuggugguuacuuuugauaucugcaaaauauugaccuggcaagaggaauugccaagggccagagaaguguauugaauauaccucaguguaguuuauuguucccagccugucugccucucccuguuggccaacauggaaaaucaauagacaucuaccaguaaaucuaauaaguaauguuaccguguucugcaguaaccugcaauacugaauacuguuugaggauguagauuuacagaucuauggcauauugggaugaggugaaaauuaucuugcucuccaaagucuccuuuugaaaauauuuuuugauaucaccuuauuuuacuugggguacuauaacaaaauaccauacauugagguggcuuaaaacacagacguauuuucucacagguccggggcuggaagucugaaaucagcuaagcaccugcccucucagcugucuucucccugggcacucuuaaguccuuuccucccugucugcaggugaagugggagggaggggagggagaggugaggaugucuuuuucuuuucuacuuaaaagggcacaaaucccgucaugagagggucucacucuuaggaccuaaucuaaaccuaauuacuucccaaagguccaccucuaauagccaucacacugggagguuuggacuucaacaugugaauuuuggggguacacagaucuucaguccauaacauaaacuuugugaaagaaauuaacguuaauuauuuaccuccucuacuaggcacuaugcuaaguauuauuuugugaaauccucacaauaagcgcuucauauagguauucugccuguuuucaaaugaagaaacaaagaccuuagguuaagucauuguuuccagggaccgaccucugugguaacauugacauuccaguuuaggcauucaaaccacuacucuacacugucuccaugaggaugagauguuaaaaagucaauguuacugucugcacucuauaaacaaugagugagauauuagaaaagcucaucaaaaugcgauuuaaaguacauugaacugguuuuacuacauuaaaagauugcaguauauaaaauauguaagguaggacauguugcucaaaaugaauuaaaaaucaagaugcuaaaaaaauuuaaaacauuuauaugggcgaggcaugguggcucacgccuguaaucccagcacuuugagaggcugagccgggcagaucacaaggucaagaguuccaguccggccuggccaacauggugaaacccggucucuacuaagaauacaaaaauuagcugggcacgguggugcaugccuguaaucccagcuacucgggaggcugaggcaggagaauugcuugaacuugggaggcagagguugcagugagccaagaucgcaccauugcacucuagccuggcgacagagcaagacucugucucgggggaaaaaaauuauagauuuuuugaauaaauaauaaauaaaaauaaaauaauaaauauuuuuugucuaccuuuuuuuuuucuuuuuuuuuuuuugagacggagucucucccucaguuggcccaggcuggagugcaguguugcaguugcgugaucucaagcuauucucgugccucagccuccggaguagcugggaccacagguggugugagcuuccacguccaacuaaauuuuguauuuuuaguagagauggguuuucaccauguuggccaggcuggucucgaacuccugaccucaggugaucugugcaccucggucucccaaagugcugggauuacacguaugagacaccguacccgugcuucucuaccuuuuaauaacacauuuuuguuucuuuuuaugcauuuguuaguguaaauauguucaagaauacucuacauuuuguguacauguuuguaaacaagggaaaaggacccaaagauaauuucucuuucauuguauucuaguucaguuacuaacuuuggccuucucaagucauauuaaucuacuauucuuauaauugauggguaauguuuguuauuaguauguguuaauauucaauaauguaaacaacguugguaaauacuugugagaaauuuuuuuuuuuuuugagauggagucucacucuguugcccaggcuggagugcaguggcgugaucuuggcucacugcaaccuccgccucccggguucaagugauucuccugccucagccucccgaguagcugggauuacaggcgugcaccaccauguccagcuaauuuuuguauuuuuaguagagauaggguuucaccauguuggccaggcuggucuugagcuccugaccucaugaucugccugccuuggccucccaaagugcugggauuacaggugugagccacugcaccuggucuauacuugugagaaacuaucaaguaacagcauugaagcccuuaucacuccaaauuuagacuugcucuucuuuaaauuaguuaauauguguuuuuuaguauuauuuuagaauaaacauuuuuugaaguauaacaacuuagauuuuaguauuuuauauuauugacuuguaauguuauuucugguggaaaaagaagcuuuucauugaguauguguguguguguuuguguuuguuaagauacagggucucacucugccacccagguugauugcaguggugugaucacugcuucuuguagccuugaucucuggggcuccagugauccucccaccucagccucccaaauagcugggacuacagguucagcgccaccagucuuggcuaaguuuuguguuuuuaguagagaugggguuuugccauauugcccaagcuguucuugaacuccugagcucaagcaaucugccugccucagccucccaaagugcuggaauuacaggugugagccacugugcccagauuuuuuacugauucugaaguaaaauuggauuccuuagacuuaagcaccuugagucugaccuauuaaauuagcuuuuuuuuuuuuuuuuuuuuuuuuugaggcggagccucacaggcuggaguacaauggcacaaucuuggcucacugcaaccuccaccucccggguucaagcgauucucccugccucagccucucgaguagguggaauuacaggugucugccacuaugcccugcuaauuuuuguaguuuuuaguagagaugagguuucacuaucuuggccaggcugguguugaacuccugaccucgugauccacccgccucagcuucccaaagugcugggauuacaggugugagccacugugccuggccuuaaauugguuuuaagaagugguccuuuaugucucaauuugaguuaauaaauuuaauuuuucaauuaacucagguuugcaguugguauuuuuaaagcauuuguuacguccucaauauuguauuagccguuaucuguguuguaacaauauaauuuaauguggcaauauuguaacauauaagauaacagcaauguugguugucugaguauucuguccacagccuucuuuccagguuuuauguguuccuggcaaucuggucuauauuuagggcuuuguucucaucacccauaugcaauaaucuccaccucuuuauuucuaaucuagaccucuuuuucugaguugcauuccagcuuccuacucgauauugccuuagugcucccuuaccuaaacugaacucgaauccccuauuucuguucccaauuucagugaaugguaccacugucagccuagucacguaagccaaaaacuuuggcagcuucuuucuuacgcuuuucuguuaugcucauuuccccuuaguccaguuagucacaccaaguccuguuaauuuuaauuccuaaauaucuuuuaaauuuauuuuuuccugugucacuuucuuacguaaggguuuuggaaugucuuaucugauuuacuggcuccaguuuugucccauuuuaaucuaaccauauucuuucuuuauguuuauauauguaucuuauuuuauccuuuuuuccguacugccguccauucauccauccaugucugaaguaccugccuacucuguacuagacacuaugguaggggcuaggauacaaagaugaagaaacugguauguugauauuacaaugcuaugacacuuguagagaaauucucauuuuuaagcccaaacgucucuuucuccaacgugaucuuuguuccauucugacaguuauggugguucugcuauauaguauuuauguauacuguaguacuuaauauguuauguuguaauuaauuauuuucaggucucucccucuuuuggcuggcguugugcuccagagaggccguguuuuuuuucauuucuguauuucuucccguauuaucauacucuuaaauugaauaaagugauggaauuaggaggaacaacaccgaguugguaaauuaaggucagaguaggcuuagaagcaaucaagaauacauuuugauauaguagauaauaaaaaguguaaaagguuucaaauauuggagcuauacaguuuuggugguauuugugugagagcaaucuagagcaguuuguaggccaacuuggagggacaguaacuuggcauuauugagacuguuuaauugcaugugagcuguacuaacuuguuagugaaaauggagagaaaagggguguggccuucaaagauuguugucuuuuagacaaaauggaaauauaaaauuauaauguuaauauguaaagaaaguacucauuucugaaggucuaaaaauauuggucaguguaucaggaguaaaauuugguuuaaccgaaaaaaacuggccugccgcgguggcucacgccuguaaucccagcacuuugggaggccaaggcggucagaucacuugaggucagggguucgagaccagccugggcaacauggcgaaaccccaucucuacuaaaaauacaaaaaauuagccgggcgugguggcucaggccuguaauuccagcuaccugggaggcugaggcaugagaauugcuugaacccgggaggugaaaguuguagugagcugagaucacaccacugcacuccaaccugagugacagagugagacucuguuucaaaaaaaaaaagaaaaaaaaaaucaaaaacaaaacaaccccccgccccaaaaucguccuuaaugaaaucuagcuauuuaacuguguaguauuggcuuaaaugcgcuuacugcagugcagaauuguacucaaaggaucaaacagugcauuuaauguuauucauucugcugugguaguuuauguauacaguugacuagaagcuuuguuuuucuuuuuuuuuuugagauggagucucccucugucguuuagguuggagugcaguggugcaaucucagcucacuacaaccuccaccucccggguucaguaaauucuccugucucagccucccgaguagcugggauuauaggcgugugccaccaugccuggcuaauuuuuguauuuuuaguaguguuggccaggcuggucucuaacuccugagcucagguaauccacccaccuuggccacccaaaguguugggauuacagguuugagccgccacacccagccuuguuuuuaaauggaauuacaguaauuaaauaaaaacuguuccauggucuacuuuuaaacuugaaggauuuuuuuucuuuuucuuuucugucuuuuuuuuuuuuuuuuuuuugagauggagucucaccccaucguccaggcuggagugcaguggugcgaucucugcuaacugcaaucuccaccucccagguucaggcgauucuccugccucacccuccugagcagcugggacuacaggugcacgccauugugucuggcuaaucuuuguauuuuuaguggagaccauguuucaccauguugggcaggcuggucuugaacuccugagcucaggugauccacccaccuaggccucccaaagugcugggauuaaaggcgugagccaccgcaccuggccaaggcuuuuuuaaaaugccuguaaucccagcacuuugggaggccuagguggguggaucgccugagcucaggaguucgagaccacccuggucaacaugaugaaacccgucucuacuaaaaaauacaaaaaaauuagccgggcguguuggcacgugccugaagggaggagaaucacucgaaccugggagguggagguugcaguaagcugacaucgccacacugcacuccagccugggcgacagagcaagacuccaucucaaaaaaaaaaaaaaaauugaguuuuaaauuauaccucuuuucagccgggcgcgcugucucacacuuguaaucccagcacuuugggaggcugaggcaggcggauuaugaggucaggauaucaagaccauccuggcccacauggugaaaccccgucucuacuaaaaauacagaaauuugcugggugugguggugcaugccuguaauuccagcuacucaggaggcugaggcaggagaaucucuugaaccugggagguggaaauugcagugagccaagaucacaccgcugcacuccagccuggugacagagugagacuuccucucaaaaaaaaaaaaacaaaaaacaaacaaacaaaaaaacccucuucuauaguagguguguuauaaguaauaaauuuauuuuaaauauuaguucgagauuauggcuugguaacgucuuguuugaagugugacauuuaaaaugaauuuucauaauuugugggagucagugccuuuuuaaauuccucagcuuacacagucuucuuaaaacacuuuuuguauugagcuuuugagaucaugguuuauuaaccaacauuuaucauuucagaaacagugggguauuguguguugcaauaauuuuugcccauaaguuggugagcauggauuuuuuuguugaucccucccuucuccagauaucauuuccauuuccauuuugcucucauccccuuucuuccuaagaagcuauaaaaugguugaaacauuuauuucagguacaauuuuuuggaaaagaucugcaacuuagguuucuauuguauaaaguuuagaauugguuauauguuuucaauuuucuuuucauaaagccuacuucaguaauaacuuauaauaaccauauuacuauaagcucguuauuuuaacucuuggcugggcaagguggcucaugccuguaaucccagcauuuagggaggcagacugaggaggaucacuggagccuaggaguuugaggccagccugggcaacauagggagaccccaugccuacaaaaaaauuaaaaaaaaaaaaaaauuaguugagcaugagauggcacaugccuguaguuccagcuacccaggaggcugaggcagaaggcucucuugagccugucucaaaaaauaauaauaauaauaauaaaaaaaagugaggccuggugggagguauuuggaucauggggcagaucccucaugaauggcuuagcaccauccccuuggugaugagugaguucaugugagaucgguuguuuuaaaguuuguagcuucuucucuguucucucuuguuccugcucucgccaugugacaugccuguucccacuugguuuugcaccaugaguaaaagcuucccgaggccuccccaguugccaagcagauguuggcauuaugcuuguacagcuugcagaaccaugaggcaauuaaaccucuuuucuuuauaaauuacccagucucagggauuccuuuauagcaauguaagaacagcccaacacagcauguaaaacauugauuguuuuugcuauaacucuuuauaaaauaagaacuauugguagugguaauaaaauuguuuaauccauugcuucacauugaaggaaugucuaaaucagugauucacaaggacaauugaaugaaaaucgucucuggcuuuuugaacuuugcauauuucccagauuuucuaauaugccucuacucccaccagauuugagcguaacuguagcagugaguucaaguuauuaauggguguguguugcauccuucuuguauguuuggggguggagguggcacauauagacauaccaguagacuaaauagucuaagaugugcauuguuguuucuaaucuaaugaccauuaggaauaaauaggucauaaucuuuuguaagcauaucuguaagcuuuccuuagggccaaccaaauauuucuuugaaccauuuucccuguucuguuccacuuguuuaggccugugcuuuaucauuuacuugacaucuuaauagucuagacaguauuugcuuuccuuguuuaugacucuuguaugugacucuagaguuuuucuuuucuuuuuuuuuuauguacagaugagaugucacuauguugcccaggcugguuuccaacuccugagcucaaguaauccucccaccuuggccucccaaacugcuaggguuacaggcgugagcugccacaccuggcugauuguuuuucuuuuucucuuuuauuuuauuauuauuuuuuuuuagagaaaaggucuuacucuguugcccaggcuggagcacaucagugcagucccagcucguugcauccucaaccuacugggcucaagcaauccucccaccucagcuuccugagcagcugggaccacaggugcacaccaccaugcccggcugauuuuuuacuuuuuugauagagacagggucucacuauguugcccaggcuagucuugaacuccuggacacaagugauucucgagccucggccucccgaagcgcugggauuacaggugugagccaccaugcccugccucacguuuuucugaaaucaaaauagaguaacugguuauaaaguuuacccaucaaaagaagaaacugacuuugcauuuuauucuuugucauaaaaucugccuggaugcuuaguauuauauuauuguuuacuauuauauauuauuccagaguaauggcuuuaaccucaacuucagaaucauucuuguugacuaaaauaagaaaaaaucuaaaggcaugcuuguaacuguguaaucucaaacucuguuucugaaugagaaucucuggguuuggguuuuuaauguuucagacaauucuugauagauccuggaguuuuagaaacacuguucuaggguuuagcacaguguuaagggaaggaaccacucauacauuaaauuuaaaguagauucauacuucuaguggguuggucgguccuugguugcuggaugcugugugcuauuggacccaaggaaugacggcacugcuaggaugaagcucaugagauuuuugaugaaaugguucaugaaacuguaaccuugaauugaaaaguggaacacaggucuauggaacagucacagguguggaugucaccgugauacacaucuuaaagcgugaaaaugacccugaagacagagaaccuguacaguuggaaacacaaauuugaggaaguaacauuagauauuuuacucuaccagacaguuuaccucuggauacacuacuuguggauguugagccuaaaguaaaaaccuaagaaaagggaagcuguuuguugcaggaagaggccaaugcagaagaagagguagaggaagaguacauggccauggcagagggagaggggguccuggugguaaugucucuuaagauuacuguuucaagguaauaugugauuugagauauuuucuguauagguuuucuucgcuuaugucaauuuuuauuuuuaaauuuuuuucuaucaaaaaauuuaccauuaugcaguauguccauguaauaugucaguuuuuuuguuguuguuuuguuuuucauuuugagacaaggccucuuucugucucccaggcuggaaugcaguggcgugaucucagcucacugcaaccuccgccucauggacucgagagauccucccacuuaagccuccugaguagcugggacuuacaggugccgccgccaugcuuggcuaauuuuuuaaagauuuuuguggagaguagagaugagguuucacuauauuuugcaggcuggucucaaacuucugggcucaagugauccucccaccuuggccucccaaagugccgagauugcaggcaugugccucugugucuggccaguaugucaguuuuuaacgaacauaaauguggaaauuuuuugaagugaaggcaaagugauuaaaacuuucuaccugggugcaguggcucacgucuguaaucccagcacuuugggaggcugaggugggcagaucaccugagcccagguguuuaagacaagccugggcaacauggcaaaaugccaucucuuuaaaaaguguuuuaaaaaauuggccagcugugguggcacaugccuguaguccuggcuacuccucuggaagguaaagucugcagugagcugugauugugccgcugcuccccagccagcgugacagaguuagagacccuaucucaaaacaaagcaaaaaccaagaaaccuuccugucguuccaucuuauuuuucccucccuuuuuuuuuguucuacuuggagcguuuuaguuuuaccgggaguuggcaguuuucuuaauuuuauguauaauugucuuuuguuucaauuauuuuauguuuuuuccuuuaguggauguuuuugucugacucuuuuagcuuguuucuuaucagugauacuguuuccuaucuguauggucucaguuauuaguuuuagaaaauuauuuuuaaaaugugagaauguauaaucauauaaaaaauguacaauguacguucucuaacacagugguuacuauuuucaaauauuaucuuggcuuuucuccaauauguuuuguauuuuuguuuaagauccuuuuuauguuuuuuuuaagguaccaaauaauuguggcuguuacuuuuaguguuugcaaaagaugcuuaaccauuucauguuguuugauaauuauuacuucucauuuuucauuauuuuguuuuaaaaauaauuucaacuuuuauuuuugauucagggcauacaagugcagguucguuacauggguauauugcgugaugcugaggucugggguauggaugagccugucacucugguagugagcauaguaugugauagguaguuuuucagcccaugcccccauuugccaaccccuucuagucaucuccagugucuguuguuaacaucuuuuuuuguuuuuugagacagagucucacucugucgcccaggcuggagugcaguggcgcaaucuuggcccacugcaaccucuccgccucccggguucaagcaacucuccugccucagccuccugaguagcugggacuacaggugcccaccaccacgccuggcuaauuuuuguauuuuuaguagagacgggguuuugccauguuggccaggcuggucuucaacuccugaccuuaugaucugcccgccuaggccucccaaaguuauggcauuacaggugugagccacugcaccuggcuuuuuuuuuuuuuuuuuuuucccuugagaaagggucuugcuuucacccugacuggaaggcaguggcaugaucauggcucacugcagccuugaccuucugggcucaagugauuuucccaccucagccuuccacguagcugggaccaugggcauguaccaccacaccuggcuaacuuugauuuuuuguagauacaaggucuauguugcccaggcuggucuugaacuccugggcucaagcaguccucuugccucagccucccaagugcuggcauuacaggcauuagccacccugcucagcuguuccuaucuuacguccaugugugcucaauguuuagcucccaaauauaagugagaacguacaguauuugguuuucuguucuugcaguaauucacugaggauaauggucuccagcugcauccauguugcugcaaagaacaaggucucauucuuuuuuuauggcuauacaguacuccaugguguguauauaccauguuuucuuuauccaguucaccaucagugggcaccuagguugauuccaugucuuugcuauugugaauagugccgccauaaaccuaugaauacaugagucuuuuugauaaaaugauuuguuuuccuuuggguauauacccaguaaugggauuauugaauugaaugguaguucaguuuuuagcucuuugagaaaucuccaacugcuuuccacaguggcuaaccuaacuuaacuuauauuccuaccagcaauguguaagcuuucccuuuucucugcagucuugccaacaucuguuauuuuuugacuuuuuaauaauagccauucugacuggugugagaugguauuuuguugugguuuucauugcuuuuaucucaugauuaguaauguugaacauuuuuuucauguguuuguuggcugcuuauaugucuucuuuugagaaaugucuguucauguccuuugucuacuucuuaaugggauuuuuuuuuucuuguggauuuaaguuccguauggauucugaauauuaguccuuuguuggaugcauaguuugcaaaucuuuucucccauucugaaggcugucuguauacucuugauaauuucuuuugccaugcagaagcucuuuaguuucauuacguccugcuugucaauuuuuguuuucuuugcaauuguuuuuggggacuuagccauaaauucuuugccaaugcugaugucuggaagaguguuuccuggguuuucuucuaggauuuuauagucuaaugucuuuaauucaucuugaguuaauuuuuguauaggacaaaaaguaggggcccacuuucauucuucuguguaugccuauccaguuaucccaacaugauuuauugaauagagaguccuucucccguuguuuauuuuuggcaacuuuguugaucagacgaucagacgguugugguugugcaacuuuauuucuagauucuccauucuguuccauuggucugugugucuguuuuuguaucaguaccaugcuguguugcuuacuuuagcccuacaguuuaguuuuaagucggguaguaugauuccucuggcuuuguucuuucugcuuaggguugcuuuggcuauuugggcuuuuugguucuguaugaaucuuagaagaguuuuuuuuuuuuuucuucuaauuuugugaagaauuacauugauaguuugauaggaauagcauugaauccguauauugcuuuuggcacuauggauauuuuaaugauauugauucuucuaauuaaugaccauggaauguuuuuacauuuguuugugucaucacugauuucuuucagcaguguuuuguaguuguuauucuagagaucuuucaccuucuugguuagauguaauacuaggcacuucauuuuuuggggggcuauuguaaauaagauuguguuuuuaauuuugcucucagcuagaauguuguaauauagaaaugcuacugauuuuuauucauugauuuuguauccugaaccuuuacugaagucguuuacaguucuaggagccuuuuggcagagucuuuagaguuuucuagauacauaauuguaucugcagagagauaauuugaugucuucuuucucuauucagaugccuuugauuuuuuuuucuugccugauugcucuggcuaggacuuucaaguacuauguugaauaggaguggugagagugggcaucuuugucuuguuccaguucucaagggaauuguugcaacuuuugcccauucaugaagggaugcuggguuuuaucgaaagcuuuuucucugucuguugagaagaugauaugcuuuuuguuuuuaauucuguuuuaguggugaaucacauuuauuguuuucauguguugaagcaaccuugcaccccaggaacaaagcuuacuuaauuauggugaauuaacauuuugaugugcugcuggauuccauuugcuaguauuuuguugaggauuuuugugucuauguucaucggggauauuguucugaaguuuucuuuuuucauuguaucucugccagauuuugguaucaggcugaugcuggcucccuagaaugaguuagggaggaaacccuccuugauauuuuggaauaguuucaguaggauugguaccaauuuuucuuuauacguuugguagaauucggcugugaauccaucugguccuggacuuuuuuugguugguaggauuuuuuuuuuuuuuuuuaauuacugauucaguuuuggaacuuguuauuugucuguucagguuuucacuuccuuccugguuuaaucuugggagguuguguguuuccaggaauuuauccuuuucuucuagauuuucuaauuugugugcauagagguguugauaguaggcugaauaucuuuuguauuuauguuuucacuauuuuaaaucggugcugugacaaacuugaacaugcgauaucccuuucccacccgcccacaccauuuugcauuuccuuaggguagauagaugucuagaaguggaauucccaaaccaaagucugugaacccuuuucugauaucucuguuguaccaguaccacgaauaaugugccacaucuguuuuuagugauauaauuaucuaaaauguuugcuuuugaucauugguuuuagaaaaauauaauuauauuugcauuucuuugauuucugggauguugguccuccucccacccccauuauccccacggauugcuaaggaggagacuuugacugcucccugaauccuggcaucuucuuuuuuuaauuuuuucugauauuugguuuuuaucaaguuguuauauaauaaaaaaaacuagauaaguuguuuuggugauccaucucuuuuuauauucauuccagcuuauuuuucaaugcuuuguaauauauuuuaauaucuaguguggcaaaacacuuaauuuuuuucuaauaauuuugauauucuuauauauguauuuuuaauucuacuuuaguaaauggcaggcaaaaaaauguagaucuauggacaguaguagaguuuaugggaggaaaauugcggaugauccuuucagcucacuagaagucucuauuuuuuucuucaaaacuggucucccugcuauaaaauuugaacuguagguaugucaguauaucuauaagaguugccuccguaauugaaauagacuuccuguuacccguugucuagguuguacacuguaaagagcaucuuuuuuuuuuuuuuuuguaggaaaaaaugguuuuguacaugggaugaaacaauguaaacucaaaacuuacagauaaggguuaguuguaucacucaucucuuugaaaaguuuauaugaauauccagucaaaaccaacaagguaucgcccuugaaauguuaucuauauggauuuccaaggagaccauaggacuguauacugucuuggaauguccucagaaggcuuagagagcaucuugauaaaagguuaugugguuuaugauagaguguauuaguuuauuuguguuauuaccaaagaugaacuuaugguuaaagaugaauuuaggauuaacaugacgaggaaagagugacauuuagcugaggguauuaaguagaugucucagaugaacugacacuaaagguaauuagcuuuacaaauagagagaugagagaagagaaccacuuccuagguaggauaaaagaacauguaaaaaagggauaugaaaaaaauuuauauuccuuuaaaaauguuauucucuaccagccuaaugaguauuuccaugugauagaaauagagauaaagguugcucauagagguaguggcaggaaaugaggucaaagagggagauauuccaguaaggaggcuguugaacacuuuuuaggcagaauaucauuguuuucuauagugaagccauugggaaaguuguguacaauuacagaugaacuucugcaaguuaaauggacaaccuuuugugauguuggugcuucagaaguacucucaaaggguugcuuuacaauauugaaaaugcuaaaaaauggccgggcacagugucucacgccuguaaucccagcacuuuaggaggcugaggcggguggaucacgaggucaggaguucaagaccagucuggccaagauggcgaaaccccgucucucuacuaaaaauacaaaaauuagccgggcguggugguggaugcuugggcgccuguaaucccagcuacucgggaggcugaggcagagaauuauaugaacccaggaggcggagguugcagugagcugagaucgcaccauugcacucuagccugggcaacagggaagacuuugucucaaaaaaaaaaaaaaaaaccagcuaaaaagagcuacuugugccuuuuuuggguaauuuuuugguucaccucagagacaugagaauuacugguuuuucuuuuuuggguuuuuuuuuuguuuuuuuuuuggucgggggacagagucugccucugucucucaggcuagggugcauuggugcuaucauggcucacugcaggcucaaccuccuggguucaggugauccucccaccucagccuccauaguagcugggacuacaggugugugccaccaugcacagcuaauuuuuguauuuuuuguagagauggggucucacuguguugcccaggcugguuucaaacuccuuggcucaagcgauccuccugccuuggccuuucaaagugcugggauuaaagauguuagcuacagcgcccagggagaauuguuuuacugucucuuaggagcacuuggaaauguguguuuaauuuagaaacucugccauuuuuaucuuccgaugaggaaauguuucgauauguuagaaauugguuucaccauuuuguuuggggaaauaagagauauaaauaguagauuuacuucuggacacgguggcugauggcuguaauuccugcaaauuugggaagccaaggugaaaggauugcuugagcccaggaguuugagaccagccugggcaacauagugagauccccgucucuacaaaaaauguuuaagaaauuagccaggcauaguaaugugugccugcaguccuaguuacucaagaagcucaaccuguggaaggauugcuuaaucccaggaauuugagguugcagugagcuaugauggcacugcacuccagccugggggacagacuugagacccugucucaaaaaaaaaaauuagauuuaaaaaauauagaaaugauagaugcuuuuguuuaacuauaaauaucagcauaucuuauaaucaagaauauaaacauuaauuguuucuauaaauuguucugcauuucuuuagccuuuaucucccugcuaauauaggugaucauaaaucacuuuccauuuaacaguaauucaguaaacuuacauacagguucugauaauauguuaauuuuagcagcuguacugcauuucagcacuuuaaauucaacugaguuugacuugaaauaccuccauuuuacuaaauuuagauuuuuuugguacauaauugucccuagguuugagcuacucugucucauaguauguauuuaugcuucagaaauuaauaucuuuuucuuucuuaguauuugaaccuucagauucuuccacuauuauaaccauuuuaaguucuuuuuaaaauuaaacuuauuuuuuugggauagauaaaacucaaguauguagaaagauguacacgaagucuuauuucuuccuuugcuugcuacuuuauuuuccuuccacacuuuuugguauccuguuuauccuuccaguguuuuccuuuuguaguuacaaacaaauguguauuuuauucuggagaucuuuccauaucuagauaaagaucuuuauuuuuaauagcuucauaguauuuucuuauguagauguaccguaguuuagucacucaauccuuuguggcuauuuggguuguuuucuauuuuuugcuguuacaaugccaaaugaauaacaauauacauguaacauuuucuauuugaacaagcaauuguagaucuuuaggucaaguauuuucuuccacugucagcugagagaaccuagaagcaacaauaucccuguagcagugagcacaccuggugcccagaucuugguuucuaacaccauucuccaguaaaaggaaccaggccuuuguggagaaauggcugauucuaggacuggggcagcuaauaaaacuguaagaucaaccuggaguaucuuguagugcuggaaaggaaggaacuauucaaacaaaaacacgaaugaguuaugucaaagggacacagccaacugaaagaguucccaguagccaauacuggaauaauuugagcaacaaaaaaguaauauugaauuauaacccaaaguauaaaauaauauccaugaguucaugcugauagaaguaaaugacugacuaaauaaauaaaugggggaagaauagacaaaucugugcauaauuagauacacagcccucaaggaaguauaauacaacuccccaccuuucaagugugagcuacaugaggugacuuccugccaauaaguaccauacuaauguaagaucuuacuagcggaaacugagugugugguuuaagggaacucuuuacuauuuuucuguaaaucuaaaacgauacuaaaaguucacuuuuaaaaaacugcuucugggccgggcgcaguggcucacgccuguaaucccagcacuuugggaggccaaggugggcggaucacgaggucaggagaucaagaccauccuggcuaacacggugaaacccugucucuacuaaaaauacaaaaaauuagcugggcguaguggcgggcgccuguagucucagcuacuugggaggcugaggcaggagaauggcgugaacccgggagggggagcuugcagugagccgagaucgcaccacugcacuccagccugggcgacagagcgagacuccaucucaaaaaaaaaaaaaaaacgaaaaaaaaaaacugcuucuguaauucugaugcugccagauugccauuuuguacuaccaccuaaaugugcaacaggccuguuucccauaaccucagcaacugaauguguugucagacuuuuugaguuuugcauuugauagaugagaacugguuuaacucagguuauuguauuuuucucauuaucaaugacauuggacauuuuuucauauguuuaaggggcauuuuacguuuuuucccuucuuugaauucucauguccuuuauuuuucucuuaggucauuggucuuuguuuucaggaauuuucuguugggagauuagcccuuuauuugugauguggguugcaaauauguauauuuuagauuauguuuuuucaugcauaacuuucgacuuuuauauggugaaguaauuuuuucuuuuauguuuuuggauuuugaaauauauuuagaaaagucuucaccauuccaagguuauaaggaaguucauccacauuuucuucuaauacuugugguuguguuuuucacauuuggauuuuaaaauuuggauccuucaguuccucucaaucuuugaggcauuuuaaaugcuuaccccuugcuuucugguuauaccugcaucagcaugguuguggccauauaggugauucagaugacuuauaguaaaagaaauacuuaggcauuuacucucaguaagaagucucaacuuucugauuacugaucaugauuauuauaguaaauggaaacuccuuuagaguuucuuuucacuguuaaauuguauauuuuguaguauuuuuucuacugauuaucaguauuguggauuauucauguaucaauugguuuuuuccuuauccuguuucuuauaggauuccuuuuuagauuauuaaaccugucugugaucuguuucucaucuuccuuagaacuccuacugguuuuaugguccucugauuacuaaacucuauuuuauaaucuucagaaguuuaauuaguaggccaguuugcuguuuuaacucauuaagaaacuggccaguagugucaguggauacugccuaauauagggugaugauuuaucuuaaccuuuuauaacaguauuaauauuuuccccacauugcuugugaugagacuagugucacugaacugagcuuguaacagacauuugggaagcugucuggugguacugcggaauuuuggcugcuggaaaauaccaccaaaaauuaucuguugaguauauugcuuauaagcauuuguagggggccauguggguguugauaagaauggcaaaccagaaaggaacaucaaaguuggaguguuuauuauugauguuuuggagucugguuuaaguauuucaaagcuuuauuagaauuaggugaggaucaugauauaauaguuugauuggacagacauaccaagguaagaguuuugagguaagcuuuuucagugucuuagaaagugaacaaucauuugcuacuauuuauugaaaaauugaauagucugauguugguuuauauggguuuuuugggaaguuccugaaaugaacaaugaaguuuuuuguagcucuuaucugccugagcaggaguuuccuggaauagcaaagucauguuguugaagacagcuguauaaugauaguuaauauagauuguaaacuugguguagacaguuucaguucucaguguccauuuagaaccacaagaaacuugaacauguauuuauaaaaagucugauucuuaggcucauuugcaaagacaaugcauucucuuggugaauaguuugacuuucaauuuuuccccuggggaaugaggccugacuuuaacaauuaggugucagacaugcccaaguaggcaguuggauaggugagucugcagcuuaauaaagaggucaggaucacuguaauaccagcaguuugggaggccaaggcagguggaucaccugaggucaggaguuugagaccagccgggccaacaucgugaaaccccaucucuacuaaaaauacaaaaaauuacccaggcgugguggugggugccuguaaucccagcuacucaggaggcugaggcaggagaaucacuugaacccaggaugcggagguugcagugagcugagcccaggaugcggagguugcagugagcugagaucgcgccauuguacuccagccuaggcaacaagagcaaaacucugucucaaaaaaaaaaaaaaaaaaaaagguuaggaucagagauggaaauuugggagucacuguguguagauguuguccacccagaaugagcuugccuaaggaggaaacauagaagaaaaaugcuugugccaggacuuaggccacacugguguguguguauguguggcugagggugggguaaagggguggaauaaaucugcagaggaguggccagagagguuggaagaaaaccaagauauuguuauagagaagccaaggaaaauguguuuaggauaaugaaggacuggucaaacuccuauaauuauaggcaaggagcagugaagauaacugguguagguuaguucaggaaauuucuaccugaaagcucuauguuuaacucauuuuuguguacauauguauacacacaggcacacuguauggguuagggaaagggucaucauauaauuguggaugguggagaugguuugaaguagacauuggggagaguaggagaccaagugcagcagagaaauauaguaagauuauuggccaguguugaggcccauuuagguucgcugaucaaacuguucuguugugugacuguucagcagugcugagaugaacuggugcugauguggagaaagucuuagguggauuaggauugggauggacaagaauauauuugugcauuacaguagauccaaguauauguaccuuucugccuuuggaguggcuguagcauuguguuguuucauuuauuucugaugggcucuucucaugaccucacuugcuugaaagcuuacugcuugacugguauucagcccaucugaacuuacuuuacuucuguggagaaguaaauuaguuccccccuuuuccugguuuccacagagucuugagaucucugauguugcuucuuaggaagaaggggcauuugacuaaauuuauaaaggaaguauaagaauuugccaagaggucagagaaugggaugaaggggaagggguuaauuguuccugguagagggauaugcuugugcaaaguuaagaggccugagcaaaacaccuuaagggaauagaagcuacaaauaauuucuuugaggcaaugaagcacucacuguguaucucuggagauggagcugaaaaguaguggggucagaacacaaaguucuuguaaggcuaggugaagaaugaccuguuggccccagagauuaauuuuuacuuaacaauuuuucuacgcauguacaaaauaacggcuguucacagaacuauucaguucaugacauucuucaccuaagaauugccuagugggaaaauguguuugcagauuaguuaucugaauuugauaauauuuucauagaaauaauuuuaccaauuuggcugccguguugcuccaugaaaguuacuuaauuucucauuuuggcuguuaauggggaaagaggguuagugauauguagcuugcaauuuuauauacagaacauaaaucagauguucauaauuugggaguauacaguggcaaaaauaguauauguuaaaugcuuacugugugcuagguacaauacaugcauucugauuuagaucucacauccuuuuggaguaauuguuuuuuguuuuuuugagacggagucuugcucugucgcccaggguggaguggucuucgcucugucgcccaggguggagugcaauggcgcgaucuuggcucacugccaccuccaccucucagguucaagcgauucuccugccccagccuccuaaguagcugggacuacaggggcacaccaccacgcccagcuaauuuuuguauuuuuaguagagacaggguuucaccaucuuggucaggcugguuuugaucuccugaccuugugaucuguccgccuuggccucccaaagugcugggauuacaggcgugagucacugugcccagccauugagguaauuguuaauucuuuucucucucucucuuuucuucugagauggaguuuugcucuugucaccuaggcuggggugcaauggcgcaaucucggcucacugcaaccucugccucccagguucaaagugauuccccugccucagccucccuaguagcugcaauuacaggugccugccaccacgcccggcuaauuuuuuguauuuuuaguagagacgggguuucgccauguuggccaggcugauauccaacucuugaccucagguuauccgccugccuaggccucccaaagugcugggauuacaggcacuuugggagccaccgcagcuggccuguuaauugccuucucugaagagaaaacuaaaugcaguuuucucagugucauacuucucacugucucucuaguguuuaaaugaaggaaucaggauuugaaccuagguuaggcuuacccuaggacuuauucucaguuucucuuaaagaaagugaacuuccuaugugcuauaaacucuuuaucacuagugccaaaguuguguguaccauaauuaacauuucacuguagguguuaauuaaauguagugauguguuaaccucuaagcuuuugagaagacugaauagguaguaagcaauaaugaagcaaagagagaaucuaggcucauaaagccauccuuugguuaacuagaauccauuuaauucaccuaauggaaaauucagauagcccaaacaauauucuguuugucagaauucugguuaauucaaauauuacuguuuuaaaaugcuuuucuauauccucauaggaaaucuuucaacauuuuuuaaaggcuaucauuuguaauguauaugcauauuuuacccucuuuuucuucacuuuguguuaauuucuuuauuuuuucuauuuauaauauacugagguuuccuaaauaaguaaaauuagaagaauagagaguucugcaaauaaaaaugaaaaccucugaaaaaaaguggcuguggaguauuuuuuuucaguugauuauucagguacaccuuuucuuacuguuuuggugaaaaucuacaauuuggccuuuaccuuagaucuuauaaagaugauagaguaugcuuggaaauuggcucauuguuaugcucccuuccuguuaggauugguaugugaacaauuucuaauuuuccacuuagcaaguaaugugauggaggauuagagugccucccaccccucaccaaaucacaaaaaaagcuuuucugaagauaaugguaguuuuauaguuuugagaucaauugauucggcccuaggaagacucuauuuugaggccuuuucaauaucuuugaaauuaacuggccauauaagagggagauuuuuuuccuucacagcucuucuucccccaaagaaaaccuuuaccagaagauugaagaaugcuggcauuuuuaauauguugccaagucuucuacuguugccauggaaaguuggccacuacuuaguagaauuugucuuauaaaggcuuuaauaguguuaguuuuuaaaagauguuauaacuauuauugucauaaauuacagaaugacaaaauagcauuuguccaguucagaugccucuuggagagaaagacuagaaaguuguacacacacacacacacacacacaaacacacacucacucacacacugucucucucucuccguccccccucuuuuuaacaugauaagcaaauucauauuuaccuugugccaaguaugcuaagaacauucuuaaugaaaccuacaugaauauuuagaaaguaggugauuuugugagauuugcaguuuaaaaacauaagaggcaauacauaauacuauuugaucaugauugaaaaauaugucauguaauaauucaguuauuuuugaagggaaaugaaauuucauucuuuuucuuuuuauuuuuuuugagauggaguuucacucuuguugccuaggcuggagugcaauggccugaucucggcucaccacagucuccgcccccuggguucaagugauucugcugccucagccuccugaguagcugagauuauguuggucaggcuggccuccaacuccugaccucaggugauccgcccaccucagccucccaaaguguugggauuacaggcuugagccacugugcccugcugaaauuucauucuuacaguagcugucaaauguggccuuuuaaauauuuaaauauauauuuaguucuuccuauuaaaaugaugccccuuaaaaugcuguuuuaauuuuuuauuguuggaguuaggaggugguuaaagggugaacaauuagcugggcuucacgggauaucuuuacgucagugggucaugauaugucaccauguggugaagucugaucuuuucagcuuuguucugugacauuccucuucaguucauuuugagauaaucugguauuguagaaucucuuaugcuaauuagaggauaaaguauaauguuaauuuagaaauacacaaugagaaauaaucuggcuugauacaacaguguuuuaagggggggauaugagugaugcagugggggcagggagggacacaaagauuuuaaaaauauguuucuuuccuuaaggaguuuauaauacgaugaaacccaggaaguuuuuauuuacauagcccacuugauccugguaaguaaaccaauuuagaagaucugauuucagaucugaggguugguugagaauagcuuuaggguagugaguuuucaaccuuuuuggucucaggaccuguuuauacucuuaaacguuucagaaaugauacgaaaacagaaaccuuagguuacaaaaaauuguaauuuacuuaaaaauaacaaacauuacgaaguuaacaaaucuuaaaaaaacuauuuucaaaaauaugagaauagcauuguuuuacauauuugcaagucucuuuaauuucaagcuaaauagaaaacagccggauucacacaucugcuuuugccuuuuaguuuauuacaauauucaguguagucucuggaaaacuccauuguacaccggugagagaaguguaaaaaaggcaaauaacuuaguauuuuauaaaaauaguuuuuaccucaggaugcucccauaaagguuccccagaccacacauacuuggagaaucucugcuuuagagcaaaaugaaguggguugcuuauccuacuuuugaucuugcucugaauugcauauucuuacaggcuguuucugucaagcuguaguaacucauuaaauuccauuguggaaguuacucgcagguaacuucuacuauaaauaguuggagccauaggcuuugauuggaaaaggcaaggcuugcuagcuguaucauuucaggaaaauguauucacauuuuggaauguuuccucuuuuguaaaauggguagaguaauaccaacucauaagacuucggugugaaccaaauaaauuaaagcaauauacaguugcuaaucaaaucuugcuguuaguaggaguuuuggaagaaaacauugccugacacauguuccaauuuucucacauacauuuugguuaaauuugcagaauauccuaaacaccugauaagauuugugucuuccuuguuacucugcagugacuuuuuuuauuuuuaaaaugcccuccguucuuuccuucuguccagcucuuacacucgcggcuucuuagagccaguuccuucacaaauaaauggggauuuuaaaacaaaaauagcaaaauauccuucccugggguguucauaaucuugugcuuaaacuaaagaaacaguuaaggaguuucaccauauuggucaggcuggucuugaacuccugaccucgugauccgcccaccucagccucucaaagugcugggauuacaggcgugagccaccgcgccagaccuauuuuauuuauuuauuuauuuauuuuugagacagagucucgcccaggcuggagcccaguggccccaucuuggcucacugcaaccuccaccucccggguucaaacgauucucaugccucagccaccaaguguagcuaggacuacaggcaugcaccaucacgccuggauaauuuuuguguuuuuaguagagaccagguuucuccguguuguccaggcuagucucaaacuuuagaccucaagugaucugcucaccuuggcuucccagagugcugggauuauaggcaugagccacugugcccagccaacauuuuuuuaaaaagaaauccucaccacauauacaugagauguaucuaugacauuauuaauaacuggaugggcugauagauugcucaacacaauuuucauuuauaagaaauacuuaauuuguuuuuuuccuuuuucuuaguguugucaaguuuuuucuuuacuuuuaaagaaaucaaccagaaaugguagagacuguguugguuuauguaaagaauuccuuucaugaauacaggccuucaucucacagcaaaaaaucagugcauuugaguguuuuaaguuaacauguuuaagguacauaauuguaaagauauguauauagauauauacuuuuuuuuucuuuuuugugauuguuugaauuaccaauuugauuaguggacugguccugaguuaguugauucaccagauucuuguuuuuuagugaauacaccuaucacaggccuacuuuuugaauucuaacuugaaagucaguagugggacugaagcccuuuuucaaacuuuaacauggauuuuguaguaaaauuggaauaauacagcaauuucauaguaccacuuguagcuuccagcaacuaucaugacauuuuauauucaaacuguuucuuuaaagaagacuuuguaguuaccuaggguuugggacucuguugugcuccuuuccagccuuauucauugugccccccccccccccccccgucuuagaguagcuucuuucuaaauuuccucuuccaaggaaucagcugaugcuucuaaggcagacucuggagccaguauuaugguuucauaucaaagugucaaaauacuucauuuucuagugaauauuagacgaaaauguggaacacuucaacaauuggaauauuaaaaggaggauauuuccuacuuagauuuauuuuacuuauuagggaacugaaaaugccgucuaagaaugaggggcaacaagauuggccugugcucaaauuuuaggaggcacggugcccagagagggcuccagagcucuuuugcuggcugccucuucuggagcagcugacuggccagcugcagagcacauugaucuggucaugauugcuuucauccuggaguagagcaaguucacacaauuuaaaucaagagccacauuagaagcuccugaccucaggauaaccucucauuuccuaccuuugaaagagggaacaagagggaacaguucagucacuuccuaacaucuagccacaaaaauacaugggaagauauagccacaucuaaagauugugaucuccugauuuucuuuauaacuuagguagauucagaauaccaucuuccaguuuucccuuggaauacaaggaacauuagucuuaaucuacuguucuguguugaauagagaaauaauuccuucccuuccacacacucuuuuuuuuuuccuauugaacuuuuccuaggccauucauauagaugcagccuagaugaaauagacuuggacuguucguaaacucacccuuuucuugaaauaucauacugcagugugacauuucuuaccuguguuauauggcagaccaguguuuuuugauguauacguuuuuaaaugcaugcuuucuuuugguaaauuuaggccucccauuauucucugaauaucccuaccagucacuauaagggauuuuuuuuuuuuuuuuuaaguagagaugaggacuugcuguguuguccaggcuggucuugaacucugggcucaagugauccuccugcuuuggccucccaaagugcugggauuauaggaaugagccacugugcccagcucauuaauauaaaaguuuuacugaaguuuauuuucuagagauuucaacuuugcuucugcugugacucacaugccaggauagguaaucucacauauggaacacuguaaguuacuggauugauaagagggacugagaauugugagcaguucucacuucuuaaguuguaauuguacucuuuucucccauucauaacugagaguaauauuaaauaauaguucugaaucugcucuaguucauuaaguauaauucacauuuucuuauuucgacuguuaguaacaaauucuaaugcucagaaugugagcacuaaauaguaauugaagaaauuaaccucagacuugagaacuauuuuacuuuauaagauuucuuuuuuuuuuuuuuuuuuuuuuuuuuugagguggagucucauucugucacccaggcugaagugcagugguacaaucucggcucacugcaaccuccaccuccuaggcucaagugauucucccgccucagccugccgaguagcugggacuacaggcacgcgccaccacacccagcuaauuuuuuuguauuuuuaguacagacgagguuucaccauauuggccaggcuggucuugaacuccucaccucaugauccgcccgccucggccucccaaagugcugggauuacagacgugagccaucgcacauggccauaagauuucuuaauaagaaagggaacuacuacuuugcuagaagucuccgugcuugacuuggaggacauacugaguuacagugaaauaaguaagagcaaaggucuuuaguuagaaaugucaugaaaugaggaaagaaaaggaaauaaggagguuaaaauaugcguagguguuuuauaacuauuaaaauuuuacugacuuguguaguugauaucuuucuacucagaaaaaagagaaaaagauccagauauuuaggagaagucacauauguuuguguaccuuccugauaauugaugguauugagcuaucuauaaucuugguuaaauccuuauaagaccacugauaacauauuaauauuuacuaccucugauuguccagaguuauggguauauuaugucacugguugaaaaucugacugauuuauaaaaaaggaucaaacuguggguguuagccuuagucaaacaauuuaaacaagcaugagguacuacgaacugauuuuuuaaaaaauuugggacagugcuguuuaagcugcuuauaauuucacuuguuuuucagagauaauuuuuacuugaugucuguuuguccuagauacugugauacacuagauauaguaauguaugagauauaugauagcggcugugauuuauuauaccuagaacuaagagugguuuucagauggauauuuuacuuucccuuauaugagggacugggucauacugcuuacaaaagaagugacuaaaauggccugcuguguaggaaggguaacaucuguguucauacaauaaauggauguagccuaguucucugguggaaugucuaacacuugccaguacuguucucaaaaagaguuuguuaauaauuuuaaauaacuugauaucauuuaaaaauacauggccagucuaggaaagguggauagcaauggaagguauuugcuagaggcuuuuuggccuucccggugucugaaaucucuucucagaaguguugaaauguaaccagcaguagaaaaauuuuccuuacuaauuguggaauugagucuggaauuugucuuuugauucugccaaaggagagagauucacaggccuaccaaaggaggaaggaggaaugcuuauaggucuccuguagaaguacuauuuauaguauuaucugcucauauaaaccuaguuuuuaaaaauaaaaacuuuuuuuuaauugagacagggucuugcuaugcuguccagcuggucuugaacuccuaggcucaaacagucuccccaccucagccccccaaguagcugggaugauaggugcauggcaccaugcccagcuucuauaaaccuaguuuaaaaauacguaagagaaaaaucagauaaguugaccucauuaggaaauaauuugucaaacacauuuugguagcauaguaagugaaauuuguuaacuuucauauaauuugauauugcuaaaauugcuuuuagguguaguuuuucuuuugaaacagauuaucaagaggguucugacuauucaagaauauugcuuaauuucacaaaaauugaaaggaaaggcauuuuguguuucccucauaaucuacacaucaaccagcuuauuugugugagguuagugaaggaacacacaggauuugcauuuugucuuaucaggguuuacuaaauagugacucuugggugagucuuaaguuuugagcuuuuguuuucuccuuuauauaauaggaaugguaaauuuaucuuuuuuacuucauagaauuguuuuaagagucaaauaaaaugauggauguaaagacucuguaaacuccauaaagcuagguauauagugauguuauucauguuauuuuuaaauugaugaaugaauuaucaacuuuguggaauaauuauuuuaaugauuggcauagggaagauaauguaccauuaucaaauaucucaucuuugagaaaaaagcaauuuuauuuuuauuuaacauugaauauauauuuaaggacaauuuaaaacucuuuaauuuuuauggauaaauguacagaaaauauuaauauaauguauagacauucagaaauuauuagauuggcaaaccuauuugugauauauauaaacagacaaaacuucagugucugaaaauuuccugguaaccaaguaaugcuuuugccaaguucugcaccuuuuuuauauaccuugauccugucucauauuugugaggucuuccugaguccuugaauauacuuuauugcuuuuccauggugcuugaugaaacuaaagguaggaccaaauucccagcccaguaauuuuguuuucaaggaaauuguugaaguucauuugugaaacauagagaaaaauauuuucuguuuuuagggacucaaguaaagagcaagccuauggaagugauuuccuguaguaugugccguauuucuugaugguacucagcugagagugguuguuguaaggaggauauauuuaaagcacaaaggagaaaacgaugggaaaagaacagagcagccaaaaaccaaacagaacacagccaaaugauugaacauaaguaugauuggaguccucaaugaaauggauagggggaaggacaugaaaagaugauuggcgacauuagucaccaggaauaugcaaauuagaauuauggugauauacuguucaucagaguggcuaaaauuuaaaagguaauaccuguguuuuugaagaucuggauugcuggaacacauugcuggugggaauacaaaaugguguggccauuuuggaaaaccaggaauucuuuagaaaguuaaacauacaucugccaugugacucagcaguuuuacucagguauuuuacccaacagaaaggaagacauuuguccauaaaaugauuauacaagaauguucauagcaaauuuaauuacaguauugaaaaacugaaaacaacccaauguuuguuaacaagcaaaugagaaugugucauauccauauagugguggaauacucuuaggcaauaaaaauaaagaaaccacugauacacagaacaacauagauuaaucucagaauucuuaugccaaguaaagaaguuacguguauaagaguacauauccuuaugugauccaguuuaugugaaauucuaaagaggauuaugcuguaagggacugaaagacagaaguugcuaauggggcuacuugguugccuucucgcacugugaaccucuagcauuuugagauguguaaaguucaaaaaacaguauuuauguguuuguuuguuuugagacagagucucguucugucgcccaugcuggagugcaguggcaugucucagcucgcagcaaccuccaccucccagguucaggcaguucuccugccucagccucuagaguagcugggacuacaggcacaugccaccauacccagcuaauuuuuuguauuuuuuuuaguacagacaggcuuucacuguguuagcuaggauggucuugaucuccugaccucaugaucugcccgccuugaccucccaaagugcugggauuacaggcaugagccaccacaccuggcccaacaauauuuauuuuuuaaagucacaaucucuugaaaaaguagcacuucauagaauacuagaguucuguggaaccccugcacagggggcucuaauuuuuuuuuuuuuuuuuuuuugagacgaagucuugcucuguugcccaggcuggagugcaguggcccaucucggcucacugcaaccucugccuccuggguucaagcaauucuccugccucagccucccaguuagcugggauuacaggcgcccaccaccaugcccagcuaauuuuuguauuuuuaguagagacgggguuucaccauuuuggucaggcuggucuugaacuccugaccucaggugacccucccgucucggccucccaaagugcugggauuacaggcaugagccagcaugccuggccaggggguucuaauuuuaaaaugcuaauugaugacuuguuuucuuacuuucguaacuggaagugguaugaacuuugauuagauauauagaguguauaucugugagucauuucuguaauuaucuuugucccuucaaguauuuuuuuaaggucaaagagcucaugaauucuuaauaaaugugugaggucuuucuucuuucaucacuguaccuuggaugcugagaagacacaucuagaacaucugauuuaugguguagaaaucauuuuagucaguauugaacccuccaucccccuaacuccaccagcagaaugauaggugaaauacauuccuccaagaccaaaacugcuuugauguuugguguccucucauuaauaccaucauugcugugggcuacauuuggacugcuugcuuuccaaaauaaaaaaauuguaugugguuagagccaagggccaaagauacaucucuagagcuaagaauugcuuuacauuuuugaagguugcuuaaaaguauuuagcagagacuguauauagcccacaaagccuaaaauauuuacuguugggugauuuacagaugaaguuuuacagauaggauauuagagaauccucuaauauaguuauuuucaaaaccaagauuuuauaaaaaucaaaguggaggcugggcaugguggcucauaccuguaauccuagcuuuuugggaggcugaggcgggcaugucaguugaggccaggaguuugagaccagccuggccaaugugguaaaacuccgucucuacuaaaaauagaaaaauuagccaggcauggugguguaugccuguaauaccagcuacucaggaggcugaggcaggagaauuacuugaacccaggaggcagagguugcagugagccgauguggggccacugcacuccagccugagugacagugauacucugucucaaaaaaagaaaaaaaaaaucaaagugugcuguaacuaucuuauguucuuaucaucuuauuaguuauuugacuaaguuuuaaaaaguccaugaaaggacacaugaagucauaguuuaauuuccagcauuuuuucuuucguuuauucaguaaugcuauauucuauagauuuggugaaauguggccuguuuguuucaagauaaauauuaauaaaaagucaacuauuacagagaaagacuaaguacaucucaggcaauaaaaauaucaaaaucaguuacuagaagaagauuuggucuaaagaaaaaagcuauuuauauuugaaaguaaugaaauagcauucaucuaaaauuuuagcaauucaguccuuucacuaauccacauuaaucuucucuucugaugauuuuugaauaagugagaguuucaaguuuucacauaaaugccaauuuuccaucuagguaugcauggaugugggaaaaauuuuuuucccccaauucuuaaggucuugauuccguuuuguaagauuuguauauugccuuuauuauagaggacagaagggucauucuuucaaaguuugguguauuaaaauagauaccguuauuuugguauugauuauuuaauuuccucauaagucaugagaaaacucaaacagccuaguuuaacuagauuuuguaacucuaaauauuugcaaaauauuaccuuaaauauuuaaaauggagaaauaaaaucauacagguauuaagcuauuuuccuucagcuucagacuuacccauugaaacugcuuugcgagguuggagcugagauccuacagacuauauuucucuuuuguaacuaguuuccuguuagauuuugccaauagaugguaccaauggagauaggaaaguaaaagaggagggacaaaggacuuuucuccuuuuuguuugcuucuucuuccuguucaugucuccacagcaacaaagcuucacccugguaggaaaaggaguggcaaaugguuccaguuugcaguuuuuccacacucauaaaaccaucuucaucacauccccucagagaugccagcaucaacuagccauuuccucccucugaaaaaucuggguuccagcuuugcaggguuccccgcuccaagcucuugacacguaguuuucuuuucggaggucuggaucccaguuucauaggguuucuccuucaagccucugaguuuucauaguuccuacgacuucccuuuguuccucucagcucugguauugacaguugcuuuuugcauuuacuaugucugugauacaugucuguccuccuuuuugccuuuucaguucuccaauuuuccugguuagcaacuuuuauuaaauugucuguuaaaauuacagguguaguuucugucucuugacugaacccugccuaauacacuggucagaauacuaggccuuugccagccaaaguccaggagaucacauuaauagcuacugagccucugcaaugugcagagccuuucccuguucuugguauccuguuggaugucuucuguggucccagagcugccuggguauacgucauuaucacacugcauuguugucugcuuuucuguaguguuucucaucuugaggccagugcugaugucuuuugucucucuguccuuaguuccuaacacaggauucauauaaacuaggugagucaugauaaaauuaccugaugaagggagggaucuuauuuugauaauuuuuggcaucuaaaauucuucagaaaaugagauguuuaaaccaaaucuuaaccugguaucaaagauuaugugauacccuccagaagucaccuaccugaggcuugauuagguuuuucuaguucaguuguuaaugagauugaauaugccucauucucacuggcauaucuuaccagcucuuguaaaacuguuccagggaagaauguaaauccaucuaucaagauaccuuucaaaugaucaggccucuucccgucaacccuuccaccuccauuacgcuuguagagugaacccuguuuccuucaauguacuuucuucguuaguaccuaaacguaugcuggauacagggucaugcugagaguuuccaagacuucuagauauuuugauugcaguaugcuuuccucuccauuauuuaguggggucaccuuggccuguauaaaucccacuuccagaucccuucccccaucauagugcauguuauaggcucuugugucauuucugucuuaauaccuuuuaguguagguuaccuuccccuaaguauaauuaaacaaaucuauaauuacuaugucuguuccugcuuuauuuccuuuauaguggagauuuguugacuauagauagcuugaaugucucgguuuacuuuauagggauuuuuagaggaaaaaguaaauauuucuuugaaauuucuauguacuuaucaagggauauagauaauuuguuuucugucuuucagaauuuugauggggauuugguuuaaacuuuaucugcucuuugaguuuuauaguauaaaucuuuuuaagaaauuguguuuauuuuuguuuacucuugaauuuuaauacaucauaguaugcuaauuaauauaguguuugucuccaaaugccaaaauguuaugaaauugugaaaauuguuuagcuauauucuuuuucuugggaauaugauaggaauugcuaccuacuugaaauuaggcauggccaugugaccugauuuagccaaugaaaucugagcaaaaguaauguguaauaccccagauggacacuuugagugaguuuguauagacaguacuuugccacuguuuauccucuugccauaguagcagcuccuucagccuagauccuugaagacuuggagcagagccuccagucagugcucaguggauguauaacaugaaagagaauaaaaucuuuguuauuauaaccuagucaaaucugacugcuacaguugguauuaauuaaugucuucuuuaaaggaacauuuaucaaauaaacacaucucagauaaaaacaguuguucucccaugguguauguaucuucauguuuguccuuagugguuauaauaaucuguauaaauuaugaagagaaucugcuggaaugauuaguaaggugcuuuauuugugggccaaauaguagcagguauuagauacguuggugggccaagaaaugaagggaagccaagaauggagugauacaucuuacaaaagagaccaaauuucauacccgaugacaucaaauuuuauaccuaaugaugucaaauauaggccauuuguuucaggaaaaaaaaaaaaaagccaucugaccagucaguuuuggaaagucaucuguugagaauauacgguuaccuaguggcaggucugggaaaaagaaauucacucuuuugacucuagccauauaucccuuuuuuggggugggguggggugggguggggugggggcgggcacggaggccgagucucaacucuugucacccaggcaggagugcaguggcuugaucucagcucacugcagccuucgccuccugggcucaagcaauucuccugccucagccuccugaguagcugggauuacaggugugugccacaacaccuggcuaccuuuuuuuguauuuuuacuagagaugggguuucaccauguuggccaggcuggucucgaacuccugaccucaggugauccaccugccucagccuuccaaagugcugagauuacagaugugagccaugugcccggccccuguauccuuuuuauuauuaaaauauuugaccuugcacacuuacuaagaaacagguaaauaaauauauguauacauuuuacugucuuaaaaucuacuuuuacuuuuuaauuaugcuauuguuuuuauucuuuuuucccuaaacuuuuuuuuuuuuuuuuuuuuuuuuuuacaaguuugcacagaguucugggcuuaugacaagauccucacuggucccugcauaaucugcauaucuguguguguauguaguuauacagcaauaaaauaauuaauaucuguuaacccaacuucuuauugucaguaacuuaacuuuuuaugugcuuuucuccuugccucucccuaauuuguaacugucaucauaaacuuuauuuuaauccuuuguauuuuuaaaaagcauuauauauaguuuaccuaaacaguaaauauauuguguguuuuuauuuuuauaaaaaauacuaaauguagucuucugggacuucuuuuuguuaaagaucacauuacuaauauuuguccuuguugcaugugguuguaguucauucauuuuuacugcuguauaauaacauucuauucuaugaauuaccguaauuuguuaccuauuaucuggucuguaauagacauuuagguuguuucuaguauuaugcuauuacggacauguugcugugacuauuucuguucauauuuuuggguaaauguguuacaguuucucuuggauauguacccaggauuaaaaucucaggauaccuuucucaggaagaauuugaauuuacuggccuaauauuauuacuaguuaacauuucaccagauaaaauaagcuggauugcucucacagagaagguagggcauguacaacccagagguguaaccucucagugcuugcuuuaucaguuaaaaagguugguuuucaaauggcuagguaggguaauuugaaucucagaauuaucaguagucuacuauaaccuuucuguaguuguacuuugagagacgcauuacuuauaugcacacucacgaccgagaguguucaucacauaacugagauguaaaauaauugccuucucgucucuccuguuuucguuuguuuguuuuuugagacagggucucacuuugucucccagguuggagugcagucacagcucacugcagccuuaaacuccugggcucaagcgauucuccugccucagcuuccuaaguagcuaggacuacaggcacaugacaccacaucuggcuauuuuuaaauuuuuuuuguagaauugagggucucacuguguugccuaggcuagucucaaacuccuggccucgagaugcuccugccucagccucccaaagugcuggaauuauagccaugagccacagugccuggccugagcuuccuuuuaaugggcuuuuuccccuuuuguauauaaccauuuguauaucaaaaugaggcacuaucucaagugguuacaguugcucucuugguucuauucugaguaagaccauuauuaucaaaagcaucagaugacauuucuaauagaucacuaucugaauucucugaaacugaacagcuguuuaaaacaaaugcccuuucuguggggauuuaucaucugcaaaucaauuuauuauucaugauggaaguaucuacauuccgagugacauuuaaaucagauuuuauauuuugaauuuuaauuuauugcccagcagacaauguauacaaaaauauguuuaaagaaaauaaugaaaauaaguuucaguugaaaaauauuaucuugugaaagucagagggaucugggggauuauuuauacaaaugaugguguugagaaacaaccuuaauaaaccuguuugaagcuucucagcuacugguuauuuuugucuaaguucuuacugaacucaggagguaauggcugguaucauuucauguagggguuccaauauagugaacuauaaugucuugaucucuacaagcuuaauaaaggcagccaauuaaauuuuaagacuuagcacaguggcucaugccuguaaucuuagcacuuuaggaggcccaggugggaggauugcuugaguucaggaguucaaaacuccaucucuacaaaaacaaauauuagcuaggugugauggugcauaccuguaagucccagcgacuuggggggcugaggcaaaaggauugcuugagccugggcaacagaggcuucagugagccaugaucccguuacugcacuccagccugggugacaaagugagauccugucucaaaauaaauaaauuuuauauauguugucacauggcucaaacaguuuucauguaaaguucacuuugaguaugugggcuauuauuugaauuuuuggccuuugaaauaauuaugaaaacauucaucguuauuauccuggaguuucacucauuugcagaauaacuucauucugaaaaugauauaacaccucccaagacuaaguaauauuaacagaguuaauauuuuaucuuuuugcccuuaaugccuccuauauugcuggggacaugauagggccugugugugaauguuuguugaaaugaaugaauaauacuuuuuaauauauaggagaaaaccuaagcacagcaguuugugugagacagugaucagaaacuuugccaguuaauagauugacuucaaucagggagacagagccuaagucaaaaaaaugacuaaucucuaguacuauguuaguauuugcuaucauuccuucauucuguagguauuuaugagcaccuguugagugucaggauuuguucuaaaugcugaggauacaauaaugagcaaaauauauuaauucccuguucuuaaggagaccacauucuaguggagggaaucgacaauagaccaauauaugccgggcacguuggcucacgccuguaaucccagcacuuugggaggcugaggugggcggaucacaaggucaagaggcggagaccauccucgccaacauggugaaacccugucucuacuaaaaauacagaaaaaauuagguggacaugguagcgcgugccuguagucccagcuacucuggaggcugaggcaggagaaucgcuugaacccgggaggcaggggcugcagugagcugagaucgugccauuacacuccagacugcacaacagagugagacuccaucuccaaaaaaaaaaaaaaaaaaaaaaacccaauguagaauguuagacagcaagacuguggagaaaauuaaagcaguuaaggggaauagaguguuagcugcguguagaguucucacuguuuuguacaaggugaccagggaagugauauuugaguagaaccuaaaaggaaauaaggaaaugagccauuaacaucuggagaaaaugcauuccaagcagaggaagggcaagugcaaaaaaagagacagcugcuauaguggaauggguaggagcagaauggcagaaaacgagguuaaaaaggagaugggcaggccauuuaugaggcuuaucaggaccucauaaaccauuuaagaacuuugaguuuaacaguuuaguaagugccagucauuguaggguuuugaagaagagugauuauguuauuuaugauuuaauauguuugcucuggcugcuguauagaaauacacuaugggcaguggggcagggagggcagagguguugcggugggagcaguaagacgaguuaggaugcucgaaauuuuuuucuuaagaguuggggucucacucugauucccaggcuggagugcagugaugagaucacagcucauugcagucucaaacuucugggcucaaguaauccuccugucucagccuccugaguagcuggaacuucagacaugugccacccugccuggcuaauuuuuaauuuuuuuuccuaagaggaggggucucacuauguugccaaggcuggucuuggaacucuuggccucaaacagcucucccgccucagccucucgagucacugggauuacagaugugagccaccaugcccaguuggaugcucuaaacauuaaauucuaagcaaagagaugaugaggcugggcuuggaucaggauuugagcaguucaugugaucagacuugauacauuuugaaggcuuuggugaugcauugauuguggaaugugagaaaaggaaagacagagcaaauguuagacuauaguuaccauccauuuacugccauggugaagacugcaagaggagcagaguuugaaggaguagagauacacgugcuauuuucuugcugaaaucugucucaugcuagauuuuaauucuucaguaguuagcagguaagagaguugcuuccuaacucuggaaauuugcuacuguggaaagaaaauugaguugggaucccuaaggugaaauuuuaagaccugacucucucacuuucagagacuuggccagaucacuucacuuuuuugagccucuucaggcucuguuucuuuaaucauaaaauaaauugcuuggcccagguugucucuaauguuucuucacuugucagaauugaugucucuauccauucuguuuggaacuggguugauuacacuuugcccuugucuacuuguuaacuuuaaguauucgucaaguuucugaccuucccucuuauuacacauacccuuucuggcuucaguugguuuuauauaagugcagcucucagacucacacuuuaaacauugacuuuuuuucugaguucuagauuaaauuuguuccaauagguucaauccuuaauuuacuuuuuucccccaaacuuacuuccugugcucagcaauuaguaauuuugauuaugguuacuauuauuacuaguuauuaccuuucuuauugaauuauuaauguucuguuugcuaagauagguuaauugaaauucagcuugggaaacuaaccuagcaaaucucacagugugauuugugauccugagacccuuucagaaagcccacaaggucaaaacuuaauuuuucauaauacuaaaauauuuguacccgcgcccccccccgccaccuuuuaaacucuguugacauuugcucuggugguacauaugcaguguguguaaaacuucuggcuccuuauuucaaaauaauggcaguggcauucuuuacuucacacauacagggaaagaaacagaaacaguuucacuuaagaauguucuugaugaagaaguaaaauguauuaauuuuauuaaaucucaccaugucugucuuaaugucugugugaugaaacccaaagcauaagacauuucugcuacauaguauagccauacaauggaauaguaaacauccauuuagaaagaugacguauagcuacauuuauuuauauaaauggaucuccaugaaauaguugaggggaaguagcugaaauguaauacuucaugggaaaacagccuaugaaacagcauguauggccugauggaauucaugugaauguauuuauauauguuuuuuggaacauuagguuuuguaaaguguuaaaagugucauugauauuacauggccaaauauauuuggagugucaguaauacuuauuaguauaugaagucucugcaaaauuuuauaguuuuucuacuuuauuugauuuagcuuuccagauuugaccaaacuauuaauaguagugggacaggugguuucuauguuguaugaauucuguacaccacuuuuaauaccuuuauauggaaaaacaaacaguauuuauuaccaaaaaccugugucugauccaauuaaacuauuucauaaacucuaauacuuuaaaaaauugucaucuauuugaguagcaaaauagccauaauuugaaauguugucacugaaagacuucauauuacaucuuugcucuugauuaugggucacauuuuucuguuucuuggucucugauuuuuuauuugcugucagacauugugaaaaaggacaguacagacugaaguauucugucaggucacuaguguuaggggcugagucaguucaguuugggaugggaccuuguugcaguuuuaguugucuuuaguuuaccacugguaucagauguugugaaggcaggaugaggacacucccuuuauuagaguuugccaucugaguaccugugagauucaggcaaucucgccauccuuuauagcccaccccagccuuuauagcccaguuuguuguacugugggagaucccucucuguuucacagcacagcuguuggcauuuggagcagcugggacauguuuuuuuuuuuucucucucucuagccccacuucuggcuucgguccuuaccucuggagagagcacugaacuaauacccugccaccuuccuuuggccaccuuacacuuagugugccacuugaacagggguuucucucagcucuucugccuuguccucagcauucuguggucccaucgccucaccuucccuuauucagcuucaauacuuggaagggauccuauugggaaagugcagauuugcuuugugaaugagauuucugagauuuuaaucuaucuugcccccguguuccccuugaaaagucuguuaaaaguuggcugguuucccccuccuauugcagguucacuucuccuuucaccaugaucccagcccuguuuucuuuuccagaaagggcuuguuccucuagaauuuaguugauuuauuuucuuugcauccucagcuuucugaguuuaaaaaacuaugauuuuauaguuugucuggcucauucuuacuguuaagcugggagcaacaacagucuuuugugagcgucuauaucauaaccauaaagcgcuaauccugauauauucuguuguguucagcauaauugguauaggucauauugaaauuauuuagccaauuauuucaguaaagcuccacucaaaugaaauauugaccauauuuaggcuugauggaaaacugauauaaaugccugcuaacacgacaguuaaaauguuuuuauugugauaaaauauacaaaacaaaauuugccauuuuaguuauuuuuaagcauaaaguucaacgacaauuaagauugaaauuuuguguaaccaucacaacuauuucuagagcuuuuucauguaaguagaaucauauaauauuuguccuuuugugucugacuuaguucccuuagcauaauguucucaaggcucaucuguguuguagcauaugucagaacuucauuuguuuuuauggcaucguauguauaugccacauuuuguuuauccguugauuggcaguuuguuuucaccuuuuggcuguugugaauaaugcugccauuaacauugguguacaaguaucuguuugagucccuguuuucaguuuuuuuuuuuuugguauaucccuaggaguagaguugcugggucauaugauuauucuguguuuaguuuuuugaggaacuaccaguuuuucacaauggcuacaccauuuuacaguugcaucaguguuccaguuuguccacauccucacugacacugcuuucuguuugauaguagccauccuaguggguaugaggugguaucucauagugguuuugguuugcauuucuccaaugaguaauaauguugagcaucuuuuuaugugcuuauaggccauugguauaucuuuggugcgauguacauucaagaccuuuacccauuuuuaaauuggguguuuguuuuuugcuguugaguuguagcaguucuuucuggauauuaaacucuugucagauauaugauuugcaaguauuuuaacccauucuguggguuguuucacucucuuuacuaucauuuuaaauuuaaaguccaauaugucuguuuuugggggucuuuuuuguuguugccugugccuuuggugucauauuuaagaaaucauugugaaauccaauaucaggaauauuucuucuaagaguuuuacaguuuuaacucuuauauuuaggccuuugauucauuuucaguuaacucuuguauaugguguaagguaaugguccaguuucacucuuuugcaugaaaacauccaguuuucccagcaccauuugcuaaauaaacugcucccucccuauugaaugguccugguaccuuugucaaaaaucaggugugagagucuguguuuggguucucaauucuauucuguuggucuauauauaucuauucuuaugucaauaccauaauguuuugauuauuguagcuuuuuaucuuuuuauuaggucuugaaauggggacacauaagaccuccaccuuuguucuucuaguucaaaacuauucaagguuccuuggaauuccauauaaauuuuaagauaucgucguugucuugcuuuuuuuuuuuuuuuaaauuugagacaggaucccacuaucacccaggcuggagugcaguggcauaaucauagcucacuguaaaccggaacaaauuuuagaccauguucuuuuucugcaaaagagcaccauugaaauuuugauagagauugcauuaaaccuguagaucauuuggauaauguugacaucauauuaagucuuccaauccaugacuaugggauauacuuucauuuauuuagguuucuuuaauuuuauucaacaauauuuuguaauuuucagcauauaagucuaucacugcauugguuaaauuuauuccuaaguauuuuacuguuuuugaugcuauucuaaauggauucuuuuuaaaauuucccuuucauauaguucauugcuaaccuauagaaauacaacugauuucaucauggcaguuuucuuucuacaucuuaaggaaauuaguuuauuagcucuaaugggguuuuauuuguggauucuuuaagguuuucuucauauaagaucaugucaucucuaaauagggauaguuuuauuuuuucauuuccuauuuggcugccuuauauuucuuuuucuugccuaauuguucugacuagaacuuccagcacgguauugaauagaaguggugaaagcaggcaucuuugucuuguuuuuuaucuuaagagaaaagcuuucagucuuucaccauugaauacgauauuagcugugaguuuuuauauauggccuuuucauguugaggaaauuccuuucucuuuuguuuauugagugauuuuaucaugaaaggguguugaauuuuguaaaauccuuuuuuuuuuuuuuuuugcuaaaucaauugagaaguucaugugguuuaucuucauuuugcuaaugugauguauuacauuaguugauuuucuuuuuuuuugagacaggguuuugcucuuguugcccagacuggagugcaauggcccaaucucggcucauugcaaccucccccuccuggguuuaagcgauucucccgccucaaccuccuaaguagcugggauuacaggcaugcgccaccaugcccggcuaauuuuguauuuuuaguagagacgggguuucaccauguuguccaggcuggucuccaacgccugaccucaggugaucuaccugccuuagccucccaaaguucugagauuaugggcgugagccacugcgccuggcuacauuaauugauuuucuuauguugaaccaccgucgcauucuugagacaaauccugguucauuauauacccauuugguauaaucuuuuuaauaagcugccgaauucaauuuguuaguauuuucuuaaggauuuuugcaucuauauuuauaaaggauacugacuuguaaaauuuucuuuucuuacgaugucuuuguuuggcuuuggugucaggguaauguuggccuuauagaagucaagaaguguuacccccucuucaguuguuuaggaauagguuguuaauucaucuuuaaauguuugguagacuuuaccaguaaagucaucugguccugggcuuuuuugguuggaaguguuuuauacugauugucagcucacuucuuagguauauuuugguugucucuuucuucuugugaguuuugcugguuuguguguuuguaagaguuugucuauuucauuaagcuauccaauuuguuagcauauaauuguucauagcauucuuuuauaauccguuuuauuucuguauaauugguagugauguuuccacuuucugauuuuagucauuugaguguaaucucuucuuguuagucagucuagcuaaaaauuuauuuuguugauuuuuuuuuucuuuuuuguuuuuuuuuuuuuuuuuuugagacagagucucgcuguguugcccaggcugcagugcaguggcacgaccucggcucgcugcaaccuccaccucccagguugaagcaguucuccugccucagccucccaaguagcugagauuacagguacuugccuugacguccagcuaauuuuuguauuuuaguagagaugggguuucaccauguuggcuaggcuggucucaaacuccugaccucaggugguccacccacgucagccucccugugcccagccuauuuuguugaucuuuuaaagaaccaacuuucuguuuuguuuuuucucuauucuuuuucuauucucuauuuuguuuaucuccaauuuggacuuuauuauuuucuucuuucugcuagcuuugaguuuuguuugauguucuuuuucuaauucuauaaaguguaccguuagguuauugagcucuuuuaauguaagcuuuuauagcuauaaacauccucuuuacacuucuuuagcuacaucucauaugcuuauguauguuguguuuuuguuuucauuugcaugagggucuuuuuuauaucucuugugguuucuucuuugaucaguugcuuguuugagaauauguugcuuaauuuccacauaugcacaaauuuuccgguuuuccuucuguuucugauuuuuaguuucauuccauuuugauuggaaaagagcuuuuuaugauuuuaguuuuuuaaaguuuauuaagacuuguuuuauggccugccuuauggccuguccuggagaauguuccauaugcgcuugaagaguguguauucugcuuguuagguggaguguacuauguauaucugauaggucuaauacaauagguauauagugcuguucaaguccuauauuucuuuccuccccuuccccuccccuccccuccccucccuuccccucccuuccccucccuuccccucccuuccccuccccuccccucccuucccuuccccuuucugugagacagagucucacucugucguccaggcuggagugugauccuggcucacuucaacucugccucccaacuucaagcaauucuccugucucagcuuccugaguagcugggauuaccggcaugcaccaccacaccuggcuagcuucuuuuguauuuuuaguaaagacgaguucucaccauguuggccaggcugguuugaaacuccugaccucaggugaucugcccgccucugccuccuaaaguguugggauuacaggcaugagccaccacacccagccacguccuguauuucuuuauaaaucugucugguucuucuguccaguacuuaaaauaggauauugaagucuccaucuauuauuguagaguugucuguuucuccuuucaauucuguuuuugcuuaauauauuuuuagucucuguuuuuagguguguaaacguuuauaauugauauagcuuaauguaucgaaccccuuauaauauaugauggccuucgugucuuguuaucauacucuguuuugucugacaaaaacauagcuacacuugcucuuuuuugguuacuauuugcauggaauauuuuuuccuauccuuucacuuucaguuucuuagugucuuuguauccaaagugcuucucucucuuuuuuuuuuuugagacagagucucccucccucaccaggcuggagugcgguggugugaucucggcucacugcaaccucugccucuuggguucaagugauucuucugcuucagccuccugaguagcugggacuacaggcaccugccaccaugcccagcuaauuuuuguauauuuaguagagauggaguuucaccauguuggccaggauggucuugaucucuugaucucaugauccacuuguguugcccuccaaaagugcuaggauuacaggcgugagccaccaugcccggccuuuuuuuuaguggaguuuugcucuuguugcccaggcuggagugcagugguggaaucuuggcucacugcaagcugcgcuucucggauucaagcaguuuuccugccucagccuccugaauagcugggauuauaggugcacgccacuacgccuggcuaauuuuauuuauuuauuuauuuauuuuuugagauagagucucacucugucacccaggcuggagugcaguggcaugaucucagcuuacugcaaccuccaccucccagguucaagugauucuccugccucggccucccgaguagcugggacuacaggcgugugccaccaugcccggcuguuuuuuaguauuuuuaguagagaugggguuucaccauguuggccaggcuggucuugaucuccugaccuugugaucugcccgccuccgccuuccaaagugcugggauuacaggcgugagccacugcaccuggccaauuuuuguguuuuuaguagaaaugggauuucaccauguuggccaggcuggucuugaacuccugaccucacacgauccacccacuucccaaaguccugggauuacagguaugagccacugcacccggucucuuauagacagcauuuagguggauuggguuuuuaaaaaauccagucugacaaucucugccuuuuaauugaagaguuuaauucauuuacauuuaaaauacugauaaggaagaacuaauuuuucuaguuagcuauuguuuucuguaugucuuauuuguuucuaacuccuuaauuuuuuuauuuuugcccuuuuauugcacuuugcuaauuuuuaaaauagcauaccauucuaauuccuuuguuuuuuuucuuuucuguaauauuuuauaguuaguuuuuuagugguuaccuugaggauuauaguuaacaucuuaaaaugauaguaaccucauuugaauaauaccaacuuaguaguauauaaauagucugcuccuguauaucucugucucuucccuuuuauauuguuauugucacagauuaccuuuuuauauuuuaugugcccagcagcagauuuauaauuuuuuuuaccuuuuaagauaaaugcaaaucaaaaucacaaugagauaacaucucacaccagucgaauggcgauuacuaaaaugucaagaaacaacagauacuggcaagguugcggagaaauagggaugcuuuuacacuguuggugggaauguaaauuaguucaaccauuguggaagacaguguggcgauuccucaaagauuuagaaccagaaauaccauuugaccagcaaucccauuacuggguauauacccaaaggaauauaaaucauucuguuacaaagauacaugcauguguauguucauugcagcacuauucacaacagcaaagacauggaaucaacccaaaugcccaucauugauagacuggauaaagaagaugugguacauggacaccauggaauacuauucagccacaaaaaggaaugagaucauguccuuugcagggacaugguuaaggcuggaaaccauuaugcucagcaaacuaacacagaaacagaaaaccaaacaccucauguucugacuuauaagugggaggugaacagugagaacauauggaaacagggagggaaacaacacuuaacugaggccugucggaggagggcagggguagggagagcauuagggaaaagagcuaaugcauguuggccuuaauaccuaggugauggguuaagugcagcacaccaccauggcacauguuuaccuauguaacaagccugcucaucuugcacauauaccccagaacuucaaaaacaacaacaauaaaauaauuaaaaaaacaagaaaagcaaaaaguuaaaaaccaaaagugcguuaauacucucuuuuauaauuaccuguguaauuaccuuuaccaguguuaugucuuacguccuuucauuauagccugaagguuucccuuuaucuuucuuguagaguaggucuacugguaacauacuuccuuggcuuuuaucuggaaauuucuccuucauucuuaaaggauaguuuugcugaauauaaaauucuugguugacuuuuuguuuucucucuggauuuaaaauaugccguuccuauugcugccuggucaucacaguuuaugaugacacaucagcuguuaaucuuacugaagagcccauguauaugucuaguugcuuuucucuugcugcuuucaagauacuuuauuugucuuuggguuucuacacuuuggauauaaugugucugaauauuguaucuccuuugaauuuauucuuggauuuauuugaaauuuuuggauguauguauucaugucuuucaucagcuuugagaagcuuuucaccguuauuucuucaaauauuucccccuuucuuuuaucuuugggggcuccuaugcuguguagguggguacacuugauagugucccuguccgguagguucaucaggcucuauucauuuuucuucauucuuuuuucuuuguaucccuaagacuggauaauuuuaauugccuugucuucaaauuugcuaaucauuuuuucugccuguucaaaucuguugaaccacucuagugaauuuuuaaauuguaguuauuguaauuuuuagcuuuggaauuuuuguuugauuccauuuuauaauuucagucucuuuacugauauucuuguuuugcucauacauuguuuuccugauuuccuucagcucuuugaguauauuuaggacaguugauuuaacauuuuugacuagcaauuccaaauucugugcugcuucagguuucugucaaaugcuuuuuuucuuaaugggccaugcuuuccuguuugugugcuuugugguuauuuguugagaccuagccacuguaguacaaugugguaacugugguuaucagauucucccacucaucaggccuuucuuggcuaguugaaggcuguugucaucccuuugugacuuuccaaaaccauuuuugcaaacuguguauuucuuguguguauagucacugaaguuucuauuacauuaucucuguaguaagucagugaccugacaaugauauaacaauaucugguuuaaagaagaaggugcugucuuauuagaucuuccaguagaugcaggugcgccuccccugcccgguagccccagagggccuaaauaaaggcaagcaucugccucugugccugucucucagugaucugccaaacugaccaaaauauucaaacuugaauuuuuggaggacaaaauucucccacugccugcuauggcacuaauaagucgcuccagagaugggggcugcuauuccuuacuguuguggcaaagcugagaaauggggaaugguagcuacugguuugcccaugugagucaagaucagcagccucugcaugaagcacuuuccugguuguuuuuagugucuaauuagguuccauacuuggaagauaguugauucuuguuguuuuuccaguuuacugguuguuuuugguacaagaaccaagcucuagagcauucuucucugacauuuuacaccucaagugucauaauaaacuaauauugucuuucuuaugguauuuuugaauggaggaaaaucuuugguacauuucuuuuuuucuaguuuguguguuucacuauucauacuaucaaaagaaaagaaucagccucagauuugaacacaucaaggauuaauuuuuuuuuuuaagacagaguuucucucuuguuggcccaggcuggagugcaauggcacaaucuuggcucacugcagucucugccuccuggguucaagcgauucuccugcggcagccucccgaguagcugggauuacagcaugcaccaccacacccagcuaauuuuauauuuuuaguagagacgggguuucuccauguugaucaggcggucuugaacucccaaccucaggugauccgccugccuuggccucccaaauugcugagauuacagucgugagccaccacacuuggccaaggauuaaaaauuuuaaguguuuguauaaaaaaccuauagcaugauugaaauuuuaauucagugcucugucaguguuuuguacaaucacuucaugguuuuguuuguuuguuuguuuguuugacauggcaucuugcucugucaccugggcuggagugcaguggcaugaucuuagcucauugcaaccuccaccucccagguucaagcgauucuucugccucagccucccaaguagcugggauuacaggugcacaccaccacgccuggcuaauuuuuguauuuuacuuuguguuuuaugcaaauaacaacauugucucuaaugaaaaaaguuuaaguuuuaaacacugguuauuccucauucuguaugauuagcuuacauguccuagaguguguuggguauuugucauggcuuaauuauuguggggaaaauaacagaauauuugcuuacaugccacuuaaugaguucacuuuuuuuacaguaguuuuuauuuauagucaucguugcugaaaauguuaugaagaaauaaaucugucuuuaucucuguuugauauuucagaaagacugacaaaagcaacauuacguggaauaaucuuaguuucccaauaaauccuagauuuuauucuucacaauacuugauuuguucuacguguauguuuugcuuauuuaccuaaaggaaagucauuuagucauuuaaaaacaauauuuagccuuuucuuuaauauuuugcaauuauuaacaaaaaauuguuuuaagaauauuucaaaaacauaaacaguggauugccacucuaauaaguccuuuuauauuagaguagcuugacuauaaggugaaauuguaugcaaagaguuucuuacugcaagugcugagaaaaccacacuauaacaccauuuuuacaaguaaagacucauacuagaacaucuaguuugggaguauuuuuagcuguuaucuucuuuuaaaacaguguaugguaugcauauuuuucuauuccuaaggcccaaacugaguuggcauucuagaaucauuaucuauauuccuuaaguaaauagaauucuuaccuuuccuuaauuguauagcagauaauccaagaacaaguuuagcccaaggcgaaguaagauaauucauuauauuugcauguuccuuuuauguacuuauuguugauaacugauuuuugaacauuuucaacugucuuuaaauggagaguuauaugcugucauucuguaacccuuuacugcccuuuuaccguuuuaaauuugaucuaaguauuacaaaaagcuagaaguguuuuugacaucuagaaaaacauuaguuuugcaguacacacacguacauauaugagacguguguguguguguguguguguguguauguauaugauaagugcuaugaguaaaaacuaaggauagaggaauagagucagaaaagggcccucugaagaaugacauuuacacugaaaugugaauauuuagucauuuaccauuaagucacacuguuuaaucuaucuuaauauucauagaaacaauagcguaggaugauggccuccagauucauccauuuauucuaagcaaacuaauguaggaacagaaaaccaaauacuacauguucucacucauaagugggagcuaagcaaugagaacgcauggacacaaagaggggaucaacagacaccggggccuacuugagggugaagauuggaggagggagaggauaaaaaaacuaccuauuggguacuauacguacuacuuuggugacagaauaaucugcacagcaaacccccauauaugcaguuuaccucuauaacaaacauguucauguacuccugagcauaaaaguuaaaaaaagaaaugauaguguaaagaucuucauaaucucaaaaauuuuuauuaaacugauaaaauauuuuaaccaaacucuugaguguuccaauuuuagauaaucaguaauuuagcacugcccuauuauaguaaauauuaaagauuaaccuuaaagccaguguaaguaguaguuuuuaugucacaaaagguguuuuuaguuuagcauaugugccuuuguucucagcuaacgaaaaaaguugauaugcacaguucuacuuaaagauaauuagaaaugucagggaaccuauuucauuugggaauauuuuuucuuuaauaaugaucuaggcugugguaaugaaauucuuuauuaucuguguuuacaaaucauuguaacuuaauuaaaauuuuacaauuauaccacagauuaaaaauaggaacaauuugaagaugugauuuuauuugaaaauuuuauaguaagguuuagcuuuauaaguauuuuucucuugcuuuuaugaauuagaaauaucuuucuuacuccugacagaauauaaaauaaguauaguuaaaauuacuuuauagaccaggauuuucuucacucuuugaugaugaaauaagugccaugcguauuauucugaguuagaagcgcauagaauguccccugauacauuguucaaaugcacuauaugaagaaaagguuaagguuuaugugauucuauuuuuuucucuuagacucucuuaaaaccaugcugacauagagcauauaaaaugcucuaugucagcauuguccaguagaaauguaaugugcaccccauauguaauuuuuaagauuuuuguaggcauauuuuuugaaaacuuuuuaaaaggcagaguuaauuuuggugauuuuuuuacuuaaacaucuaaaauauuuuucaacauuauuuuauuuuauuuuauugauugauugauugagacagagucucugucacccaggcuggagugcagugacacgauccuagcucacugcaaccucugcccccugggaucaagugauucuuaugccucagcccaaguagcuaggauuacaggcgugcaccaccaugccuggcuaauuuuuauauuuuuaguagagacagaguuuugccauguugaccaggcugaucuugaacucccggccucaagugauccgcucaccucggccucucaaagugcugggauuacaggcaugagacacugcgcuuggcccucaacauguuauuaauauaauaguuauuaacuuuuuuuuggugagggauaauaaauguuauugucugaagccacuaagguuuuuuuuuuuaauuuuuaaaaaaguuguaaaauacacauagcaaaauucacuaucuuuaccauuuuuaagugcaguucagugguauuuauuucauauuguucugcaucuaucaccauuuuccaucuccagaauucauuucaucuugcaagauguaaacucuguacccauuaaagaauaacuucccauuccuguccuucccccagccccuggcaaccaaaguccacuguguauuuuacagcugcagcacaacucaguuuggacuacguacuuuucaagugcuuauuagccugcuguuggcuacaguuuuggauagcucaguucugugcuguaauagauacugaauccauuuauaguuacucuguguuacagaauguuacuguuauaugaauuaauucuguaauaacauuucuauaauacuuuguuauuuuuguccuuauuugucauccagaacaauaggcaggucccguggucagcaaaauagcaaaagggucauucaaaaaugguguggcaagauucugaaguggugaugucuguauagucggauaaugcaacuguaaaauacacaguggacuuugguugccaggggcugggggaaggacaggaaugggaauuuauucuuuaauggguacagaguuuacaucuugcaagaugaaaugaauucuggagauggaaaauggugguagaugcagaacaauaugaaauaaauaccacugaaacugcacuuaaaaaugguaaagauagugaauuuuguuauguguauuuuacaacuuuuuuaaaaauuaaaaaaaaaaaaaccuuaguggcuucagacaauaacauuuauuaucgcucaccaaaaaaaaaguuaauaacuauuauauuaauaacauguugagggccaagcgcagugucucaugccuguaaucccagcacuuugagaggccgaggugagcggaucacuugaggccgggaguucaagaucagccuggucaacauggcaaaacuccaucucuacuaaaaauacaaaaauuagugacuagaugccuguguuugaaaaaguuggaguccgaaauguugguaguuaugagcuaccaucucuuaggacuuuuugcuggggcacguagauuucuuggagugugcguugggaauccccaagaccaacccaucaugcuugaugauuugcucgaaggacucauagaacuuaagagaaaagcuguuaaacucaugguuaugauuuguuauggcuaaaagaugcagaugaaaaucaacaaagggaaaagguauguagcuugaaguccaagaggauccagaugugagcuuucauuugccuucuuccaguggaguugcaugggcuaugacaacaugcaaagagcuucaaccagggaaguucaccugagucuuguugugcaagaaaauuacuguggaucuauuagauaggcauggagugcucauaugacugacuuuaguuacucagucuccagccucuccugcagguccuuccucaccuaagaaaucaaacugauauagugugggccagagccccaggcauacaaaaacaagcauuaaccauaauucauauuguuuauauagauuaccugauaugauccaaggugucaguuauguagagacacucuuaucaggcaggauauuccaagggcucggagguuaucucccaggagccucucacagacuagugcuuuuuucagaaugugcagaguuagaguaccccaagccucccuaguuauuucuugacugcacaggaugauuugggagccuaacaaaggaagaugucucuaguguaaaguaguguaaagucuuacagaaacaaaggguagaugagaguggcaauagcucaguacaacuuaaauaucuaguguguuuaaacaaauggcaugaguuacugacugucaagguagagcuauaaagguugacuaucagaaguaaagaauagcauuuagaguaacccuacaauuaacagguuucuuaauuggaaugaacuucaugguuuacuuucuccuuugcuugggaagugcauauauuaucucaucuaauccacaucaaaaccuccauuucugccuaugauggaguaacuuguaacagacuaaaacugcugaaaacuagaaaugcuaggggaaaaaaucauuuugaaggcauuguaaagcuucucagugaaucaacacuugaagagucaagauucaggagagaagggagacagacacacucugugcugguuuuccucuugauccauuuuccagcucuuaagcuauuggggguaagaagauaaaagcugagcaaggcauaagagaugagcaaaaaacgacugaggaaguugaauggagcuuucaauaguuuguuguggugguguucuggcccuagugaagagccacaccauagagugaggacaaaucagaggccuaccuaucuuuguagugucugaaacucagucucaagucagcucagucccaauuggauugcaucagucugcuccuacagagacuguuaaaaaaaauaaaaauuaaauccuuucuggaggaagguaacaucaucuggaggcucuacguuuuuuccguauacauaugcauaugauaacucacaaugucuuacauacaauaaaaaauuacuaagcauacaaaaagaucaagagaagaaaauugacaagagaaacagauugauagauuguucagacuuuggaguuaaaagcaggggcuuuaaaauacuguauucgguucaugaaaauagaugcugagguggagaauuucacuagagaacuggcaucugcaggaaggagucaaauggaaauucuagagcugaaaaauauaguaacuaaaacuaagagcacaacagauggguuuaacugcagauuagacacagcugaaaagaggauuugugaacuggaggauacguuaguagaaaacauuaggcauaaacucgacuuuaaacugagcuaaggaauagaaacuuuucaauaucucaccaaaguaugucucuuauuuuagagcaugugggugaaaagaguccuuauuaaagugcagucgcaacucuugcuauuuuaauguguauuuaguauuuuuugguauuuuuauuuuaguggauuuuuaaaaaauuauuaaaaaacauuauuuaagagagcaucuuauucugucacucaggcuggagugcaguggcacauuuguagcucacugcagccucaaauucaugggcucaaagugauccucccaccccagucuccugaguagcugggcauacaggcagaugccaccaugccuggcuaauuuucuuuguuuuuuucaguagagacaaauucucgcuguuuuccaggcuggucuuaaccuccugaccccaagagauccuccugccuuggccucccaauaugccaggauuacaagcaugagcuacuaugcccagcugguuucuauuuuaaaauauaauaugaaaguaguaaaauauaaaauuauuacuuauguuuauuugugauaccuccccccccagcuuuuaagcaaaaauaaauuauucuguaacuaauaugcauagauuaccuguucaguaaacucaguuacuuagaauaaauccuuagaaugagaaaauaagcaaaacauuuacagcuauaaaauagauaucuggagcuggaugguaaaaccccuguacuuuaauauagaggaguuguacggcccuuacucuugguugguugggauaaugguuauagugugcauggcaaucugguaagccagcucaucauagaaauaccaaguuagaaaggaaauugugggucaagaauuuggguuuggcauaaguaccuuguuucaucauauccaagacucuacuaugaauuauaccauuaauuuauguaccuguaagaaaaaauacugucaguuacauuuugacaucacauuaauugugagauacauucugauuucaaagauguuaaagugugaaggaaaaaguaaaugguaauucugguuuuaaaucucaguucugucauuuauuuguuugacaugagucagggaacuucuuugagcacguuuccucaugugugaaaaugggauaguauacuuuaccuuucagaauuaggaagacacaauuagagauaugaaagugucugcuguguggcaggcauucaguacccgcuaauuuggcuuucguuucuuccuucuaaagcuugguucucuuaggaugaaagagacacuugaaagccuaacaaguaaaaacaaaaccaaacucuaauguacuggcuguguaagagcguaaaaaggaaaauuucuuguuggagcuguuuaauugucaaacauuguucuuugucuuccuccauuaccucacccgccucccuguuauaucugaagauaucacuggcugguuccaauauaaugauugauauuuauguuauggaaccuaagcaucaaaauaauauugauauuuuacuauaaugguuuuuaaaauacacauuuuaagaaaauuuccaauccuucuaaacuuauuugugaugcuuaaagucccacucuuuaguuacauggaauuccugcucuucugaugaugccaaauaaauacagcauuauucggaguaggugaaucuuuuuaaaaaagggguuggauuuggugauguuuggcagaagugagaauuccucauuauauuccuauuuuaaagauuuccaguaaacccaggcgguauuuuucuucagugguaaaauauuuauagcuuuaguuuuguguuuauucuuuucuuucaggauuuuucaagccacauucaauugauaggaugaaaaaauuuaagagaaggcuaucccucacacuccgaggaagucagacuauugaugaaucauugucugaauuggcugaacaaaugacuauugaagaaaacagcagcaaggauaaugguaaauauuuggcauagggggagaugcuuccuccuuuuaauuacuuuaugaauagaauguaaauuuacuuuuuagauaaguucauaauagcuucccuuuguuuauuucugucucauuccaugguuucuuaggaaauugaagacuauauaacuuuuguuugguuacuaacuggaauauuucccucucacuccaacauuacgauaccuggucucaaacccugaugaauuguucuauuccacauauccuuccauuuuucacuaguucuuaaagaagaaugcauuuuauaauauuaucuugauuguuaaauaacuauuaauuuuuuuuauucuuauaacccaaguuaauacagcuuaaaagugcauaggaagucugugaaauuucuguuuguggcuucaucaguuucauaauguuucaugcauuugacagugcuuuuuacaacauaaaguaguaguauccagauguuaaaauaaaaagagcuuguuaaguguguuaaauacaaaauccuggugaaauuucuagaggaaggcuacauauucaaaucugaaauagcccuagggaugucauaguaguaacugggaaggaacuuacgugacuggcuuucagugugucaugaugugcagaguaucuggcagaucuuccuuaccugugccugaaauucugcuguuagagauuuguggcaguggcuggaaagcauggacacccuuaccccuuccacuagaaugcacauacuuauguuuugagagaggaaaagguauaguggagugggcucuggacuuuuuaaagucauagguuuggauuuuggauacacuuaaacacuuccuaguugaugacuggcuaagccguuuauucuacccaggcuucaguuuucuuauuuccuuuacucagaagggucauuauuugcucaagguuacccagcuccagaaccaguacuuuagaacccagguuucuucacuucagagucuauaacaaugcuacuguucugcaaggacccuuucauucauuuguuaagguuuuccuugauaacaucuaccuuuuuuuuuuuuuuuugagacagucucgcucugcugcccaggcuggagugcaguggcacaauguuggcucacugcaaccuccaccuccuggguucaagugauucuccugccucagccuccugagcagcugggauuacaggcaugggccaccaugcccagcuaaguuuuuuauuauuuuuaguagggaugggguugggguuucaccauguugaccaggcuagucuugaacuccugaccucaagugaucugccugccucgaccucccaaagugcugggauuacaggugugagccaccacgccuggccuuguuuuguuuuugucaugguggggaggagagagggaugggcucaguaggaaauuuaauauaauaauuuggauagaauuauauguaggaggggaaaauuguacauuugggucaaaucucaaacaucaugauuuuacuguuguuccucuugccagaggaccuauucuagauacacagagcaaaauccuuaauucucuuuuagacccccucauugaauuuuuggugggacccccccccauugaauuuuuggugggaagcgcagugugccuacucuuaggauagaagggucuugccaauguguuugccaaugaugaucaggaauaaaauaaacacaguauauaucuuagugguugguuucugggacauauuuuuaguauuugacuacaagacaauccucuuuuccuaaagaaaagauaugagucaaagaaaaugaacguauguuuuagcuaauauuuuagaccaauugcauauuuucuagaauauuuugguauuaacuaucauaaaacaugcuuuguuuuuaacaaauggugaaagauuaaaaauauuuguuuucucaaguuguauauguuuuuuaaaacuuauuuuauuacaguaguaacuuuuaauagguaguaaauaagggcaaauaggcgaucuauugaguuucuccuugaccuugaaguaauacuucaagacgucauaagagacauugauuccucuuggguuacaaagauugcuaguagcauaggcuaccauaaucuacuaugcuuauuuucucucuguaauagcacauggauuucaccaacagcuuucacagagauucuacaccuuuuuggucaccugucagugccugauagcugauuccaacacauucuuuucuuguggaacauauuuuagaguauaaaagcuguuagacaggucacauacacagacacaguccaugccagaauacagagaauauagcauaaugaaugacacguauauacuuuuaaaguuaucuucucacauacaauguaagcaguuuaugaagcaaaagugagcuuuaaugccaaauaguagcauaaugcuagcugaaggaguaggaggaauauacagucaugcauugcuuaacaguggggaugcauucugagagauacguuauuaggccauuucaucauugugcaaacaucagaguauaucaaaacuagguaguauagcuuacuacacaccuagccuacaugguacaaccuguuacuuauaggcuacaaaccuguacaguguauuaugguacugaauacuguagguaguuguaacacaauguuguuuguguaucuaaguguaucuaaacauagaaaaggaaaugcauugugcuacuauguuacagcggguguggcaucacuggcaucacuaggcuauaggaguuuuucagguccauuauaaucuuaugagaccacuguuguauaugaugucugucauugucugaaacgucacauggcacauaacaguaguuuauaauuucccugaauaaacugccuuuggaccaauuuuugaucacuugucucuugauuagucacaggcaugaucacaguccuauuacucuugcauaucuaggcacauggcucucaugcauacucuagauccagaacacauuaauuggggguaauacuauaaacauguuggagaaauuauggguaugaugcguuugguuauacuuauacccauaaucucacucaugcaugcucuaccucuauccaaauacaauagaauaucccaaaugagauauuaucucucuuauuuugauaacugagucauauaugaagguuuuuaacucaguuauaaaucuauaaaucaaauuacuuugucuauuuauagaaacuaguauguuugcacauugacagguggguugaacccaaggaaugaugaauccugaauuuguauucaguaugcuaaaaaaaaaaaaguugaaaguuugcaaauuugguucauuuaaggauucuggccuuaacucaauacaccuuucccuaaauaugaaauaaaauuuuugcagaaaaauuuccaaacugaaauguacaaaauauuuuuuucuguagugccuggaagaaaaagaauuuugagcccaucaguuuucuuuuuacuaacugagaaguguuuaauguucaguuuuuaaaaaccugucaaggccaagcaugguaccaggcuuaugccuguaaucccagcacuuuggggaggccgaggugggcagaucacuggagguaaggaguucuagacuagccuggccaacacggugaaaccccgucucuacuaaaaauacaaaaauuaauggaaugugguggcgcacgccuguagucccccaccugcucaggaggcaggagaauugcuugaacccaggaggcggagguugcagugagccgagauggcaccccugcauuccagccuggguaacagagcuagacugcaucucaaaaacaaacaaacaaacacaccugucaaaaauuaauuuaccucaguucuucaaaaaguuaaacauagacuuacuauaugacccaacaauucuguuccuaggaauauaccccaaauaauugaaacagguaaucaaagucuuguacacaaauauuuauauuuguagcagcacuauucacaacagcuaagguguaaacaacccagaugcccaucaacagaugaauggauaaacagaauguggucuguccauagaauggaauauuauucaauacauaaaugaaugaagagcuaugugcuguagcauagaugaacuuugaaaacugaaaggagccagacccaaaauacucuaugauuccauuuauaugaaguauccagaauagguaaauccauagagacaaaaaguagaugagugguucccagaggcugauagggagaaaagacugaggagugacugguuauuguguaugggaucuccuuuagcaauaugaaaauguuuuggaacacagggaggugaugguuguaccacauuguaaguauaugaaaugccacugaauuguauacuuuaaaaugguuaauguuauaagaauuucaucucaauaaaaaauucaguucaucugagcuucagcuuucccucauaaacacucaauguauuugaugucuuuuuuuuuuuugcugucacugcagcagaacagauguuugauaagucuuaauucuauuuuaagacuuaucacagaaaguuauauuucagaaucuuguguuuacauagccuugaacuuauuuuuucuuguaaugggacgauauauugagauuauugaauuugaugagaauaggugacaauuuaaaugugaggaagagaauaaaucacaguuguagaaagguaaaauuauguuuuauugcacauauacuacuugagacuucuugaccaacugaaauucuucagcuaauguacauguucccaagaaguguagucagauaaaccuaacagaaugucacuuaucaugauuauuuagcauuagaaguaacaccaaaaagcaaagauuaaaaugaccugguuuuccugauauuccaaauucucauucuuaacagcuccguuuguacacuggagcaauuugucaaguuuggagucaacaaauuccaguuuuauggauauugugagccucugucuuucaccuaggucucuuuaucuugcugaucucuuacauguuagcugugacaguuugucuucgacaguuugugguuacaucauaacaguaauuguuuuuuacaacaguggauaacauagggaguuuaaggaggacuaacuccaacaaauagcacaaguuccuugaaagguugacgcugaaggcauaaacuccauuggauauauguaggaucuagaaugggaucaggcuaguaauaauguuugaaagagcagguuugggaggagggaauggcuuaggcuacaaguugggcuaugaaauugcauguuccugaucauaguucacguaaugaaaagaucuagauaaauaagaugccaaauaacguuucuuaguggaaucauaaugauuaucauguuguggugguaaaaaucauuggaaauccuuacuuggaacuaauuauagaguauaaaagaucugcaauuuuucauauagauuucuauuacuuuuuaaaaguuaugguaaaauauauauaauacaaaguuuaacauuuuauaguauacaguucagcagcauuaaauacgugucuauuuacauugcguaaccaucacugcuacccaugucuauaacuuuuucaucaucccaaacugaaacucuguacccauuaaacaauaccuccacauucccuccucuccccagccccugguaaccaccauucuacugucuaugaauuugccuauucuagguaccucauaugaguggaaccauauaauauuuguccuuuugugucugacuuauuucccuuagcauauugucgccaagguuuccauuacuuuuuaaaauacagaguguuauuaucuuauugaauuggccagcuaauuaguuucaaguucuggaaguguuagaauauuuuauuguauuuuauuguggcucucucaugggccgcaaucucuucucugucuauacccucuccuugggugaccuccuccaacccuacaauuucaacuaccauauauauguugacuacuccuaagucugaaucuccaguuaggaucuucaucuggaucucuagauucauauuuaaaugccuucuugucuucuccacauggauguguaaugggaaucuuagacuucacaugaccaaaucagaauucuugauuuccuuucuccaaaaucugccucuacucaaacuuugcucacuuaaccaguuacuaaaacuaaaaaucuaggcauuguccccaauucuuuucucuccuuuacuuuacuguugucuccucccugcccccaacccccaccauuguagcuuccuauuuuuuaccacauaaauaacuuagaaacucaugauuaugauagucaucuguaucagugguccccaaccuuucuggcaucagggaccaguuuuguggaagacaguuuuuucacagacugagguugggggaaugguuucaggaugauucaagcauaguauauuuauuuugccuuuuauuucuauuauuauuauauuguaauauauaaugaaauaauuacauaacucaccauaauguacaaucaguaagagcccugcccuugucuuccuacaacuagauggucccaucugaaggugaugggagacagugacagauuaucaggcguuagauuaucauaaggagcaugcaaccuagaucccucgcaugcacaguucacaacagcguuaguacuccuaugagaaucagugccaccacugaucugacaggagguggagcucaagcaguaaugugagcaauggggaguggcuguaaauacagaugaagcuuugcucacuugccaacugcucaccucuuggccugguuccuaacaggccauggaccaguacuggucugugacccaggaguuggggaccccugaucaaugugacugauacacaauuccaguuauaguccauuaacacaucauauuucauauauguuuaacaguugaucugguaaagauuuaaaaauauuuuggggcuaggcaugguggcucauuguaaucccagugcuuugggaggcugaggugaggaggaucacuugagcccaggaguuugagacuagcugggaaacauagcaaaaccccaucucuaccaaaaagacacaaauuagccaggugugauggugugugccuguagucccagcuaugguggggaggaugaagugggaggaccacaugagcccaggugguugaggcugcagugagcugugacugcaccacugcacuucagccugugcaacagagcaagacccugccuggaaaaaaagaaaaaaaaaauauuugaauagauguuuuuacuauaaaugcugacuaaaagcugggugguaggagugugugugaaacuaauuuagcagucgugucugcuggccuguugcuucugccuuuguaauauguccuaaaucugccugcuucccuccaucuucaguacagccacccuagucuaagccaccaacauuuguuacuuaggguacuguaguaaucuccuccuuuugcuguugauucccuauugccuguuuuucaaacagcaaccaagaugauaucuuaaaaaauuguuuucaguaauuacaaauauaaaggaaguuacaaagauuauauagaaaggacccauacuuguacccuucucccaauccccccaccauugguuccaucuuauguaacuauagaacccaggaaacagauacuggaauaaagucuaaauauaguucugugucauguccucaccuguguugauucguauaaccacugcaaucaagauuaagaacuguuucaucaugacaauagaucucucguguuaccuuuuguagucuucccuacccccuuaccuccuacuaucuuuaacccuucacagugauauuuuugaaacaugaaucagaucauaucacucuccugcuucaaagcuaccguaacugcuuccaaucugagaauaaaauucaaacuuuuauggugaaguauaaaguguugaaugacuuguucccuccuuaccucuguggucucaccugguaccacuguugcccgcacgguuagguacuauagcuacacuugccuucuuucuaguccucuaacacagugguucucaaagugugaucccuggaccagcaaugucagcaggaccugggaauuuguuagaaacacauauuuuuagauuccacaccagaccuacugaaccaggaagucugugggugagaccgagcaaucucauguuuuacagauccuugaugauucugaagcauguuaaaguuugaggaccacuguucuaacaagucgaacucugccauaugucggcuuuucauuagcuuuuuucucuaucuggaauauccuguuauccacaacuuaaccaucuucccugacuggcucuuucuugcauuuaaauuucuguuaaaaauaucucagcagagagaacuuuccucaauauacaguguaaaauaacuagcuacucauuuccacaucccucuauuuuagucuuuugcauaucgccugucauuaccugacuucgugugugugucuuuucccuguuagguuuuaugcacucugagaucaguacuuuguuuuguucaccaguugaugcccagugccuagaauaguguuuaucaaauaguauguccuuaugauccccauuuuuuuucuauauucuccagaacaaucaagcuguauucuccaggacagcuuuacagagcaacuaaaauguugucuguaggcaaaagauuugcauaauuuguuuuuaauauuugaauguugugauauuucacaugugaaauaaccuagaaagagaaaaaaaucuucauuuuucuuuucucuuucuugagacaggguauuacuuugccacccaggcuggaaugcaguggcauuaucuuagcucacugcagccgcaaacuccugggcacaagugauccucccacucuagccuccugaguagcugggacuacaggugcaugccaucaugcuuggcugagaaaaaucuuauuguaugcuguagccuguauuaucccacauuguuuguaauuauuuaugcauuuauaucagauagccccucuucauucauuauuaaaucauugauuauuuugcuucacuuaagauccccaaauucuuuaucaguuagguacugccagggaauguacagaucacaggaaacuuuagacacauguucuguauuacuagguaggcauuugccccuaccuccagucugucuuugacccagauuagauagcuuggaccuugggugagccuuugggcccuuaugccccauccuucuuauacccuuuuaggcaaccaguauucguagaggcucaggccacauggccuucuuggcccauuucucuggagcccauacccugguccuguucugcggauccuaagauuuucuugugagagaagccuuucacuuuaaggcuuguagccaacuccugucaaccuguccuuaguugagaaaccuuaguugagaaacagguagaggaauccccugaucaggagguauccuuaugccugauuguuaacugcagaagaauaguuggcuucauuuuaaaaaggaauccccugaucaggagguauccuuaugccugauuguuagcuacagaagaauaguuggcuucauuuuaaaaagaagguauucagagcagcccaguucuuuuuaaaacuccuuggcugcuaucaguaaaaacaaaauucuaauauagaagacuaauuguguaucacaagacuuguaucuuuaaccuguaucagagcucuucuuuggagguggaaaggagucaagagauuccugauaaacauuacaaaacaguuucucccccaugcauaauuaaauagcuuuuaaguauuauauuuuuuuaauguuucugcuugguuaugggucugugauuguuuaaaaacucuuuauauuaaucccaaauucaggggaauaaacuuggagccucuguauugauauguauuuagguacuucgguuuuauucacuaauugacauaccauuuugaauguccagcaaacagggauguaaauuccuuuaggccgggaccaugucuuuuauauucuaaagcaugcuuaauuucuuuuuuuuuuucuuuuugagacggagucuugcucugucgcuuaggauggagugcaguggcgugaucuuggcucacugcaaccucugcaacccggguucaagcaguucuccugucucagccucuugaguagcugggacuacaggcgcaugccaccaugcccagcuaguuuuuguguuuuuaguagagauggaguuucaccauauugaucagacuggucucaaacuccugaccucaggugauccgccugccucggccucccaaagugcugggauuacaggugugagccaugcacccagccaagcaugcuuaaaauaaggcacacagguagucaauaaauggaggagugguauggaaacaaucuugagauacacuaaaauaaacaaauggaugaaaauuugguuggguauauuaguaguuuugugguucuuagccacuuuugauuauauaagaaauagaugguuauuagaccaacuuaaaauauucaaguauuuucuuaaguauuuuuucagagaaacuauuuuaauuuuaauacuguguauaguuaagcaaagcaaugaggcuaaauguacuaaucucuguuacaacuuuuuguuuugcuuucugaauccuucucaugugauccuggaucuuggacugaugauggaaugauuuucgaauucuaugaaccacagagccuauugugaagaauggcaggccuccaacgucucacaguaugcauuccuuccuccaccaguacacaggaucuuucaagaagcccccauugcggagaccacacaguguuauuggagggagccuuggcuccuucauggcaaugcccagaaauggaagcagauuagguaauuugauuacuugucuguuguguuuaccuuucugauuauacgucaugcacauaguuaaguuuuaauuaagcaacuuuuauuaucucguuucuucugucagauaaaaaucaaguugagaucaagaggaauagcagaaggauggaaaguucuagagagguaguagugcugacaauacagggaaguaauauuugaaaaaccuguccaucaggagggaaaugaaacccauaauaaauggaugcaguauuucaagaugaauggcaguuugggaugguguuuauuuuaggguaaugccucaguaacuuuucagaucaucaccauauaaagccuauuauaaugaauaguauaugugguuaucaccugaauuguuucuucuucugucauuaugucuuuaaauauccaagaaaaaagaauugcaaguuucuguuuauuccucuggccuuuuuugaugaugccuuauguuuuuauuuuuauuuuuauuuuuuuugagacagugucucacucugucacccaggcuggaggggaaugcaguggugcuauugaagcucacugcagcccugaccucccaggcucaaaugauccucccaccucagccuccugaguagcuggaacuaccugugcaugccgcuacgccuggcuaauuuguuuguuuguuuguuuuuguuuuuuuuuuuuuuuuagaagacggggucucacuguguugcccaggcuggucuugaacuccuggacucaagugauccacuugccucagccucccagagggcugggauuacaggcaugagccaccacaccuggccuauuauguuuugauuuuuaaaaucacuucaaguacaacuauuuuauagucuucuuagauaauuauauuuacugaagcuccuugggguuuuauucuacugcucguuuuaugugcuuacucuuggaauaguauauuauuuccaaauguguuucuuuaauuuugggaguaugagcuuaucuacagugagauuuuuucugugagaacugcauauagccuuuaucucuguaggugugucucuacagaaugguaugcuggaguuggcucacacuaguucauaagagaugauuguuaaaguuucaggaacuuugcaaacugguuguuaaacauagcuauuaaauuuuaaauuauauaaguuuacaaauagguaaacuaaauuaaaaacaaagguaaugaauaugcaaaagucauugcuuccuaauuuuuuaccacuuuuaacuauuaucuaugccaccggcguuauuuuuuucuguucuaguuauagucaaaaacacuauauaaugguaugcuacugcacauuucuucccaaccauauguucaguguugucauguugguagccugaaguuguccauggagagagaagucagaaaacacuacagaucaggcccuggcuuauuguuuucuuguuugucuagaccaggguuuguuuuuuuuuuuuuuguaagggggcaguuaguaauaaauauuuuagguuuuaugggcauacagucuccauugcauauucuucucuguuuaauaauccuuuaaaaauacaaaaaacauuuuuagcucaugggccauauaaaaagaagccacacuuguucuagacccuuguucuagaacuaagacaguguauugaaaauguuaguaacgcagauuaaauuuaaaggguauugugcuggaggagaaaaguauguuguaucugccgcuguuacauuaccugaucagcagagagauaucccucuuccccccuugacagaugaguaaaguucugacaagccaucauuguuucacguuugucuugauggaaaugaaaauaccgacugguagucaugucagaacuacacuuguuuguuaaugacgugaguaauuucuuguuugggucagaugguacucaaguauuuauucauagucugagauuaguaagcuuucuuugucguccaauuccuugugcaacaggacagauuuuuuuuuaagugugaauuuuuuuuuuuuauuauacuuuaaguuuuaggguacaugugcacauugugcagguuaguuacauauguauacaugugccaugcuggugcgcugcacccacuaacucgucaucuagccuuagguauaucucccaaugcuaucccuccccccuccccccaccccaccacaguccccagagugugauauuccccuucauguguccaugugaucucauuguucaauucccaccuaugagugagaauaugcgguguuugguuuuuuguucuugcgauaguuuacugagaaugaugauuuccaauuucauccaugucccuacaaaggacaugaacucaucaauuuuuauggcugcauaguauuccaugguguauaugugccacauuuucuuaauccagucuaucauuguuggacauuuggguugguuccaagucuuugcuauugugaauaaugccgcaauaaacauacgugugcaugugucuuuauagcagcaugauuuauagucauuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcaccuguuguuuccugacuuuuuaaugauugccauucuaacuggugugagaugauaucucauagugguuuugauuugcauuucucugauggccagugaugaugagcauuuuuucauguguuuuuuggcugcauaaaugucuucuuuugagaagugucuguucauguccuucgcccacuuuuugaugggguuguuuguuuuuuucuuguaaauuuguuugaguucauuguagauucuggauauuagcccuuugucagaugaguagguugcgaaaauuuucucccauguuguagguugccuguucacucugaugguaguuucuuuugcugugcagaagcucuuuaguuuaauuagaucccauuugucaauuuuggcuuuuguugccauugcuuuugguguuuuggacaugaaguccuugcccaugccuauguccugaaugguaaugccuagguuuucuucuaggguuuuuaugguuuuaggucuaacguuuaaaucuuuaauccaucuugaauugauuuuuguauaagguguaaggaagggauccaguuucagcuuucuccauauggcuagccaguuuucccagcaccauuuauuaaauagggaauccuuuccccauugcuuguuuuucucagguuugucaaagaucagauaguuguagguaugcgguguuauuucugaaggcucuguucuguuccauugaucuauaucucuguuuugguaccaguaccaugcuguuuugguuacuguagccuuguaguauaguuugaagucagguagcgugaugccuccagcuuuguucuuuuggcuuaggauugacuuggcgaugcgggcucuuuuuugguuccauaugaacuuuaaaguaguuuuucccaauucugugaagaaagucauugguagcuugauggggauggcauugaaucuguaaauuaccuugggcaguauggccauuuucacgauauugauucuuccuacccaugagcauggaauguucuuccauuuguuuguauccucuuuuauuuccuugagcagugguuuguaguucuccuugaagagguccuucacaucccuuguaaguuggauuccuagguauuuuauucucuuugaagcaauugugaaugggaguucacucaugauuuggcucucuguuugucuguuguugguguauaagaaugcuuguacaauguauaagauuuuuguacauugauuuuguauccugagacuuugcugaaguugcuuaucagcuuaaggagauuuugggcugagacgaugggguuuucuagauaaucaugucgucugcaaacagggacaauuugacuuccucuuuuccuaauugaauacccuuuauuuccuucuccugccugauugcccuggccagaacuuccaacacuauguugaauaggagcggugagagaaggcaucccugucuugugccaguuuucaaagggaaugcuuccaguuuuugcccauucaguaugauauuggcuguggguuugucauagauagcucuuauuauuuugaaauacgucccaucaauaccuaauuuauugagaguuuuuagcaugaaggguuguugaauuuugucaaaggcuuuuucugcaucuauugagauaaucaugugguuuuugucuuuggcucuguuuauaugcuggauuacauuuguugauuugcguauauugaaccagccuugcaucccagggaugaagcccacuugaucaugguggauaagcuuuuugaugugcugcuggauuccguuugccaguauuuuauugaggauuuuugcaucaauguucaucaaggauauuggucuaaaauucucuuuuuugguugugucucugcccagcuuugguaucagaaugaugcuggccucauaaaaugaguuagggaggauucccucuuuuucuauugauuggaauaguuucagaaggaaugguaccaguuccuccuuguaccucugguagaauucggcugugaauccaucugguccuggacucuuuuugguugguaaacuauugauuauugccacaauuucagcuccuguuauuggucuauucagagauucaacuucuuccugguuuagucuugggagaguguauguguugaggaauguauccauuucuucuagauuuucuaguuuauuugcguacagguguuuguaguauucucugaugguaguuuguauuucugugggaucaguggugauauccccuuuaucauuuuuuauugugucuauuugauucuucucucuuuuuuucuuuauuagucuugcuagcggucuaucaauuuuguugauccuuucaaaaaaccagcuccuggauucauugauuuuugaaggguuuuuugugucucuauuuccuucaguucugcucugauuuuaguuauuucuugccuucugcuagcuuuugaauguguuugcucuugcuuuucuaguucuuuuaauugugauguuagggugucaauuuuggaucuuuccugcuuucucuugugggcauuuagugcuauaaauuucccucuacacacugcuuugaaugcgucccagagauucugguauguugugucuuuguucucguuggucucaaagaacaucuuuauuucugccuucauuucguuauguacccaguagucauucaggagcagguuguucaguuuccauguaguugagcgguuuugagugagauucuuaauccugaguucuaguuugauugcacuguggucugagagauaguuuguuaaaauuucuguucuuuuacauuugcugaggagagcuuuacuuccaacuauguggucaauuuuggaauaggugugguguggugcugaaaaaaauguauauucuguugauuugggguggagaguucuguagaugucuauuagguccgcuuggugcagagcugaguucaauuccuggguauccuuguugacuuucugucucguugaucugucuaauguugacagugggguguuaaagucucccauuauuaaugugugggagucuaagucucuuuguaggucacucaggacuugcuugaugaaucugggugcuccuguauugggugcauauauauuuaggauaguuagcuccuccuguugaauugaucccuuuaccauuauguaauggccuucuuugucucuuuugaucuuuguugguuuaaagucuguuuuaucagagacuaggauugcaaccccugcuuuuuuuuguuuuccauuugcuugguagaucuuccuccauccuuuuauuuugagccuaugugugugucugcaugugagauggguuuccugaauacagcacacugaugagucuugacucuuuauccaacuugccagucugugucuuuuaauuggagaauuuaguccauuuacauuuaaaguuaauauuguuaugugugaauuugauccugucauuaugauguuagguggugauuuugcucauuaguugaugcaguuucuuccuagucucgauggucuuuacauuuuggcaugauuuugcagcggcugguaccaguuguuccuuuccauguuuagcacuuccuucaggagcucuuuuagggcaggccugguggugacaaaaucucucagcauuugcuugucuguaaaguauuuuauuucuccuucacuuaugaagcuuaguuuggcuggaugugaaauucuggguugaaaauucuuuucuuuaagaauguugaauauuggcccccacucucuucuggcuuguaggguuucugccgagagauccacuguuagucugaugggcuucccuuugaggguaacccgaccuuucucucuggcugcccuuaacauuuuuuccuucauuucaacuuuggugaaucugacaauuaugugucuuggaguugcucuucucgaggaguaucuuuguggcauucucuguauuuccugaaucugaacguuggccugccuugcuagauuggggaaguucuccuggauaauauccugcagaguguuuuccaacuugguuccauucuccgcaucacuuucagguacaccaaucagacguagauuuggucuuuucacauagucccauauuucuuggaggcuuugcucauuucuuuuuauucuuuuuucucuaaacuucccuucucacuucauuucaucuucgaucgcugauacccuuucuuccaguugaucgcaucggcuccugaggcuucugcauucuucauguaguucucgagccuugguuuucagcuccaucagcuccuuuaagcacuucucuguauugguuauucuaguuauacauucuucuaaauuuuuuucaaaguuuucaacuucuuugccuuugguuugaauguccucccguagcucagaguaauuugaucgucugaagccuucuucucucagcucgucaaagucauucuccauccagcuuuguuccguugcuggugaggaacuguguuccuuuggaggaggagaggcacucugcguuuuagaguuuccaguuuuucuguucuguuuuuuccccaucuuugugguuuuaucuacuuuuggucuuugaugauggugauguacagauggguuuucgguguggauguccuuucuguuuguuaguuuuccuucuaacagacaggacccucagcugcaggucuguuggaauacccugccgugugaggugucagugugccccugcuggggggugccucacaguuaggcugcucgggggucagggggucagggacccacuugaggaggcagucugcccguucucagaucuccagcugcgugcugggagaaccacugcucucuucaaagcugucagacagggacauuuaagucugcagagguuccugcugucuuuuuguuugucugugcccugcccccagagguggagccuacaaaggcaggcaggccuccuugagcuguggugggcuccacccaguucgagcuucguggcugcuuuguuuaccuaagcaagccugggcaauggcgggcgccccucccccagccucgcugccgccuugcgguuugaucucagacugcugugcuagcaaucagcaagacuccgugggcguaggacccuccgagccaggugugguauauagucucguggugcgccguuuuuuaagccggucugacaagcgcaauauucgggugggagugacccgauuuuccaggugcguccgucaccccuuucuuugacucggaaagagaacucccugaccccuugcgcuucccaggugaggcaaugccucgcccugcuucggcuagugcacggugcgcacacacacuggccugcgcccacugucuggcacucccuaaugagaugaacccgguaccucagauggaaaugcagaaaucacccgucuucugcgucgcucacgcugggagcuguagaccggagcuguuccuauucggccaucuuggcuccucccucugauuuuuuuuuuaaauguacccuguaagucucaaaaguguagcacuuugggaguugagccuuucugugggaaggucucacuuguaacucagaaacccagggcuucauuuuuuaucccaauguggaagguaaacccagggaccuucucaucaacaucagcagccucuccuaagacacugauagagucaauuuauguauaacagcuuuggguuuucaguccucucuuuguuuuugcuuccuagguauuaccaauacauucuugcacauuuagcugugcauuuuaaaauauuguauuuuagucaacauuuucuugaggaaagggagauuuucauaucucacuagaaauggaagccaugauuaaauuauuuuuaacauuuugaaggugugacagaaaugaauacaggaccuuagauguguuauauaccaaauuuuaagagguuaggaaucaaucaccaauacauuacuuuugcugccaaauuaauuuuuuguucacauaucaccauaaaauuucuauggaaaucucaacauaacugaaguguauucuuagauuacauauugagcuauuaaaaauccauuaccauuugcaacugcuuaugaauauuaauuggaguuuucuuaauauugaguuaaccaagacaaaaauacagacauaaagugaguuuuaagauagaguugauauaagacccuugaguucaaauuucuccuuaaucuaagcaguccucaugauuuuauauguaaauauuauuaaaaguuaacauuuauacuuauaaaauacaauugucucacacauugauauuuuauauaacuuuauuugaaaaagagaucuaguuaucuaggccauuccuugauuguuaguuaauaugcaguucccuugaauacuuguuaagcaccuucugagugccagacaguugguuaaguucuggaaauagaaaagugaacaagcuaaaucccauccccaaggaucuuauaaaaucacaugcaccaaaaaauguucuucagugcagugggugggggcacaguagucaacugugucugagauuagaaaagacuucacugagugaugacacaugagcauaguuugaagacuaagccugaucucacaaaguugauaaaauaggaaaaggcaucuuuuaaaaacgagaaaaaaaguguguuaaagcacugcagcaugaaacaacaugcuucuuucuggaaaaugaauacguguauagaaaguaauaguggcaagagaggaguucuagagauccagcauuuguuuccuaguacacucuucuugcuggguuauuagauaaugacugacaaaugcagguauaugaguauacaacuuggccagaugugguggcucaugccuguaaucccaucacuuugagaggccaagguggguggauuccugaaguugcaguuuuuugaauuuuugcaaucagaccuuggugaugaccuugagcaguaggauauaaguagcucccacaugcuuagcuuccaauaauggaacacuaggcauaaauggcuacaaguucaagaugagccugaacaacaaggcaaaaccuugucucuacaaaaaaaauaaaauaaaauaaaacaaaacaaaacaccagaugugaugggugccuguacucccagcuacuugggaggcaggaggauugcuugagccugggaaguagaggcugcagugagccaugguugugucacugcacuccagcuuggccaacagagcaagaccuugucucaaaaacaaaacaguauaugucuguuuuuaauauuuucaaauggaauuuaucuuccucccccuacuuccauuuaacuuuuaucucuauuaagcaugccauaacccaccuuuuuuguaguauguuuuugcucugaacagauuuuugaguauuugaagaucauaaacuuguuuuuguaguucugguacaaaauagauauucagugaauaauuuuuuauuguuuuauuuuuaacauugggggugcagggaggagaaacugcauuagaagcuuuuaagagguguuuuaaagaauauuccaagaauuagcuccauuuaaccauagacccagugacacauuauuuaauugaaagaauacuaaauaagaggcagaugaccaggugucuauuccagcucugcaucuaagcuuugugaacuuuugaaagucauuuaaccuuucaagucucaguucccagaucuagaaaaugaaagaacuggcucauucucagagauauuauuuccaguuuauaauuuuauuacucaacccuugauaauaacuugaauguuaauuuuuuucauaauuugaaaguguaaaaagauuucauacuauuuuaagacauuugagucauguuuucaucuauuaacugcauaccuguggcacccagaauguaaaugacuuuuuaugcugugauuuuuacucguuggccuucuauauuuuacccauagugauaauaaauuauauauuagaauauaauguaucucuuuuaaugucucauuuuuugauauagauauuguucaugaaaaucuaaaaaugggaucagauggugagagugaccaagcuucugggacaucaucugaugaaguccagucaccuacagguguuugucucagaaaucguauacauagacggaucucaauggagguaaucauuuaaaaaauacaaauauacuugugaauauguguguugguauauguuaauacacauacauaucaaguggaguaaaugcccauuuaaaaauuuucaugaagacacgugacacuuguaagaaaguuacuucuuugcauucauaaauugcagucugugaauauuuccucuuuuuuaauuuuuaucccaauguagauauguaauauaguuguucgcauucugugaaacauuuuauuuuaauuuuuugcgaaacguuauuuuagguuauccauuaaggagaagugaauuuucaaaaauucuggaaauacagaaugauacauuagcaaugucuucuuuuuagaaaauacgauuuuaaugauauuuuugagauucaucuggauaauuagcauuuuauuuucucuguuucaaauuuuaagagguauaaauaaacagcuuuuuuuucuugcauuauauuauaaaaguggguguccuuuccuuugugguucacuguaccuacugaucucugaagcacauuuauuucuccguguaaaaggaugaagaauucauuuucuuuucuuuguaaguguugugguauaaccuugaggacauaaguugaucgugacuguuauuucaguacguacuguaaacuaaaauagguuucugcaaaaaaaaauugaacauguuuugaaaugaaaguauuguugcuuuuuuggugcuguugagaugaugauuaagguaucucuccuauugguugauuauauuuucauuauaaaaggauucuucuuaaucaguuaaggaaaucuuaucaguuuucuaaaugauaaauuaacauuuucacuuguugaaaucaacgauauauuuaugugacacaauacuaaugaaaauauuucuuauuuuucuucaccuuauagaugauuuuuuaaaaucauuuguuuuauuuaguauuagggucuguaucuggaguuucucauucuucguugagcuauaauuuguuuccccaccaccaaggaggcaugcucuagauuauauucuuuuuauaguauauauuuuuuucugguuuaugagacagggccucacucugucacccagacuggaguacaguggugggaucucagcucaccacagccucaaccuccugggcucaagugauccuccugccuuagccccaaguagcugggacuacaggcacacaccaccaugcccggcuaauuuuuuuguauuuuuuguagagacaggguuucaccauauuggcuucccaaagugcuaggauuacaggcuugagccacugcgccugaccuguaguauauuuuaauaucuggaaagacuucuuucuguaucccucccccauauacacauauacucuuucuuauuuuagaauguuuuuggauuuuuucuguuuauucuauugauacauuuuaggcauuuuauuuuguucuaagaauaagcuuauugugauuucuuagugguuauauaacuuauaaaauuaauauagggaggaccaguaucuucuccuuacuuauucuuaccauuugguggcauuguauguuuuuauacuuaagucuuauauuucucaguaaauauuuaugcaguuccuauaccucuccauuccguuucaugguuuggcugcuguuaugaaugggaggaauuucuuuuuauagggcuuaaauuucuugauacaaugauauaggcaagauucuuuucaaguuuaucccagcucacauuguauaauuaaauaaaguagaaaugccauuaacauggcaguaauaaauacaauucucuuuccccauguugcauacaagaucauauaaugucuacuugguuaguuauuuaaacugaucacagaguuugugguaguguuugccuaauguuacuauaugguauaauaaauuuaaaguaaauuucaaguugaauuuaccagugaaaggacucaaaaauuacugagguugcaaaauuucauuucuguaacacuucgcuguauacuuuugcuuacaguaaauguuuuugccaugaguauauuacauauaaucaauguagguaacuuugcaacugcaauaaaacuuuacaauuacuuaucacuaagaaauaauauguuagagccugugaauacaaaagccaaaugccuugccuuuacuauuuuggauuaccuuuuuuuuuuuuuaaggauuuaaauaagcgguuaucacugccugcagacaucagaauaccugauggauaucuugaaaaguugcagauaaacaguccaccauuugaccaaccaaugagucgaaggucucguagagcuuccuuaguaaguuuuuggucuccuauaccuccaccaucaaucagaucugcuuguuugcugcuucuggguguaaacauuuuaaauuaauuuuuauacuugacuuuagaauagcuaaauuuuauuauauugccuucucgauuuuuauuauuuuccauucuuaaagguuuauuggaguccuuaagaugcauucaauaggaugcauauuggaauaggauuuaagguauauuuuauuuuugguaaauguuauuaauacaugcuagguagauaaauacauacuagauauauagauacacuagauaugugcuggauaaauaaacauguauuaauauauacuagauauacagagaaguacacaaaccauaauuguacagcucaacgaaccuuugaaauguuaauauaccuguguaaccaguaccuggaucaguaaaagaaaauuucagaaaucccagaaacccccuucuguucccuuucucuuuacuuaguauuccucacuuccucaacuguagccauacucucugccuucugaugcuaaagauuaguuuuacccauaugugugacauuguucugaucauacuguuuuuauaguauguuuugguaucuggaucuucuaaaaucccauucacauauauucuuauuuguuuuuuaaauguguaauauucucuuucugauuauccuuauuaaaacgucugagcuuuguguaauuaugaauauguaauuauauuaaaauauauuuuauguagauauacagaauuauauacuuauacaaaguuuguauauauauauugcacaauauguaucccaguauguauggaaguuauacaguauguauuauuuuuguuguuagcuucuuuuguucaguguuauguuugugaguuucagcccuauuuuugcauguaauuauagauaauucguuuucauuguugcaugguauuccauuuaugaguguacuguacuucauccauucuccuaucgaugggcauucugguuguuuucgguuuuuggcuauuaccaaauaaugcuucuaucaccauuccugugcauguuuuuugguuaacauguaagcauuucuguugagugcuuaccuaggaguggaauuguugcauuauauucugcuucccuagauacugucaacagcuuuccagagugguuguaccaacuuauacguauaucacuagcauauaauaguucugguuguucuccuugccaacuuuugauaaugucuuuuaaaaauuauuauuuuaaguuuucuagcaaguugauaguggucucuugguuuuauuuugcauuucucugaugacuaaguugaacaccuuucuguguguuuauuauucaucguauguuuauuguauguuuauauuuagauacucucuuuugugaauuaacuacccaagucuguuuuucuucuuuuuucuauuggguuuucugucuuuuuuauugguuuauacgaauuuuuaaguauacuuuauauacaggaccuuugucaguuacaugucuuacaaauauauuuucuuaauauuuaguaauuaacccagcaccauuuauucaaaggauaacuuuucuuauugcaguaucacuuuaauguaaauucaggugauuguuuaugugagaaucucuuuuggaugacuauaguccuguaguagagauacauauaaagugcuuugggacaacaaaagaggcagcaaguaaaaugccuuggcaaaucacaagcuuacagagauagcacuugagcugguccuagaaggaugggcagaaauuugucagucaaaaacggccuaugaaugaaggguguuguaagaagaggaaacuucauguacuaaaacuaaaacccagagguuuggguguagaugucauguuugggaaaucagaacugauaugaaggguaauauggaauaauauaaaagcuauggcuugaacggacaggacagauccagaaugaaaagccuuagaggucaggccaagaagucuggacuucuucccauguaaugagaagacaucaaagguauuuauuuaaacaaaggcugacauggucacauuuuuguuucauagcaauagcuuuaggaaaaguacaaacaaugaauuagagagaaagacuagaggcagggagaauuaggaauguauucaaaauuaaggaugauguggcaaucagauggaaauagaaagcagaacauaaauccuagggaccaggaagggauaaaauaccaccuaauacccacuuggacuuugcaccugaaggaagagaaauugaugaugacucuuggauugcuagcaguuguuguaucuccuuuuuuacauuauuauuauuauuauuauuauuauuauuauuauuuuuggagacggaguccugcucugucacccaagcuggaguguaguggugcaauuuuggcucacugcagucugccuccccggguucaagcgauucucuggccucagccucccgaguagcugggauuauagguaugcgccaccauguccugcuaauuuuuguauuuuuaguagagaugugauuucaccauguuggccaggcuggucuugaaugccugaccucaggugauccacccgccucggccucccaacgugcugggauuacaggggugagccacugcauccagccuuuacauauuauuauauaauggaacuauuuucuuuagagacaaggucucacucugucaccuaggcuggaaugcaguagcacgaucauagcucacuguaaucuugaacuccugggcccaagcaauccucacaugucaggcuccugaguagcuaagacugcagguguacaccaucacacccagcuaauuaaaaaacuuuuuuuuuuuuuuuuuuuuuuuagagauggcaucucacuguguugcccaugcugguuucaaaugccugggcucaagcgguccuucugcauugguuucccgaagugcuaggauuauaggugugagccgcccauagcaucuggccccugugggccagauuagauauucuaguuagauagucuacaaaauauuuuggugacauacucuaaaaaauaaaaucacuuuaugcuguauauaccaugagcacauuguuauuugacauucaccaguauauaaauaugguaaaaaguauaacacaaacuugauuuugguauaagcauaugauuaucauaauuuagcaucacugcuuaagacauuuuuugugugugugugugucugugugugugagacagagugucacuuugucguccaggcaggaguacaauggcgcgaucucggcucguugcaaccucugccucugguucaagugauucucaugccucagccuccuuaguagcugagauuacaggcaugugccaccaugccuggcuaauuuuugcauuuuuaguagagaugggguuuugccguguuggccaagcuggucuugaauuccugaccucaagugauccaccugccucagccucccacaguguugggauuacaggcauaagccacugugccuggccaagacauuuuuauugggaugauuuugccauuugauugucaagucaaaaguuuucuucggcuaucaguuuuuaucaaagauugguacuuaggauaaauuuugagguuguauuuguuccaauugggaguaaaaaugugauuuaaucaccauguaauuuuuuuaagcuaucauuuaggagcuaucuuuuacagucuacaugauauuaagaaaaacagugcccucuaaugaaugcuaagugauuaaaguuuuuauuuaugguuaaguguuccuaccuaccucccccgcuuuuuuuuugagacagaguuucacuuuuguugcccaggcuggagugcaauggcaugaucucgggucaccgcaaccuucgccucccggguucaagcgauucuccugcuucagccucccgaguagcugggauuacaggcaugcgccaccacacccggcuaauuuuguauuuuuaguagagaugggguuucuccauguuggucaggcuggucuugaacuccccaucucaggugauccuccugccacagccucccaaagugcugggauuacaggcgugagccccugcgccuggccugccuacuucccuuuucagaaaauucugaaauggcuuauagauuucagauaaaucaugccagcuauguuuuggauuuuacugaugcauccauuucauuauucaucuaccuuaguaaagcauacuuuuuggaaauacauuaaaaauuauucuucaaaaugaaaaucucuacccuagguuuauauuugaacauagucagugaagggagggcaugugaaaguuagggauggauggaaaaggagugggaaaaagaaacucauuuuuuuauauguauuagaauuuguguaucuguggauaauauauucuuuauauaccuaaaaaguaaaaguuuuuucaaagagaucaguucuucagcauagaagucuggacccuugguuuauguguaaaggagauggguaaagauuagggauggauagaaaggagguaggaaaagaaaaauauucuucacauguacuagacuucauuuuuccauggauaauauacccuuaaucuaaaaaauaaaauauuuuuuaagguaaaauguaaaauuuagccuugucuucuaaaaguuuuaaacuuucaauguguuguucucauauauauauauaauuuuuuuuuuuguacaaauuauuuguagagacagggucauacuauauuauccaggcuugucuugaacuccuggccucaagcaguccucccgcuuuggccuccaaaaucacugacauuacagguguaagcuaccucuccuggccuauuuucauauuuucuaauggcaauauauaaugaguaguaaaaauaacauaaaaccuuugcuugaguaggaauuaagaaacaauucauuuuuccuggagaaaguuauacaguagggcugaaugggucuaauauaaauuuauggucaucaaucucgcauagauccccaguguugucuggcuaucccacugucuuucucugauuaacucuuccucucuuacuguaagcagaugaucucucuuccuauaucauaaaaaagagagagggccagauguuguggcucaugccuguaaucccaccacuuugagaggcugaggcaggagguuugcuugagcccaggaguccaagaccagccugggcaacauagugagaccuccaucuuuacaaaaaauuaacaaaacuagccaggcgugguggcacaccuuuguagucccagcuacucaguagguaggaggugagaagaucacuugagcccaagaggaugagguuguggugagccaugauugcaccacugcacuccagccuugucgacagagcaagagacccugucucaaaaaaaaaggggguggccauuaaccgaaaacucccuccuuuucuguauaacaaacuugcaaaucuaccuaugcauauacccauucuguucuuuuuuguuuuuaaucuugagaaguugucccccuuacuaucccaucuuuucaggaugcuuaagacuaucuguuaucccuauaaacugauguguguucagucucccauuucuuaccuuaauccuuuccagugacuuuuuauuuacauaaacauaauuuuaguuuuagauuuacagaaaaaauuacaaaaauuauauaguucuucuauaccacauacccaguuaccauauuauuaacauuuuauauuacuuuaauacauuugucacaacuaaggaaccaacauugguacauuacuaguaacaaaacuccauacuuuauucagauuucacuaauuuuuugucaguguuguuuuucugucccgauacucccuccaggauaccacauuacauuuagugaucauaugucauguuaaaaauauuggcuauuggauggugacgugcuauuuaguaguccuuuaugauugauaagaaauaaaacauugucaacauauuuaguuaaauauuagaauaguggcaaagccuauauguagauagucaggauucaucagagcuuccuugcccuuacgauaaugguauacccaguggaaguuuugugagacugagugcagcuucaauuauaauggaggucauccauauauaaaaauuugucuuauuguauucaaauuauagguuuauacauuuuaagagcauaugccuuccuaaacaaugaauguuuggauucuucauuccugguuuuaccaauagacuauauagaccuuucuuaauucucagagcaggugagaaaauacaaucaaguccuuacaucucucagcaauuagaaauauaagauggaaugugggagugagguucaaagucccacagaauuuaccuuuagcauauuauguacaggaguacaggauuaaggugguauuguggugaugauaauagcaauuuuuguaagacaaagugacugaguagaauagagauucucagucuuucccccugcccaccaagucuaagggauaaaacacauuucuuucguuaacaguaacucgguaauucccacagagagggaaaugaauguuugaaaaagccucccucuuccccugcuguuucuuuuuuguuguuuuuugagacagagucuugcucugucgccaggcuggagugcaguggcacgaucuuggcucacugcaaucuccgccuccuggguucaagcgauucuucugccucagccucccgaguagcugggauuauagguaugcaccaccacacccagcuaauuuuuguauuuuuaguagagacaggguuucacuauguuggccaggauggucuugaucuccugaccucaugauccgcccuucucggccuccgaaagugcugggauuacaggcaugagccaccgugcccggccccguuucuuauguauuaauauauacucacucuuaaaaugucaucuauggauccucuguacauacagaagcuucccccuuuaucugugguuucauuuuccacaauuucaguuaugugaggucaaacauagucugaggauaggugaauacaaugccaguaugauuauuuugagagcaagagauagagacugcauucacguaacuuuuauuacaguguauuauuaugguuauuuguuuuauuaguugaucucuuacucugcaaaauuuauaaauuaaacuuuaucuuaggaguguauuuaauauguauagggaaaaaccuaguacauacagguuucagugcugucugcuguuucaggcauccacugguguucuuagaaguauccccuguggauaagggggaccucuggugcuucauuuguuuugaagcucagcuagaacagcaucuccagccugugauagaguaauuauguugcuagauccaaaguaaacaaaaaguuucccauaaggcuugguauugcuuacaaguuacagugaauucuaggaagacuauuauaaauuauaauuuaauuuauauauauauuuagaauuuucauguguuuauacucuaagagccaucugaauaggaauuugcuuggggcugucaaaaagugaaguauuuucuuggaacagugaaauaucagaaaaaauuaucuucauuugucuggaaagcagcauuaagggggcucuuauauuacaugaaaauauaagcuuugagcagugauaguaucauacccgagguuuauccaaggcacaguuauugcuaauugaaaauuuuucccaaauacccccaccaugacaacuugugauuauaguuggcauuggcaauuuuugaguuucugcagagacuggaacaacaacauacacauuauaaagcuuauugugcuauuucuuuagcuauuauuucuguuucugugaaacuuuuaaaauauucuaaaauaaucuaggauggaacucaggcuagauugugaacucaugaaagugggaaucaugucugucuucucuagcaccuaacauugugcuggguaaauguugaauaaaugagcuuuguccucuguccucugaauaauuucuguaggagagcacgucaacaagcuagucauuauaucuauuguuaaucuuguuguguucagcaaauaaaaaugcaagcaaaauuuucuaaaaauuuuauuuaaagauucaguaaguacuguuuugauguaaucauuaaauccuaaguuggaaauuacuaaauugggggcuaagcuuuuacuuuuugaauuaggaucugacagacaauucacuaguguaauugugccuuugucugaauucucugccugccugccugccugcauggguggaauucaguaguguuguuuauuuuauagacugauuauucaaauuuaaacuuaaccucuuacauauuugucuuuacagucuaauuuguaguccauuuacauagucuuuaaagcaaaccucgacauuuugucauaguaaccauuggacccuaguguauuugauguuuuaagaacauaguaguauucauucauuuaagauaaaaggauuaauaagaaaauuucucuacuccugagaagaaaaaaugccuagcuuacagucuuauuucccgugugcuucucauuguuauaaugacauuuuaaauauuuuuuucaggaacauucauucuuuuguucauacuaguuugcauuuauucucaauauaguguuuuuucccccauaaaagaugacacaaaacuuaaaauucauggcaaaaaugcgguaguuccauauucaugaauuuaagcaccuaaauuccagagauaaguaucagaauaaagauauuuuauuaguuucugugaucuuggcaaguagccuuuuuuauggaguaaaguauuuaagaucauauauaaauaggcuauauaaaacauauauaaauuaaaagauuauucguaaucagacugucauguaccagauagugggcuauuugccauguuuuucauacugauuuuaaaaacuucacuuguauuuuaaaaauguuaucuauuguaguuuuacuucuuuauuuugcauaguuauugauacuagaaagcgaaggacuuaauacugagucauguucaagacaauacauggaugaauaguguaugauggucguaaaacuucauuuuuaaaauuuaauguuuuaugaaaaacgucauaggaaaaugucauagaaugcaaaaauaauuuuucauucauucaauaauaccugugaccaaaguuuuaauuaguuuacuaaaauugaauuaaguacuauuggacgugcaguuuuccacauggcuuuuaauaugauacauaucauuguaacaaaaagauaaaaacaguuauuuugaggggccucugcuacuuuuggccauucagcuuuggauaauuuauccuauugucugaaaugguaagugaugcaagucuaauuaccaaggauuauuuuaauuuuauuccacaguuccaaggaaaauugcguauuuagaccucuagaguuugacuaaaucacaacguuuaaucaucuggcauaauuuauacaccuuugagaacugagauuauguauuaaaaaacauuauuuccuuuaacuggcuuuuuauuuaagggcauuagcaccauucuaagcaaguggaucuuucuuuagauuaucauuaccuuuuccauuaucuauaaagggguacuagaaagcaacuuuaagaaaauucuuuucccauucuguuuuacuuuuuaaaauauuucugcucucucagucccuaguuuucaaucuaucuaaaaacaaauuuuccuaaauuuuguguuaagguuuuuucuuuuucauuuuaaauauuguguuuguauuacauauuuagguauauuucauguacccuguuuaucaucuccauacacaauagucaggcgagcucaaguuuuaaaagcaaggcuuuuaagaacucacuuuuaaagcauuuucucuuguuguuguggguuuguuuguuuuuuuuuuuuuuuuuuggccgaguguugaggggggguguagccagaauuagacuuacauugcugcuucuauguuugccacuuccugauccauagaagagcaugauuuucaguugucuuuuucauuguauuuugauuggaaagccugaaacaaauaguauuuuguuguuugcaggacuuccuugggaauucagauuggugagggagaaaauacauaggaaaauuauuuauuuugcaauuuuguuaaaaagaaaaucccaaguaguuauccuugauaagauucuuuaguaucuuaaaaugccugugguaucuuagaauaaaaccaaauauuuuucaugacagaauguuaacuguguauauauaaagguuggguugacaauuuugauugugaacuuugauauuuuugaaccuuugaauguuccaacauuggguuuauuuuaaaacuugauagauauucaaccauuugauuauaaucagauuuuucuauucuuagucauucuuuagagugggaaaguuucagaaguugaggaagagaugaauugaaacuuuaagaauauauacaaggcugggcgcgguggcuuacgccuguaaucccagcacuuuggaaggccaaggcaggcagaucacuugaggucaggaguucgagaacagccuggccaauguguugaaacccugucucugcuaaaaaugcaaaaauuugccgggcuuggugcugcgugccuguaaucccagcugcuccggaggcugaggcaggagaaucacuugaacccgcgagguggagguugcaguaagccaagauugugccgcugcacuccagccugggcaacagagugagacgaugcugucucaaaaaaaaaaaaaaaaaguaaauacuacauuuuucauuguuuacuuuucagucagaaauuggcuuuggaaaaauggaaaccuacaucaaauuggaaaagcuuggagagguaaguaaauaucucaaaaauguaagacacauuuuuuucuuauucgucauucaaacucuguuacuccacgguuuuuguuaaccuggaaaaaacguaaguacugaugucuacaagauuauauacuuguucuggaaagguaacagaguuucuaggaguuagagucuucaauucuugaaauuaucccaucaguuugagaggaaaugaauuuuuuuuauagcuuugaaauuuuuauugaagcagaaaguauuauguuuucuuaauaacaaaguaggcauuugucacuuagucuacugccagucuacugucugugccaccaugggaaauugcaugaguucagaccugugaaaaaucagaauaaagauaaaaacacauuuuuugaagguuacggaaauucuuaagaucuugguuuucuugaacuuacuacuaguacuacugauuuagaaauggccuaccuccuauaguaggaaagggcaaagaaaacaauaguuaauagggaaggcuuaaaggagcuugagggcuguccuggcaauaauagaagagauccuuguuuuuuaaaggagaguuaauguacaaagauucugaaaagucuagaaacauggguaaaauuuuuaugauugccgggcgcgguggcucacgccuguaaucccagcauuuugggaggccaaggcgggugaaucacgaggucaggaguucgagaccagccuggccaacauggugaaaccccgucuguacugaaaacacaaaaauuagcugggcgugguggcgggcgccuguaaucccagcuacucgggaggcugagucaggagaaucgcuuggaaccggaagguggagguuacagcaagccaagauugugccacugcacucuagccugggcgaaagaaugaaacuccaucucaaaaaaaaaaaaaaaaaaaauuuaucauuuaacaauauguacauuauguuuucauuuuucaauuaauauguucaauuaguguccaucagucuccauauaccauugcagguaaagcaccuuugauuuuaaagcuauugaucuaauuguuaaucuaaaauaagguacaaaaaguaaauauucugucuauguuuuuauacucuugaggcacucuguaguguuacagaaguauggaagcugugcauaugaacugaaaguccuguuuacuguaagaaaagccauggcugaucauuguguguuuuucuuugcaagauggaacuuaacaaugcuuagaaacuagaaauucagguagagcucuuuauuauaagaugguauuaaauagacucuuaugauacuuuugaugcguccuuuaaaaauauauuuuauaggguacauaugcaacaguauauaaaggaagaaguaaauugacagagaauuugguggcauuaaaagagauccgauuggaacaugaagaaggugcacccugcacagcuauaagagaagguauaauaauuauacagaacauuuuaaaaucaaagugguggaauaagugucuauuuuuuauaaguaaaaagagcucagauauacaaguaauaaaugacuggaagauguaauuaaaccuuuaaaaagcaaauuucuaaaacaaauacucaaagggauuaauuauauuaguguauaacuuauaaugaaaucugaauucauuaaaaaucacuaucauagacaacuauuugucauagggaaauguuauacauugguacaugaggaacaugguaacuauaaauuaaccagauaaacuaaauaaauuaaaaaacaguguguaaacauauuuauaucauaguaccauuuuauaaagaagauuauucagaaaauggcuugaggcaacugauuaguaauguggaggggaaaaaugguuccuuguaauuuauaucuaaauuaaugccagaaguuucaaaaguuaacauuuaggaaaaauacagaagaugauauggagaauguuauaauauuggggacaauuuuaaguauuauaauaucaaacccaguaguauaaaagaaaaaauugauuuccaugaacuuuuuuuuuuuuuugagagggagucuggcucuguugcccaggcuggagugcaguggcgagaucuuggcucacugcaagcuccgccuccuggguucacgccauucuccugccuuagccucccgaguagcuggaacuacaggcguccgccaucacgcccggcuaacuuuuuuuuguauuuuuuaguagagacgggguuucaccauguuagccaggcgaucuccugaccucacgauccgcccgccuuggccuuccaaagugcugggauuacaggcaugagccaccgugcccagccuccaugaacauuuuuacaaccaauccccuugguaaauuauugcuuuaaacuuaagagaaucuuuuuuuuuuuuuuuuaaauagcauuguugcccaggcuggucuugaacuccugggcucaagugauccgccugccucggucucucaaaagugcugggauuauaggggugagccaccgcccaagaccuaaacuuaagagaaucuuuuaaucaguucguauguucaacuuacuucagguuuuuauaaagacugccacagacuaaacaauuuucuuuuucuguuuugcaguuucacuauuaaaggauuuaaaacaugcaaauauaguaaccuuacaugacauuguucacacagauaaauccuugacuuugguguuugaguaucugguaagcaucucauaaaaauucaguauuuaacuuuacuuuagaaaaacauaguaaauuggacuuuuaguuuguuuuuuauuuuucuuuaaacugcagcugugcuuagcuaaauuggacuuuuuaacagcccaagagacuuuauuauuuaguuaucaguuuuucauuaaauuauguguauggugcauccaguaucuuuucuugaaaaacaacuaauuuugaaaaacacuauuaagugaaccagucacaacauucugaaaaugguguaucacauagcagagugcuguguuuuuccaggauaaagaccugaaacaguacauggaugacuguggaaacaucaugaguaugcacaacguaaagguauguuuucuugcguguguaauuuuuaaauuuuguuuaaagcauaggugaaccauuauauaaugaaauguaccagccucauaacucuucuucaggguuuucuguuuggccuuuuaaauagguuauuguccucugaacgugcaauauuuacccagaacuucuguuuacuacacuauagcuuucuuaggaucagaccuuuuuguagaaccacuucauucuuuugacauuucacauuacaacugauuguccuaauauagaauauauguacagguguauucugcuuuaaaaaaaaaauucaaaauaaacacgaaugaugggugcauucugugaaaggccuucuuuaaauagugaacuccccaaauaaaugguauuuaauuguaaaacaacaacuuuucagaacuaaugaauaaggccagaacaugcagguuuuaugaacacuaugcuggaaauaccaaucuguacugucaggaagaagaguaagauaauugguguguuuucuuacaacaacauauuuaaaaauuuaaugcuaaaaauguuugccauaaaaucagugccagaugauacccaaaaguuauuaacugaguaacagcauccagcauaguuuguauucuuacaguagguuucuuugaccugaguaguguauccaaauuuagcaaagauuuauuuauccaaacuuagucaacaauauguaagaaccuauucugaaaauaggcugucgcagcugugugcuucagacauuucuaauucuguagguaguaauuuuaaacuuacauuuuaaaaaaauauuaaguuuggugguuauaaaggagagccaguuucuguuacuaaaagacagcucagaacauauggauaacacauugcuaaggauuuuuaaaaagggcuuuaaauguacuuccauauauauucugucaggguuguuuucaucuuauuuuacaucuuuuguuugcaaaguguuauaacugucauuuuguauuuuuuugguuuuaauuuuguuuuuccugcuuuuuuuauuggcaauaauuugaaaauaaaacaagguccuugaugauaauuucacaaauguugagacguuuauuucuuuaaugccagguuuacaugauuagcuuaaguuggaaagcguuuuauuauuuauuuguuuaaauggccuuuauacuuucaaaauacaaaguguaacaagaauucauuuaaauaguaauuuuagaguuuuaaaaacauaauuauguagacuggagagacucuggcacagagaauucauucaggcauaccguugaccugcugccuuggcugccucaguguucggaugcccuguuuuucaccuacagaugaacugaggggaaacucuugaauccucuguacuugagguucuuuuuguuaaccccagagaaucaaaggucuuauguguuccguaacccucuuucuaccaaaauguacagcaaaaacucuaccauuagccuuauaggaauuacuuuuuucagagucauucagaacacuacggugcuaaugccccuuugugaaucacaguagauuuugaaggcuaaguaggaggugcugaaaguaaaguacccaagagaugggugauagaagcugguuuagguuaguuuuauaguaaguaauuugccagagcuaugcagcagcuuucucuuugauaccucagacuuuucauaaaaucgccaauuccagugccuuauuuuaaagacacugccccagaucagaguuuuuguuuuuguuuuuuuucaaggagagaugggugggagggggguugguugguuguuuugccagaauuuuauaauuaaacuauguaaaccuuaguaggccuguaaguuuaugaggauauguuuuuuuuuuuaagucauuuuccacaguaaaucaacuguuacugcuaggaggaaguuacuuuuuaaaaaauauuuccauagauacuguuagacuaaaagaaauagguagaugcuucaaauagaauaauaaacuauuaaauucagaaagccacuauauauaaaaggaaaaagacauuguacuuaaguaugcaauuacuuucuuuuuccuguuacaauguucuaggccagcugcuuuucugcuuaccaucauuuaugcuuauacuaaagcaugucucaucuuuaagacuaauuuuuauuuauuuguuucuguagcuguuucuguaccaaauucuacgugguuuggcauauugccauagaagaaagguauugcaucgagacuugaaaccacagaaccuccucauuaaugagaaaggagaauuaaagcuagcagauuuugguauggaauguaugagauauuuauuaguacuuccagguucuaaaguguaaugguuaaaagaucaaccacugucauaaugugccauugcuuuuauguggguuuggaaauuuucucgguagcccacagaauaagauauuugacagaacuuugguuggugauuuauguugguuauuagcagcaaauucuaaaaugcacaggcuguucuuggguguggacaaagaccccuagggcuccugagacccuuguaggaggccucuaaauguaaauauauuaccaaaauuguaccaucuguuauuugccuauuucacuguguuaauauuugcaaugauggucccaaaauaauaaugcauaaaacuauacaucaaaguaguggcaccaaaauauaucuuuuuuuuuuuuuuuuuuuuuuuuuuugaagacagcauuuugcuguuaaagcccaggcuggagugcaguggugugaucuugacucacugcaaccucugccucccagguucaagugacucuccugccucagccucccaaguagcugggauuacaggcaugcgccaccaugccuggcuaauuuuguauuuuuagcgugaccaccauguuggucaggcugaucucgaacuccugaccucaggugguccacucgccucggccucccaaagugcugagauuacaggcaugagccaccaugcccaggccgucauuguauucuuuaccacuacacuuacguaaagggaaaacugucaguuacacuuacaugaugaagcaauaaaauuuauuaauuauauuuaauuuccauccuugacuacauuucuuuuuaauauuuuaugugauaaaaugggaaguguacauaaaacucauuugcugcacacagaaauaaugugguuacuucucagggaaaagugcucaugugauuauuugagugcacauugaacuagcccuguuauuugaggggacaccauuuuuacuuaaaugacugacagacaaacugugguuauucagacuuagguguuuggcagacauuuuccugaaagugaaugaaggaagccuaucauuucaaggaaaagaacugucaguauuucuugccaauaauaaaauucaaguuuucaagcaaaaauuagaguuuggaaauuuggaucugcuuugaguuugauggcuuuucaauacuuagagacuuuucugaugagaucgauguugauguuaacaaacacgauuuuucaauaugcugaaaaaguguauaaacauuuggaauguauaacccagggauccacuguuuuccaaauggcuaaugcaugauauuacagaaucaugcauggauaaaagacccauuuaaaguacaaggucaaugaauuuuagugcaacaaaagcaugagaaguucaucguuauagguuuuguuaacacauagcuuuuaagagaccacuuacuuucuaguucugauguagugucaaauaagacuauucacauuuaucagaaaaggcuauuaaaaugccccuccucuuucaaccucauaucugugugagauuugauuuccuucauauauguauguugugauauguauauuugaucuauuuugauacauauugugauauguaucaaagcaacauaucacgacacacagaaugcaaaaacagauguggaauccaguugucuucuauugaaauagacuuuaggccagacacaguggcucagggguguaaucccagcacuuaugaggcugaggugagaggaucacuugaagccgggaguuuaagaccagccugggcaacauagcaagaccccaucucuacaaaaacaagacuuaaaagagauuuacaaaaaugugaaagaaggccauucuucuuacuguuuuguuuuuauaaaaaaaauguuuuucauaaaaaugucauacaugcugcauauaaagggugguguuuuuaaagagaaaauaauauuuuaaaauuugcuaaguuuuaauuucuaauguggcaaauaucaguaaauauauccacaaaaauaaaagcucuuuaggucuuugauaauuuucaagaguauaaaaugggucuugagaacaaugaguuuagaagcaacuacugaaaggcguucccuuaauauaccugccaccauuacucuguauuuauuauaugcucaguaauuuaauuguagcuauuuaucuauuuuuuuuuuagcuaaucugguuuuaagggaauugaaaguaaaauuaaaugcucuuuuugcuucuagaaaguaaacuuuuucauauugaaggaacuuuguagagcagcuuugaauuuuuuguauuccgcauucugagaguuugaauacucuuagagaacuuaguuuuuaaaaacccaugcaguuuuccauaacuaaauucauaauuuuuuuucauaaaugauuaugguaguuuuuugguuguuuguuuugagacagggucuugcucugucacccuggcugaagucuaguggugcaaucucagcucacuacaaccuucgccuucuggguucaagcgauucuggugccucagccucccaaauagcugcaauuacaggggugcccaccacgcccagcuaauuuuuguauuuuuaguagagaugggguuucaccauguuguucaggcuggucucgaacuccuggccucaagcaaucugccugccuuggccucccaaaaugcugggauuacaggugugagccaucacaccuggcuuugauuaugguaguuuuauguuuggaguauuucauuaaauuuaauaaauaugaguguuucaaguauuacucuucacugucauuaaauggugaguuuauucuggaaauuccuauacuuuugcucguuuaauacuuugccauuugaagaguaaauuacuuuuugcauuuccuuccuuaaaaaggaaauguguggguuaccuguguuugaauaacaaauuauaugcuauuuacauaugcuuucauaaagucucuucuugggcauaguuuauguuguuauuucccuuauaauaauuguuacucucucucucuuuuuucuuucucuuuccuucccccagccacuauuuccuuuucacucuuuuuccuucuccuucucuuuguuugcuaaccugcauguaaugcucuuuauucccaaucccaaaaugaauggcagugaagagaaauacuucaggaugcuaaggcggguggaucagaugaggucaggaguucaaaaccagccugaccaacauggugaaacccugucucuacucaaaauagaaaaguuagcugggcauuguggcggacaccuguaaucccagcuauuugggaaguuuaggcaggagaauugcuugaacccgggaggcggagguugcagugagccaagaucaugccacugcaugacagagcgagacuucaucucaaaaaaaaaaaaaaaaaaaagcaaaaggaaugucaaggacuauaaaaaauuuaccuuuggcugggugcgguugcugacaccuguaaucccagcacuuuggaaggcccagcaggcagauugcuugagcucaggaguucaagaccagucugggcaauauggcaaaaaccugccucuauaaaaaauuucaaaauuagccagguguggcggugugcaccucuagucccagccaguugggaggcugagaugguaggaucaguugugcccgggagguugaggcuucagcgagucaugaucaagccauuucauucuagccugguugacagaacaagacccugucucaaaaagaggaagaaaaaaacaacaacuacuuuuaucagggaauacucugagugcuuuaaauuuugcuuccaaccucuacaaugcaagccaggcaaauuuuacccacaaggcaacaagaaauucugauuauuccaugagauaguauauucaauucugucucuauuucuuccuuuuuuuuuuuuuuuuugguugcauaguaaauaugacuucuugugaaggagggucauauaacuuugaguauuuauacuauaaguuguucucugucccucugaaaauucuacccuuuucccacgaucagugaaaaucagaagucuaggaacuagugauauagacagauauuuucacuaaugauagaaaauggcuuauauaauaauaccauaucacauuuaauuaauuuuguuuaggagagauuguuucauuucauuccaaccaguauugaaauucuaauugugaacuagaaggccauguacacaaacaccauaguucggaauccucucaggagugggagaguaggauacugaggaaacuauaacugguaauuugccuugauaugguauguuacaggauaagcacguuugcagcccuguccuuugccuuccuauaacccacuuuuaauaucaagaagagaggucagaaagcuaccuccaucuuguuaauuaauuaccaaaauugguaugaaaauaauuuguuggacuuacuucaccaaguugagaugcuagaguaaaacuuguaauuaaaugaaggaaugucaacauuguuccaguuauaaccuuucaccauuauacugaacugaaauaguauaugaguccugccuaauuaaauuucugacauuguuucuguaaccuuauucaguaaaauugauuuuuucuuuugugacauuuuucuuuaauauuuuaaucagauauaccaaguuauauauaacagcaaucucagccuaaaaaauaaauucuuccuuguuuuggcaaaauaaauuuguaauuuuccagauauuuuuuaaaguugcuucuucagaucauaauuuagaggcuucgagguaauagcgacucucucacacuagugacucaagagauaaaguuguaaacucuagccuuuauuucuggauuaucaauagauuccauauuaaauuagcaaaggaauggcaaauguuuuauaucacuuacagcaagcuuguccaacccauggcccaugggccauauauggcccaggauggcuuugaaugcagcccaacacaaauucguaaacuuucuuaaaacauuaugagauuuuuuugcgauuuuuuuuuuuaaaggucauggcuguuguuaguguuaguguauuuuauguguggcuuaagacaguucuuccauuguagcccagggaagcuaaaagauuggacaccccugacguaaacagcaauuaauaauauccaaggacaaugaagucugucuuacuccagaaugauccauguaacuuacaaccuaaaaagggaguacagaacagcacuguaauuuuauuccaaggaaauugucucuaagucgauuugucaguaaaucucaaugagauuauggaccaauaacuuuacaguuuuugauaaaaaaugguauagcaaaugaaaguuggaaucagguuaaaaggugacaaaagcucauagccguuagaaguaaaauuguguaucucaaugucauuggccuauuauggauuaauuuaauugcagcugagaaauaauuuugucaucaugauucauggacagaaggaaaacaucuuaaguuuagauucacccagaauacuucaccagguguauucaaacauaaaaguaagcacagucucugguuguggaauucuuguuuaguucaacuauguaaggauuugcuuacuuagggccacaugcacucaacgaauucauaaaguuaauaguggugaagccucaagaagcuacgaauuaaccauuucaggcaucccuuugaauggagucauggugagaauagggucugagagauccauuaaagcuuuuucuuaacccuuuguuuuauuuucccuaugaaggacuagcccgagccaagucaguucccacaaagaccuacucaaaugaaguugucacacuaugguaccggccaccugaugugcuucuugguuccucggaguacucaacacagauugacaugugguaaauauauacagaugucacugacauuuauaauuuugaaagaauguaacuguuaaugcaagauguauugauaaguauauacuuuuaaggagauauuauuuuaaagagccauaauguaacagugauuaaugaguucuggcaugggaauuagauuaccuagguuuaaauaccaauucugccauuuagaacuauguguuaacuuuauucaaauuacuggccuuugccucaguuuccucauuuaaggaaaugggaauaguaacaauaacuacuuugaaguguuguaggugauguuaagauuaaaugaacacucagaagagugcuuuaugagacacucaagaguaucugauacauaguaauuuaaaacaaaauuaucauuuuaucaucauuuaauauucaccaaaaucuuucugcuuuaacuugaacuaaaaguaauaaucaaaauauuguagucaucuuucucacacaccgcuucgauccugacacucuucuacucagacaccguuauugccacccccuucauuaccuauagaauaagguacaauuaauuccucaaucugauacuuaaggauuuccauaagaugucucuaaacuaccuuuuccaacuuauuucagacuguuucucaacacaaauguucccuuuuagcaaaauggcauacucacuauaucucaggaauaauguggacuuuccuaccuuugcucuugguguucauaccaguccacccaucuggaaugcccacuccggugcucuaacuugggcucauuccuaguaacguucaaaauacagcuuuucauaaauccuuuccugaauauacucuagccucuguuggcaguuccuuccucugaacugugguugcauuuauuuucuauguucuucaugugguaauaagucauauaccgauuucuguugcugucuugaacaguuuauguaaaaugucucguauaacuuuuuaaaauuaauuuuuaauauuguaaaauacucauaaaauuuaucauuuuaaccaauuuaaguguacaguugugagacauuaaguacauuuauauuguuaugcaaccaucaccacuaucuaucuaccuccagaaucuuuuucaucuugcaaaaccaaaacucuguacccacuuaacaauuucuuccuauuccccucccccaccaucaguuucugguaaccacuguucuauaauacuuucugucuccauaaauuugacuguucuaaguaccacuuaugaguagaaucaugcagugugugucuuuucaugacuggcuuacuucauuuggcauaaugucuuuaagguucauucacguuguaguguaugccagaauuuccuuccuuuuuaaggcuaaaaauacuccauuaaauauauauuccacauucuguuacccauuuauccauugauggacauuugguuugcuuccaccuuuugacuauuguaaauaaugcuguugugcacauggguauacaaauaccuuuucaggacccugcuuucaauuaucucucucuccuucucuuuuucuuuuuaagagacauugucucaccauguuguccaggcuggucuuagacuccugggcucaagcaguccuccugcauuggccugauuucaguucuuuuagauauauaccuaggaguagaauugcuggaucauauaguaauucuacuuuuaauuuuuugaggaaccaccauacuauuuuccauagcaacuauaucauuuuacuuucuauauaacacuuaauauguaaaauuaacuuuuauauauaguugcuagauuacgagcccuuuaauggaaggauuaugucuuaaacuguguguguacauacaguuccuagaugacuguucuaagaaccaccauucuauucucugaaccaccauccuuuucuuuuccuucacuuacacacaccgccuuguaccaacauguucuaccucugcuuccugcaucaaaacgucuugaaucauuuguuucucuccauuucuccugccuagcuucacucacugucaucuccuagauuaccauaauaucucuucaguuguuuuuccccacuccugucuuugcuguucaauccauggucuacacuauugcuaauacaaggauucagugagauaauuggugcacuuaaaaaacauuucuaacacauaguaaaucuucagucacuguuagcuguuguuaguguuauucuucaaggauuaugcaaaggagaguuggacauuuuaagugggaaaaauggauauagcaauauagaaauugagacaaauaggguaaaugcgaacaaauuaguuagaucuaaaauaucccuucaagagguuuuccgacaggcuagugcaaaauucugcagagaggcaaccuuaaggaaaagauucuugugcuucauaauauguaaaugaauugcuaaauuauuuucaugaucuauuuuaaagggguguugguugcauuuucuuugaaauggcuucuggaagaccuuuauuuccaggaucaaccguggaagaugaacugcacuuaauuuuccgacugcuagguaacagaagaaaucuuuucccagugauuuugcacccauaauugacuagcuggauaagacuguaucucuaaaauacauauuuuaaaauuagauacugagacuaacauaaacagcuguuaguuagaauaauuagaauggacacuaugaagauagauccuucuagguaacuucaucugcuaaguuuuaucuuugcaauaaagauuuuauggaaaaacagaacauaauuaguauggaaaauuggaugucaccauauuauuaaggaauauugcuaacuuuuuugguaucaacuggauagaaaaaggaccaggcauccuuuuuacaguaucauugcaaaguccaaacaaaaaguccauguacguuuauuucugucauuucaauugcaguugaaauaguuaagucaucugguaaauguaaauuauucucuaagacacuuuguuauauauauguguauauaauuuuuauauauaaauuuuauauauauuuauaaauauauuuaauuuuuuuuuuuaauucaggaacuccaucucaggaaacuuggccagguauuucuucaaaugaggaguucaagaacuacaacuuuccaaaauauaaaccacagccucuaauuaaccacgcacccagguauuuuuuuuucuuaugugaaaggggggaaaacacaugauucuuuucaaucuuuugaaggauuagccacaguaaggauucaggaaaaaauacauaauacacauaacccuuacguauuuuaggaucuuauuuaauuuugaacuguauauguuuuagaauucuagaguuuauguaguuacuuuucccagaaagaagacauugauuaaugccuuauuccguaccacagagauuaugaugaaauuccuguuuugcuuucuacagaauuauucuguauuuacuuaacaaaaaccuaagaaaggguuauguaaguaaaaucuugacucuauaacacaagguaaccuaucaguauuuugaccaguguuaaugauguaauucauauuugaagaauauaaacucuguccaauuccuuagcaaaauguaacaucuaaaugucagccauucauuuaaguuucuucuuagaccuaccccaagaucaauccaaggcucccaauaaaauuugagucagaacauuuuuacuuguagaauguauuacauuuucaggagauaacauagaauaaccccuuugacugcauuuuccaucucccugcccccaacccccccaaauuuugaaagucaccaagauaccaaauaaggacaucauuuauuuuaacccaaagccauucacauugcucacaacauaacacacuuguuaugcuuccuuuuauuuucaagcuaaggaaggaagagcaaaacaguuaugacaccaaaaauauuuuuaaaguauuuaugugaguugguacucuuauuguuacuauagcaacuaauaccauucuaacuagauuuucuuaggaagaauaauaauacuugcugggcuuuuuuugcaugucucucccaaguagcauaaauucuauuuuuguccuuuaauuauuuuuugguaauguucaguguagaagguugaagcuuuucuuugaagcagagucuccaugacuuagugccuaguuugugcccagggaacucuggauaugugcuagaauggcaaacuacauagaaugucuagacugcagcauccacaggacccacuugagagcacuuggaaaaaaacguuaccuuauucauaauuguacuucuaccagugaaaggcaguguaagauagaaccuguuauuucugaucaagagauuauuccauuaagauaaucccaggccgggcacggugauucacgccuguaaucccagcacuuuaggggggccaaggcaggcggaucaccugagguugggaguuugagaccagccugaccaacauggagaaacccugucuacuaaaaauacaaaaaauuagccggacgugguggugcaugccuguaauccuagcuacucgggaggcugaggcaggagaaucacgugaacccaggagguagagagguugcagugagccgggaucgcaccuuugcacuccagccuaggcaacaagagcgaaacaccaucucaaaaaaaaaaaaaagauaaucccuaacccuacuaccccuaguuauacuaauuucaucuuuauuaugucauuaguuuuauaucccuuauugaugaauuuuuuuuuuuuuuuuuuuuuugggagacagagucucgcucuuccgcccaggccagacugcaguggugcuaucucaggucacugcaagccccaccucccggguucacgccauucuccugccucagccucccgaguagcugggacuacaggcgccugccccugcgccuggcuaauuuuuaguagagacgggguuucacuauguuagccaggauggucucgaucuccugaccucgugauccacccgccucggccucccaaagugcugggauuacaggcgugagccacugcaccuggccaccauugaugaaguuuuaugaaguuauuguagcauauuuaaauugaacucaauaccuucuaguacccggugcuaagcagacaacucuaaaaauuugcugaauagcucauuucuguguuugucuugaacaacagugauacauuuuggggucacuugucucuguuuucaccuauauaauaggaaaaugaugcucuuauauacuugcguuuagugaaagacugcgaaaagugauacaauauguaagcuuucuuaauauugaaguuucuuuguuuugagacagcauggugauuuuuaaaauucuuuaauuuguucuuggauauugaaaauucaaauugaagccaaguuauuuauggcuuauccuuaaacaaauagcaaggccagucuuuuaagacuaaaacagauuugugucuauuugaagacaacaagagugacuauuuuagggcauuuaaauuuagcagauuaaaacacuuagaaaauaguuuuaucugaaaaguuuuaucagcuaagagagcauaaauuuuuacuuguucuuuguuguuucuagguuagacucugaaggaauugaguugauaacaaaauuucuucagguaagucaguucuuacaguaauuguuaaauagguuguuaagccucagcuucuucauguguagaaugggcucaguaguacuuccucgguauuguuaaugacaaauaaaauuaucuaugcuuaaggcacauguuuaaguuaaaaaaaaaaaaaaaaacaugguuucuccuaaugugucugggucucuugucaccuacaacagucugagguaguugguuacuggcauugaucagcugugucaaggccacauucucugcaauugaugcucucuaugcucucuuauguucucuuuuccuuauacguacagccuuuggaggaugcucugccuccaaaugccauucauauuucccuccaaagcaggaauaaggggggacgauaaggguaguaccagccacauuaguccucuugaaacuuggaagcaaaagcuuuacagaaaccccuacaagguuucuuuccaagucuuauuggccagaacauuaauuguaggaaagacugggaauuggggagcagaauugucauaauuagccaaaauuuaaaacaguuaugauucaugauucaucuaucagaguugauggacaccuugaacaaaccuagguuguaucaucaaaaaaaaaagggaaaugaguauuggauaggucguuaagaaugacugccauaaaaauacuggguauauguccaccaguccuuugguguucaugaagagaaguaacuacacaggucaaauauuuuaauuuuucuuugcuucagaaaauacaagcaauguaaauucuuguuuaagauccagccuuaucuuagaaauguggaacugagauguuauuacacaaucucagcagcgacucaaauuagaguauaacuggaguauuccaaauuguugauugaaaaauagucaucauauuaaauaaucaagauuuuuuuuaaguagcucuaaaugcuaauuugcccaucuccuacuuuuugcaguaauuagagaaaaagcuaaugaagcaguucuuugcuuuuucacaguaugaaucuaagaaaaggguuucagcugaagaggccaugaaacauguguacuuucgaagucugggaccaagaauacaugcuuuaccagaaaguaagagaaauccuaaaguguuuucccugcuuuauuuuuauuuguccaagguuagggucuggggugauuggggagauggcuauugauuuuuaagccuaagauucuagucuucucuauaguuagauuagaauuucuugaagggaggugugugucuuauuucccuaugauucaguuauuucuuguaacacugagcacauugucacuccucuguaggaaaccaauaguacuuaggcaaggaucauuaaucuuauuggacuuuaguugaaacaugccaucugaugacaggcauugucccuaggcccaaucuagcuucgauuuagcguuguuaaaagugaauuucaaacaaaaacuaaugaagcauaaccgaaacauaaauuguuuucuugugaaaauacauuuuuucuuaagauacaaagaugauuuuccuuuauuguggucacacugacuuuacuauccccaugacagcagugagcauauugucaaagucacuguaauagcagauuucccaugccugaauaacauugauuuuacucuuaacauucuauuuuuagauuaccacaguauuuuacuuuaaaauagaguaaggugaguggggaauuagaagaauguuugggaacuaagcugccaaaagcuuucauuaauuuccuauucucauuuauuagacaauauugauucaucaaagcuuguguagcagucagugacaaagcuaauuggaauaaaaaauccuuaauacuuuucacuucaacuuuacuggauauauuuaaaugaaagaauaccucucugacagagauuggaaaugaaaaagauaaauuacaaguuuucuuuuaaagauauuuguauuucacugggcgcgauggcucaugccuguaaucccagcacuuugggaggccaaggcgggcggaucacgaggucaggaguucgagaccaggcugaccaacauggggaaaccccgucucuacuaaaaauacaaaaauuagcugggcgugguggcgcguaccuguaaucccagcuacucaggagacugaggcaggagaacugcuugaaccugggaggcggagguugcagugagccaagaucaugccacugcacucuagccugggugagagagugagacuccgucucaaaaagaaaaagguauuuguguuucauuauuaauaccaaguuuuacuuugagguaggcaguuaugguuauacaaaccuuuuccuuguuuuucgcuaaaauuccaaagauagcuugagggccugguaccuucaugucauuguaaggagacagagaaaggacagagagaauuaacaccuaguauaauaauauauuuugacugggucucccaaccccagaaaguccuggaacagacaguguauauucuccucagagaaacacuugcccacagccugcucugacacagaguuggaagaagaaagguucuaaagguggauugcuucauucauuuaguuuucuccucaacacacugggacaaaaaggaaaaauuucagcagggcuaucaccuuguaaaaugguuucauauugaaucaguauaugcuuuauaaacauuuguugauaguaggguuguguuuguuuuaauguuagaccuucaccuaauaauuuuugucuaugcauuuuagguguaucaauauucaguuugaaagagauucaguugcaaaaggacccggguuuucgaaauucuucuuauccagagacagguguguuugucauaaaccauuucacgugucgaucaugaauuuuugcguggaaccaagcuuuugguuuauaaauugaucaguaaaauuauugauguaaaaaccaauguacagugcauuccacaacuguuuauguuuagcauugcacguacucacuuuucuguaugaugugggcagcucaguaaaucuucagagaaaaaucugacucagucaagucagggauccugaaagcugcagauggcacaaagaccuuuuacaagugaccuggcuugaucacugcacacgccaucccugguaccugaggcagaagacacaucuugugcuucccuagucaucagguucaucacuucgaagcauagaagcuguagacugaccccgucaacagaagggucauuuaagacagugcugaucacucuuaccauggaauauuagcuuuugcuggugggaacauuagcuuccuagucaccaaauaacuguaugugggauaaaacugaaccuugaacugccucauaaaaugacuuuauauuuuaggacaugggaagaacagaagacagagcaugcucuuuuaagucugauaacaugguuucaagcccagcccccagccuuucuuaccaaucaaggacucagaacugaaggcaauuauuucuuuugguggacuuggaaucuccguuugucuacacuguccucuucacaguggagucuuuuuauuucagaccuacagauuguuuuuauauuuguugucacagugugacaauuuuuuguacagucgguuuuaaggucuucucugccauuagagccaguagguuacagcuauugauguaacuauagcugcaauuuuugugcaggacugagaaacacagugcauuauuuauugcggaaucauugcugcuaaauaacuacugucuguuuauuuaacacaacaauugaaugccugaagaaguugcaguggcuuuauuauaugugaaugcaucuguuucuccucacgaauuguuuuacugcugcauuuuuuguuuuuaaaauuaaacugcaguguuuccuggaauguaaauuuagcuuugcuuaauaguaaaauaagugagccaucuugaacacuuuaaguuuauacuauauaauuucuuaaugaacauuggcaaauagaguagcuaagagauugacaagcacauuacguuuagauaagcaugugaugcagaaguugauucaagcaagugaaucccugacauuuugaggaucucacauuagacaccaacaaauuaaagcuccaaaauuauuuauuuuuuauguguuccucacuuuagaaacgucuacugcauauuacuggauauuuguauacuaauacacuuaccuauuuuacauuguguuuuaaauuuaguuaaaacuuaaccguagaagucuguucaaacgcgaaaggucuugcuuuguuuguuuuaaauacauuuauuuuauuagaaaggaugauauuucauuggggaauaguuucuuucauuugggggcuauguguuucaauaacauucacuuggaaucagcugaaagcuguaauaugucuuugaaaugagccaugauaaauuacaaacaagagaaaugagaacuuacaggauugcuugaaauuauuguggguauuaucuguuuaccagagauacuaaauauuaguuuuaauuaugcaucucuuugaacaucauaaacacacuuugguguugguaacaguauuuuaagcauuuuuguucacuuuuaaggacuauuuguuuagugcaucuuacaaacuauaaaucuuaauugguauauuuugaaauggucguguaaauuuuugccuuauauaucaugaaaauagucauaacuuaauuucuuuuccugaaauucacuguaaaacauucagggguccuaccauuucuguucaggaaaucuuguaguuuauuguuguuauuuaacaguauuaaguggauuuuuguauauuucauuuuaacuuuauuugugaauagugauuguggcauguuugggguguuauuuuaauauuucacgauacuaaaauuuuaauuuuaaaaaauucuggaagaaacagauucauguguaauggugaauauuggaccacuacugcuuuucacauuuguaaauugguuuuauguuaaaccuuguagccuaacaaacugcuguucuuucuaacugacagacauguauuaauauuguacuuugaagguuauaaauauguggaaauuccuucauuuuguuuugaaauuuauaauaacaaaaucuccauguuguuaaaaugugguuuuauugagucacaguucuuucuuggggaugaaggcugugccgagugggguccuuuucuuuuaugggucguucuuaagauaaugaagucucacugugcuagagguguuauuguuuucuguuugugccaaucauuugcuuaguaauuucugcuggguuuuuuuuauagcacucucaauuauaaaguaucaaauuugucacuucauagaauguauauuugauuuguugcaaauuugacauuauagcuuuucauaggcuuaauucuugcguauaaaagaugaaaauauauauccauuuguuacauaaaguguuucuuccuaggaauuccuagggguauuucuucauuuuauuaaggaauuugacaagcaaacaaguguuuguuuuuuuguuuuauuuuugauacucgagcaccauucagauccugaaaacacugcagugaagggaauugaaacuccgaaacuuggaacuuugaauaccugugauuccucuuaaacugguaagauucuuaaagguaagagaagaugccuuuuauauuuucuuuccaagugguacugugaacacacauuggaugugucauucuagguguauagaguggcugcauucugucugaggcuuuaucaacuuucauuugaaaggcuauuuguuaacauguuauaaucugucuuuuggacucgggacaauuuauguagguucuuuuuaucuuuuaaaaauuguguugagacauauauauauauauauauauauauauauauauauauauauauauaucauaaaauuuggcauuguaauuauuuguauguguacaguucaguggcauaauuauagccacaaaguuguauaacaguuaccacugucuacuucuaaaauguuucauuacuccaaacagaaacucugaaccauuuuacccuuccccgcagccccugguaaccgcuaaucuacuuucugucucugugaauuugcccauucuagguauuucaaauaaguggagucauaccauauuugucguuuugggucuggcuuauuucauucagcauaauguucacaguucauccauguuuagcauguaucagaacuucauuucuuaucaugacugaauaauauucuauuaugauuauacacauuuuguuuaucgauuuaucuguugauggacacuaggauaucccaucuuuuggcuuuugugaauaaugcugugugaacauugggguauaagcaucuguuugaguccuuguuuuuaauuauuuggggaauacauacaccuaggaguggaauugcugggucauauaauucuguguuugacuguuugaggaacugccaaaauguuuuccacaguggcuguacuauuugauauuugcaguaguaaugcaugagaguuccaguuucuccucauccuugcuaauucuuuuuuuccuccuuuuuauuacauuuauucuaauaaguugaagugguauuucauuguaguuuuuauuugcauuuaccuaaugcuuagugauguggaacaucuuuucauacuuuuuuggcuauuuguuuauuugcuuuggauaaaccuuuauccaaagguuuauucaaguacuuuguccauuuuaaaaauaggguugcuugucuuuuugucaucgaguuuaaaaauucuuuauguauuuuggcuguuacaccuuuaugagguauuugauuuguaauuauuuucuccuguucuuuggguucucuuucacuuucuuugguguccuuuuguugcacaaaaguuuuauuuuauuuuauuuuuauuguuauuauuuucugagacggagccuugcucuguuguccacacuggagugcaguggugcaaucucggcucacugcuaccucugccuccuggguucaagcgauucuccugacucagccucccaaguagcugggauuauaggcaugugccaccaugcccagcuaauuuuuacguuuuuaguagagaugggguuucaccauguuggccaggcuggucucgaacuccugaccuugugauccgcccauuucagccucccaaagugcugggauuacaggugugagccaccacgcacagccaaaaguuuuuaauuuaacgacaucuauuuuaucucguuuguugccugugcuuuuggugauuuaagaaaguauugucacguuucaaaggucauaaauauuugcucuuauauuuuccuuuaagaguuuauuauauuuuuagcugucagauuuagagcuuugauccauuuaaauuuuuaugugugauacaaaguaaggguccgacuuuauuuugcauaugaauaucaauuuuuuuuuccagcaccauuuguugaaaagacuguccuuuccccauuaaguggucuuggugcccuucucagaaaucaguugaccauagaugugagguuuauuucugggcugucaggucuguuccauuagucuauaugucuguccauaaggguuuguagcacaauguuuugauuacugucuuuagaacguuuuaaaucagaaaaugugagucuuccaacuuuguucucuuucucaagauuguuguagcuauucagagucucuugaaauucaauaugaauuuuaagaugggauuuucuauuucugcaacaacaacaaaacaccauuggaauuaugauaggguuugcauuaaauuagaaucuauagaucacuuuggguaguauuacaauuuuaauaauauuaaaucuuccaguccaugaacacaagauuucuuuccauuuaguuaggucaucuauaauuucagcaacauuuuguaguuuucagcauacaagucuuuugccuucuuaaauuuauuccuaagcaucuuauucuuauugauguuauuguagauggaguuguuuucuuaauuucuuuuuggauuuuuucauugcuaguguauagaaauacaaguaauuuuuguguguuccuuuuguauccugcagcuuugcuaaauuugauuauuagcacuaacaggguuucuguagagucuuuaggguuuucuauacauaugaucuuguuaccugcaaggaaugauaguuuuacuuccuccuuuauaauuuggaugcuguuuauuucuuucucuugccuaauugcucugucuaggacuuccaguacuauguugaagugaugaaggaacauauccuugucuuguuuugaucuuagggacaaagcuuucagucucucaccauugaguaugcuauuagcugugucuuucuauguauggucuuuaacguguuaaagaaguucccuucuaucccuaguuuauugaguauuuuuaucuugagaauauuggauuuucuucaaaugcuuuuucuccaucaauuaagaugaucauauuguuuucuauauuuuuuugauguguauuacauugauuuucauaugugaaaccacucuugcauuccuuggauaaauccuacuugguuaugguauguaauucuaauaggcugcugaauuuaguuugcuaaauuuuuuuuaguauuuuugccuauauucauaagguauuuggccuguaguuacuuuucuuauaguguuuuugucuggauuugguaucaggguaaugcuggcuuaauagaaugaguuaggaaguguucucuccucuucaguuuuuuggaauaguuugaggauugguguuaauucuuccuuaaauauuugguagaauucagcagugaggugaccugguccuggcuuuucuuuguucagagguuuugauuaaugauacagucucuuuguuauauauaauuuuauucagaguuuuuauuucuuguuaguuuugguaguuuguguguuucuaggaauuuguccauuuaaucucuuauaaccaguuugcugacauaaacuuuuucauaguagucucuuauaauccuuuuuauuucuguuauugauuucuaguuucauuccauugugguuagagaagauaguuuguaugauuucaguuuuuaaaaauguauuaagaguuguuuuguggccuaacauauggucuguucuggagaaugcuucauguaugcuugagaaaguaugugucauucuaugaaaaauauuguuggguagaguguuugguaugugucuguuaggucuaauugguucacaguguucaguuccucucuuucuuuacugaucugacucuuuuguacauuauugaagugggagcauugacaucuccaacuguuauugcaggauugucauauuucuccuuucaguucugugagugcaugcuucauauauuugggggcccuguuacuggcugcauauguguuuauaauuguuaccuaucuucuugguggauugaaccuuuuagcaauauauaauguccuuugucuccuguaacuuuuuuuugauacuuuagucuauuuuaucugacaaaaauauggccaccccauaccucuuuugguuacuauuuguauggaauauuuuuuccauucuuuuauuuucagccucuucaaaguaaaaauacagugucuguguuuuuaaagugagucucuuguagauagcauauugauggaucauuuuuuaaauccauccugcccaucucugcccauuaauuggagacuuuacaacauuuacauuuaaaauaauuacugauaaggaaggacuucugccauuuagcuguuuucuguaugucuuaugugcuuuuuguucuucaguuucuacauacugccuuguauuugauuuuuuuuuuuuugguaauguaccauuuuuauuuucuucuuucuuugccuguauauuuuuaguuauuuucaguuccuaucauuuuaaaauauuuauccccaaauguaaucccuucgaguuuauuauuuauaaugucagugguuuuauuuuuuaaauauucuagauucuuacauugauucuuucugauugacaaauucauccauaucagaauuuuaaguguuaacacaagcccucaagcaaggcugcugaagaauuugcauacuuuucuauguuccaaacuugaaauuuccaaaguuuuuaaugcauuacuuuagacccaagagaaagguacaacauuuuccccucuugcucaguguaaagcugaaacuauuuaaaaaaaauuuuuuuuugagauggaguuaugcucugucacccaggcuggaguacaguggugcaaucucagcucauugcaaccuccgccucucagguucaagcaauucuccugccucagcuuccugaguagcugggauuauagguacaugccaccauaccuggcugauuuuucuauauuuaguagagacgagguuucacuauguuggcuaggcuggucuugaacuccugaccucaggugauccaccugccucggccccccaaagugcugggauuacagacgugagccaccaugccuggccugaaacuauuuucuaaucuuaaauucagauucugggcuuagucagauaggaguuucccugagcugucaucauucccggcugaaguuauuacaauaaucaguuuccaucacugacccagaaaaucacugaaguuaccaauuuucuguuagacucaaacagaaagaaggugaccaagccacugauuauaaagcuacuuugauuagaggagaauauaaaauuucaaucugugaugauggggaggauuuuucauugguggguucccccuaagagaagugggaaaauuccacuaauuugaaaacccauuuuucaaagauuaccauuucaaagacuguaaacuaaaccucuguugaguagagugggugugggggcuagaugugcaggugugcaucugugagagggggacagggagagaaagacugaagcuggaauaggaauccugauggcuguucuugcuacucucucccaccuuaacgcugcugcaguagugaugcagagauaccugggcuggaucauaaagaugugaagauguagcuggugacccucuggauaauaugcagcaccuuucagaggguaagggaaacuuagcgucugccaacagucuuguauguuuaccaaaggauggcuccacugggcucugauugaccuauggaauuuuagugaauagacuugggacuuaacgcaagacucccuugggacucuuuugagucuuuccuagaacagugcuaguugaaacagugccacucuccagccguuucuccagcuauauugacaauaguuccacauucuaacagucaaaauagucuuaaggaucaucuuuaucuuguuauuuucuuccucauguauguaugcagcugagguugucaagugaugaaugggugacguggugcuguuacaggcuguguagcucaucucuggaugaugaugauggacuguuauuccagaaacacugaaaaaguuuauuuuugagggccccauccugccaucuugcucuuccacagaaucguagcuaaucacugugucauuuacuccucagggaucuagaagcguuccuccuuccucccuuuucaauuucgacucuguugcuacugguaucuacauuacuaucccauaugaugaugagauaggcuuuguucucugugaggguaaauccagccauauugaucuuuugaguuccucacaccucaccucauugugaaacauccccuuuccucugcuuguucaucuaugccucuucucuuuguuacccuuacucauucucaauguaauuuuuucuuccagaaagccuucucugccccaccuacccuaccacagacuggguuaugugcucugcugcuuaacugccuuccuucccaauagcauccuuauacuucacucugcaacaacacuuaaucacacgucauuucuucucacuaauccacaagcuccaugaaggagaggauugcauuuugcucuucuuuauccuaguaccugauacauuuuaggggaacaguaguauuugcugaucaaauuaaggcacacaugcaugaugaaauucugaguaauucuaaaaaaucuuuugucaguuauguaauaucaacuuggauucguccccucucugagucaaccaaagacaaaugucgcugucaaaaauuggugauagaaacuuucuuccuagcuggcuaaaacaugugagucuuuaaaaucuuaagaacuaaccuaugaucaagcuguucucaacacacacacacacacacacgcacacacacacacagauaugcagguacacacgcgccacuggggagugggucuaggaauaaagucaauacuagagaaaucuagguagggccagcuucuugaugacagaaaauuugccugcccucccaggaaacacugauauagcaaacaugucugaaagguuuaugugcaccagguacuguucuaugugaagauguaaauugcuaauuuacauucguuggaaguccuauagauuaagaccauggccucucaaucaaaaugcuguuugaaaucuggccaauucugugaccuugagccaguuccuuaaucacucuaggcuucaauuuccuuaucuguaaaaugguauauaauaguacuucuaucauagguuuauuaggaagauuaaguaauccauguaacaugcuuagaacagugccuggcaugacagcaaccuuacaaaugguugcuaucauuaacugaaauuaugccauccagcaaugaaauaaaaccauguuuuagagaucugacucaccugagagaggguaacuaaacauaguguauucuucagugccaauccuuuaggcagggucauauaaucccagguaacacgaaggggcggcgcagaucccuguggguauuuaagcauaaaagggcauuuuacaaaacugauuugaauucuuuuuuuuuuuuuuugagauguaguuucgcucucgucauccaggcuggagugcaguggcaugaucucggcucacugcaaccuccaccucccagauccaggugauucuccugccucagccucccgcguagcugggauuacaggcgcuugccaucaugcccaacuaauuuuugcguauuuaguagagacgggguuucaccauguuggccaggcuggucuugaacuccugaccucaggugauccacucgccugggccucccaaagugcugggauuacaggcgugagccaccgcacccagccaguugaauucuuauguauaaacagaaccaagcaaauuauuaaugagaacagggaucggguuuccaucccccguuucuaaaauggcaccuggaacauaguugaucuuuaaauguuucuucaggaagcaaaugauuuccuaccgccaccuguguuacacuauauguagcugugaguuaucuguggccuuuuggcacgcuagugauacugaauguguuguuuagggacugcauuaaucugcuuucucccugcauccccuccccuccccucacaccagucucccuauaucaaacccugaguggagacugcuuugaaucacccaugaaaaccagagccaggucagccugguauugagaccaagagaaauaauaaccuuuaucaccaagccuagcaguucacauuccccugaaucaacaaaauggcuaaaagaauaaaugguagauuugauuuuccccuaccuucucacuuccuccuccuccucaauacagagcaguugauagaacuuaaauaagaucaggggucugcuuuucaauccauuccauucucccacaagucagccucaauaauuacauuuauuucuuaaaauauguguauguaaagcacuuuuuuuuuggaugugcugucuuuaaggguaggugacaagacucauuuuccaacuuguauccauauggaaaagugguuugggucaccccaagcaaauggaaguaagccaauccaguuaccucuaaacaccuuuuaucacaaaguuuuuauugaacaaaaauaauaugacaguaaaaaugauacauaaagugaagauuugcagucauagaaaagauguguacaaagagaccaacauucagguuauauaguucuauaaaacuuuucccauagcaguuuaacacugauuaagcagacauaaaagggaaaagaaagucauuaauguucuuugaaaccuauuuucugaguaaaauaccucugcuaacacacacaugcacacacacacagaaugaggcagagcuauaugagugaguuauucuucaguuccuccaguucucuguuuguguuacaggaguauuuucauccaucaaaaaauuguaguauuuuugcauuucuaauaaauggaucuagagcauacauuaaucccaguuuccaaaggaaaagaaagaaucagaucuauagucauuuaaauauuuccaaucagcauuuacguaaacaaguauacuaaaaauaguaguuuugguugagauuuuugcacauuaacuuccuuuaguuuguaagaaucaugcauuuuggauguguucucuuaucugacaacacaguuuuaaaugcugucuuuaucuguuuuguuuguuuuacuaauaacacguaguuuugaaccaguaauuacuuaacagcuaggcaugggggagacagaauuggacugagcaccaaucauuguucuaccuucagugagcugugcagccauaggcaacucccagcuucugcugugcaccugucuugagcuggaaacagguggcgggaagcauucucaaaggccccuucuagcacuaacuuuguauguucaguaaauaucaguucccuggaccagcuccuuuuauucugguacagaauuauucuuagccuaugggguggggguggggggacaguagugucuauuauuugugaauuuuggaaccagugucauuacuuuacagucaaggaggcauguuagaguguuuggauuuuuaucccuugauaagggcccacauccccacauacagagaugcucaauuccaauugaaaaaccucagaauuucuaagugucaaagcaauagucuagauuuuuuucugaaaauucaagaaauguguuuucucaaaucucuuuuuuuauccuuucucauaauccugccacuuaaugcccaguuuggaucaguuauuuagucacauuucaaguuaguuuuuaucaucacuuauaguuaaggauuguaauuaaucuugaauuuaaagcuuggugcuuuucaguuuucuuguauuagaacuuuccuucuucauguacaggugugguaccuuuggacuggugccugcugauuuucugauggaacagaaaauaugucuguauuaucacugcuccaaauuacauuacacaacagaauuuacuggaguguuccaaguuaucaucaguucaguuccacgaugaugagguuccuguagaauuuuucaucugucagauuuccuucauucuccccuaacuuuaguaauacauaaagcaguguauccucucucaguuuccacaagcaaggccuuuaguaccuccacucucuauuuguauuacagcaaguuuuugauccaucaaaaauugugaacaccuaccuauacugaugaagauaccuaguguuaaaaaugguuucuuuguuguuuggguucaucaccacucugugagcuucuucuaaagcauuagauuuuuuaaauguuaauuauaguuccaggggaaccccaacuuacuuauacugacacaguaaauauaucagauggucgggauucccuauggaaaacugagaaaaccagggcuaauuuuuugaaauaagaauaugcuaaccuaggagauauucuugggccuggaauagcaugaacuugauguagcuuuuccaucucagauuuuugucugggaggcaucuaaaagauaagauacuguaaacagcuaaggaggcuagccuuucaagguccauucuuuugaaaauguacuuuagaacauuuucuuuuaucaauguuuauugucuaaauauggcuuaguuuauuauaaaaacauuacuuggacauuuacugaauuucaguucaaaagagguucuaaggcaauucuuauacaauugaaaguaaaacaaaacgugauauaugcuuucauauugcccacuggugaaaaauaaugaaauucuacuagagagcuguuugauacuaauuuucaucuuucaaacauuuccucuuaauacuaaaaaauauauaaaucauucauuuacauuaaaugcgaaggaaggcacaacugguuauagucuauauaagcacacaguuuagcauacucagaacuaaagagaaaaaagcuucacauccuuauuaguuauacugaaaaccauuaagaaaaguucuucacugucaacaguguucaacacuuaagagcuaaaaggauauaaaaacaaaaacauuaaaauucacuuaaugccaaacagauuuucauauauacuugaauauaucaaaaacaguuuuuaaaaugcuaacauaaaucuagacuauccauguuaugaaaagugcaaaccaaauuaacaagaguuucacaauguccuucucacgacacagguaaacuagcccguggggacaaauuuguuucaucaguuaaugaguccuuaauuguggccagacgucaucaggauuucugagaguuugaagaaagcaguacuggagaagcagcucuguccagacuggggauuggcacuggcauguggccauuaagcaguguggggaacuguaggggacaaaagauuuuuacaauaauuauugcaaauccauugggaagaacuuagguucuuuacauucccauacaguccauagcaguccauuucucucaucaccccugugauagagauuaguugccaauguauuuuacagaauaauuggaagaugacaaugagaucaagauuuacauagagcaaacaaaggauaaggcccagaaaaugucccuaauuauucuauaugcauaggcuacuaggaaaaaauauauaauuuauauguugcuaaagcaucuucuaacacuauuuuuuaaaaguucuaagcuacucaggaugcugauaaugcuauaaauauuaaaauaauguuuaauauuaaauauuaaaagaguguuuugaaaaccauagacucuuuacaugugagucaguaauuucuaauacuauauuuugaaauuugccaucaguuuuucaggguacuacaaagaugauucuugcagcauuuauucuaaaguaagaaauguauuuaaagauuuagaauagauuauuuuggagcuaagaaaguauucuaauuaaaauaucacacagaucacucauaagugacaaagaauaagauuucuguauuguuguucacuaagaugauaaauauaguaggaugacaguauaugcucugauaaugaguuucaggucugaaacaaauauguuaguugcaaucccaacugaacaaggccuuuuaauaugugacuacuugcaacuagauuuucguuguugaggaugaugugucaaaaagaucuccugggcugucuuuucuagcuuauuuccuauuuaguccaggaaaguuaaacuucagcgccaaauaucaaauuacagagccugacacauguuagaaguacaacaaauacuuauauuuaaguaaauauguuuuugcaauuuucaaacaauuucaguaacuugugucuaguaccuuagaguuuaucaaggcuugucauuucauuugauaccuaggagcuguaacguaaguuuuguuguccccauuuuacagaugagaaaacagauuucaaauaaguucuguuggcuaaaggucacacagcuaauaagcaacacagccaaguuuuaaacaaaucuuucuguaccaacauuuuacaacuuuuuauuuugguaggaguuaggggguaucuuuaauuacuguuuuaauuucuuuaaugauuauuggcauauucaagguuuuuguuucuuuucuggaacuuuagaauuuuaacuuuuucuagaauuguauucacuucaacugcauuaucaaaucuaugcacauauaguuuauacucuuguuuaaaagguccgugcuacuaaccacucuucccauugaguuagagugaacaugggaagaugaacagauuuuaaauuuucauuuauuuauuuauuuuauuuagagauagggucuggcucugucacccaggcuggagcauagugaugcaauauuggcucacugcaaccuccaccucccagccauccucccacuucagccuccuaaguagcugggacuacagguggaugccaccaugccuagcuaauuuuuguauguuugguaaauacgagguuucaccauguugcccaggcuggucuggaacuccugagcucaagcaacuggccugccucagccucccaaagugcugggauugcagaugucagccacugugcccagccugcauuuucauucuuuuuguuuauuugcaucuucucucucuuugguguaccuuauugguguuuucaagagaaucaguuuugguauucaucuguuuugcaaaauaaauuacugauuucugcccuuauuauuucuguauacucaauggacauaguuucucuugauuagccuggcuuuucuaacauuuuuuuagucaucuuuauuaggcucuucucccaugacacuccccuauuuuaaacugcaacguuucccaaacuuuuguccccagccaccuuuucuccaguaccaugcuuggacuugacaaccauuuccauuuuagacaucuccaaccaaugccucuuucccacaaaacucgcccuucuuccauugcuuacuccaagucagugagaaugguggcugggaccacaaacuuaaaacuugagucagggcuccaccacuuacgaguguguuaucuugaauaaacuagccaauaucccugugccuuaguuucuuaucucuaaaauagaauuacugggaguauuaaaugagaagccaccaaaagugcuaagaacaacgucuugcacacaauaagucaucaaucaucaauaaauguuaacuauuguuauguuuuaucuuuauuuuuucagacaggaucacucugucgcccagguuugagugcaguggcaugcucauggcucacuacagccucaaccuccagggcucaagcagugcugccaccucagccucccuaguaguugggaccacaggcacacgccagcacacguggccaauuuuuguauuuuuuuuggagagacagggucuugcuauguugccccugauggucucgaacucuugggcucaagugauccacccaugucacccucccaaagugcugggauuacaggcaugaaccaccaugcccggccuuaacuauuguuauuuaguagcauuuccaguauguuaaucacuuaguaaucuuugcuucuacuuaauuuucaauaccuacuuuaccccucagacccagcucaaagucugccucucuugagcucaccucuaaaaugucuucuaauuauauccuguguccacuguuuuaaucucaaagaugauucucccuucaauauuuguaguaucauuuccucuagccagguauggucguugacaccuguaauccuagcccuuccuaggaagcuaaagcaggaggacugcucgagcccaggaguucaaaaccagccugagcaauauagugagaccucguuucuacaaaaaaauuucaaaacuuagccaggcuugguggcauaugccuguaguuguagucccagcuacuugagaggcugaggugggaggaucgcuugagcccaggaggcagagguugcagugagccgagauugugccaccgcacuccagccugggcagcacagcgagcucaucucaaaaaauaaaaauaaaaauuuccucuuaucuuccuguuccuuccacuuucucuucaguucuuccuccacacuaauaucagugauuguucucuaaaacagagaucucauccuccuaccuccagcuuaaaaagcguaaacauuuaacagauaaagagagaaauuccuaagccuauauucaaggcccacagcugcguuuccaaccuuaucuccuaucaccuggucccuuccugaacagacucucacguccccgucauucggcucuauucaucuaaauguacucgaucgaaauccugucccuuccucccagcugaggcgccacugcuuccuuggagccuguccaguggccagcuggaaaaagcgcgucugccccuuacuuucugcagcaguuuguuuacucauccacuauucacauauucucugucccuacaguccuugucgcagagcauugcaaauauuugcugggguuagauuuguugaacuaaaaauuacagcacacauucuuaauugaaaacuuaauuagcucuaccuuguuucaagacauaccuauuccuacuagguauauuccacauuggaacaaaaucuguuucaaaagucauggaacagacauccuuagacaagaagaaaauaauaaacuguccaagaaaaaccgaguucacuuuauuuauauaaaucaagguucuuuguuuacauuuagcacaaugucuucggugccucucuccuuaccuaaacauuucucaauuuuaaagcauaccucuuccagaaaggcgucuucucucuccuuccuuggaauucuuucauaucugcuauaaccugcuauaguaaucauauuaggggcccuucuguacaaaaaugcuucagcuguucaacuauuaccccaaggauucugaucaaccuuuccaaucaugguaauaggaaacuugccagcaucauuuaaaauguguaagccaaaucuauuuuuuucuuccuucauuacaucuauagcguacaugaaagagguuuguuguuauuuugaaagaaaauuauuuucaucaguuuaaaagggauguuggccagcguggugguaugccuguagucccagcuacuccagaggcugaaguggaggacuacuugaacccaggaguucaagaccagccuggacaacauaaugagaccccgucucuaaauuuaaaaaaaaaaaaaaguucuuaaaaaaauaagaggcacugcugauaguaaucugaauucugaauauguaucaauuguaacaucuaguuuuaaaaaucagaaaguuauuccucuaccauauuuuguuguuuaccguucucaaaauugcuauuuucaacuuuugccauacucaguugcucuuuucacaggaagacuaauaauauuuuaaaaggcaaaaaauuguuuuuccuuagucuccuggauccagccacaaaaagagagcccaaggccauacaaccugucagccauccggaauaccagcuugucuuuuuuuucaaggguuguauucugaauggcuucaggaaagagaacagguccacuuggugaaauuaaaacucuaagcagguagccuuuaaaugcaguaauuucugaugcagaauucuaaauauaaacuaggaaccucuggucugcagugcuucucaaauugguuccuagacuggguaguaucacuaggaacaugacaaaaauguuuuugggccaggcacgguggcuuacaccuguaaucgcagcaauuugggagaccaaggcaggcaggucacuugaggucaggaguuugggaccagccuggccaacauggcaaaacuccaucucuacuaaaaauacaaaaauuaacuguguguggugguacacgccuguaguccuagcuauuugggaugcugaagcaagagaaucacuuggacccaggagguggaaauugcagugagcagagaucacaccacugcacuccagccugggcaacagagugagacucugucucaaaaaaaaaaaaaaaaaaaguuuuuaucaggcccuaucccagaccuacugagucagaaacucugggaguggggcccugcaaucuuuauuuuaacucacccucuaggagauuauuuugcaugcuaacuuugagaaccauuggucuacaguagugacugaggacugaagaaacgagcggaugcacguaucccaacucccagagauccugauaacgugucgaaucacuguagacaugaaccaucauuuccuguugggaguguugggcuggaaaagguaucuaagacaaggaaucccaaagaacccccagccaauagugcuccauugcuuuccuaggagguugccaaggccugcaccaaucagguggcagaauucccaguaaggagagaaaugagaggccacuuauuauucacaaauaccuacugaacucuacagaagcucuguguuagauucuaggauuagaguaguauaacaaucccuacugccauggaguuuacuguaaccaaacaauuucuuucuauucuauuaauuuuagaauucugcugcucuaaucuuaagacuuucaggaaaugagguguuuuuaucucuccaccaaaagauuaguauuccuaauuuuaaacuuuccuaauacaacauuugcucauugcuuuuugcuauuucuaguuucucuuuuccuacccaagcugaaauuguuaaaaaucaacaugacuauagcucaaguuguugugaugggaauaagggcugugaaagagauagaaacccaauuacuccaaggauauggucacuucaugacacccuacccuaacuccacuaggaaaccaaagaagcaagauggcaaucaaaaccucuuuagcuccacccuuacaaagagacccugaaucccagcauguacagcuccuggcacagaggagguacucagcagacauuaaccuugacaagcaaaaugaccagcucagaugaucaugaagacuugcuauuaauacuggccuuucucagacuucucuuugugaauucauuuagacagucaauuauuacugagccucacuuguguaccaagccaugugccagaugcuggggacaccacagugaacaggauuccauucuggucucgagggcccauaguuuagugagaaagauugccagaucaacaggcaaucauaauacaaagugccacgugcuagaugaaaugguauccaaagagcugcaacuaacuugggguaagccacacuguggggcacaggauacaggcagggacgaugagaaaagcuagaauuugggaaagagggaguuugcacuggguccaccuuuucuucaguccugucccuaggauucuuuccaccugcacucaacauauucaaacaguaacaccuuaaucagugaguaaugaucuaugggucucaaggaggaaauacugauuucuccaugauagcaagugacgguccugcaagauucuggugugugaaugaauaaugaaggugcucgccuaguauggagaguucuauaagauaaagcagcuaagucuucauuauuuuuuaaccaaaugcccuggauucuccuuuuucauuacagaacaaggagaacuuaaugaugauucauaaaaugaugcaaguaauuuuucuaucccaggauggggaaauuguucacuauuuuuauuuucacuuuaugucaaacaaguugcuacauuaacuaggaggauuaauauuuuaaagucuuuuguggacuuuuauaaauaauaauauuuauuuucauuuuauuuuaaauauagauggggucuugcuguguugcccaggcuggucucaaacuccugggcucaaacaauccucccacccucaaccucccaaagugcugggauuacaggugugagccaucacacuggccuaaagaauaauucuuaaaguuuugccuuuuccuuaauaaauuuccuguuuucauagacaaaugaaaauaugcaaaacacuuuaagaacuaauuguuccacguaugggugucuggcaugagucugcaauuucugccucaaugaaaaugucugccucugaagggcgugcaaccccacuaacaugaacccccucuggacauuuaauauuucaacucaacauauggcaaaacucaccguuaccucugcaggauuuagagaaaaaaccaucccucagaagcuuaauguucaaaaguucauuuccaaacgcucaccuggaacagcgugcuuggcccuugcagccuggcaggacucagcggagcaacuggacuaaggcugcuccagaaauguaugcuggagagcaguggacucggagucagaagcaauccauuuggugucugggaaguaaagcaaacagacuucuucauauagguucaccugacuugggccaugaucaacagagcagcagagagagguuagguaggcuaggcaugggccaggaaacgaccuuaccaucucaggaaaacuggcaacguuaauucugaggggcugugaacaguuuaauuuuaauuuucuuuucuuuuggagacagucucgcucugucacccaggcuggagugcaauggcgcgaucuugguucacuauaaccuccacuuccuggguuuaagcgauucuccugccucagccucccaagcagcugggauuacaggcacccaccaccgacuaauuuuuguauuuuuaguagagaagggguuucauuacguuggccaggcuggucucgaacuccugaccucaagugaucugcccaccucagccucccaaagugcugggauuacaggcgugagccaccauaccuggcuggcuaguuuucuucaaugcuaauuuuauuaacacuuuuuucauaaaggaaaaagguauugacacauuaccuucccuaaacauucugguggaaaauucaaguuuguaucaacuuucguccgaaugguuuguuaacuuguuccccuucccagauuaaacaaggauuaguauacaaacaaaauaggaucccauaaaggggcuuuaauucuucuuaucuauauuuuccuguguuucuacaguggacaucuauuacuuggguuacgaacacacguuuuuaaauggucuccauaucaacagcuguuaaggcuuugggauuugcuguuaaaauacccuguagcagccucuucagaagcucugagccggguuuuccagauuccuuccggauguggaguugaugagaauucauugcccuggcaaugguuugggugggggcagggagggcccuuucuugucagauuggguauaaagccaaaacccuggguuucccaggggaguuccaaggacugaauuucuugcacacacacagcaggaguccuggccugcaagccagcaggagggcagaagaaacacccgcccagcugcuaagucugcauggcuuuuauucucaguggagacaaacuccccggcccagggugguuuuguaccuuuggugacuagaaggagucccucagugguuuugugaugucaauaaggugcuuuguguaagaagaaccacagcaaaggcgccagccuuucagacugcaccaugcuggaugcuaaaguguuauuuuuuccuagaauuggccuccguagcaucauuaauuaccaacagcauuuggcuuaaaccuaaauugaaaggucugcucuguucagcagaauggagacaaacauccaaaguuccucaaacugugaagcugcugaaauguaaacacauuuauaccaaauuauuugagucguugguuccauggcauuuccuacauacugaaugaccuaugagguuacuagaauaaauacauguuuugaauaagcuucccauuuguucuaguccaaggcaauuucacaagcaugccaggccaucuggccuaacaguuaaaacuucacggcucagcaugagcucugccaggguuccaaucucagaaccacuacuucccagccagguaaccucaggcaagccaccuaaccucucucugucucaguugccucaucuguaaaauggggagaauaaaaaugcccacguuacaggguuguugggaagauuaaauaagcugaucuacugcaagcucuuauaagauaugugccuggcauauagaaaugcucaacaagugccagaggcaguuaucuggcuagguacuucauacauguuuuugaaugaauaaauggauugguaauuaauugaaaguauacaugacauacuuacuaaacguacuucaucuaugugagggagaaauucucaacuguauacagagaaggacuuaauccucugaaacagaccaacucaacugagucagccuggacuuggaggcuacugucaguuguguuaggcucaaggccacaagcucagguguucugaaaacuaauauuugcauguuacucuggagcaagguuccaaccucaauaugucacauuaacauuuaauaaccaguguguucaaggccuccuaguuuauccaucaaugaaggcucucaaagcuuuaaagagacaaucuucuaaaccacaaaacacagcuauccuucucuccuccauggccaucauaugcccauuccuuuuuaauccucuaagcaauguacaaggucuagaauuucuauuucucuggucuaaaacguauacccaugucuggauuugagauguuugcacauuuguuucuuaggaauacaggauguacucagacuacuguagccuucuuguuucucaucuuuaauaugucugaaaugucuucuauaauauaugcaaauaaacacuguaaaaugauuucauucccuccucucccuucuaucccugaaguucucccugaaaauccuguggccuuaaagaaccaugugguugcuuuuuuaaggaaaguuccuauaacaccugcucuggguuaucuccgggacagugugagacuucacagccucucuccacacgcuccuggagucaggcagagugggcugagccugagggccaagggcuaaagaagccacagcaaaaagugcuguuuucuuuccuuccccaaagacagucucguuuuaacaagcauggcagauaaggagcuccugaucccacggcugcugggaaaggagaugccacaggcaaugcauuugcaaagaguaagacccucaucccaagauccccuuuucauuuuccccacucaguucaucuuccacuuccacuucauagagucuccuaaaaagccugcacaucugagcucgccagggugagcuggcauccaggcaugcccaccugugcaccccugccccggcccgcugccuccuccucuugccuuccucugcccaucaaaaugccaccuccuccaaggacacuuuccugaucuccccucaaccagaugggauuucuuauuucugaaucuuuguaacacuuugugaccauuuuuuucuuaacauuuaacauguucugccuccuauuauggugauuggcacauuuuucuuauucuuucuguagccuuuaagguaucugcucaucuuuauuccuccuguacuuucaucuccuaaauaccaaugaacugaagccaucugcagcucuagcuggguccccccuggcuuaucgcuuguugggcaucuccacuuggaugccccaccaugcuccaacuucaugaagcucagcaccuuuccacaucaguguuucuuaagacucuuccccuucugucaacaggaccaccguguaggcacugccucaauaaauacugaccgagagugcaaacuauguuucaggugccacagaugaggauaaaacaagacauaaacccugcaugcacagccccauuuaccacccgcaucccaggccccaccaugcaaaaugccuuccgauaacugcaagcuccggacauagccucuggaggagucccacaacucagucuccuguuuaucccucauuuccauuccugcugcauccaagccccuaucaccuuacagauggcauuccacaacagcugcccaggccaguccaccugccuccggucuccccaucuauucuguaccccaucgccaaaucaaccacccucaaacacugaguucacucaacauucagucaccauuucagaaaggaugugauguccuccuuagccccagauuugagguuccccauaaucuggguucacacacuugcuaacuucugaggacuaagcucucauuuuuuaucuugcccaaauuccuaccuaggggucuagggagucaugcccuacaaaccguaaauucucaucagauggguuuuauuugacccuauauauggugacuuacuuuucaaucugacucuggaguaacauuauggaacgaggaaaaaauauuuaaccccaaaauauauuuccuugccauaccuugaaguugccuggcaauuucaugacgucucaugccucccuaaaauauauaaaaccaaacuguaccccgaccaccuggggcacauguucucaggaccuccuguggacugugucacaggccauggucacucauauuuggcucagaauaaaucucuucaaauauuuuacagaguuugacucuucguagacacuucccuccccaaacccucuuacuugcuuugauguguccugagcuuuccucauaugcacggaggaacaggcauucuaacccaacaguccuucaacgcucccucagaacuucccugaccacccagcccagcccauaguucccugggcuacaggcccucuccacaagugaccucauccguucccaugguuucaccaccccuugcguguugaugacugccuaacuuccucuccggcuccaaaacacucuccgcucuccagaugcagcuggacuuuuccacccgaauuuccugcaggguccucaaacucagcauggccccgacuggacguuuagccuuuucccagggagcuuagucuuccucccauguuccucacacucaauucuggcucuccccacuccucccacccagucagucaccaacuccugcugacggcacucccaacaucagauccaucccucugaccccucccaccauacagccuuagauacucauggucuuucgccuggaauauuccaauagcauccuacuuggauccagccuucccccuucccaaucucgccagcagggugauuccuaaaacaauucagacugucacucauaccccuucaaugcuuccuauugcuauaccuccccuaaucacaaagcuauuucacguaucuaugccuugccucaagcuguuccucugccgacgaugccuuccucucccugucuacccugccacaggcugauccuucaacacccuguaccaguggucucacccccuccaggaagcccucuggacauucuuccuccaucucaggcaaaguuaauaccuuccuccuuaggauuccuuuugcaacuuaguauuccuuuuguauugcaccugagauacuagaugaagggacuuaaguuaugagcuccuaacuaucagagacuauuuuauccacguuuguagccccagcuccaaacacagcagcuuucacaugaugggcacucaguucauguguguugaccugaacuaaacgaucuugccccucagcuccuaaagcgcuucucugugcugcauguuugacucuugccaagggcuauugugugugugugugcacuuguaaugccuuguugucauggcuagguccuaaggucauaaaaacaagcaacuguaguuuugguguccuuucuaggcucuguuauugcucaauaauuauuuguugauucuaaugagauuuuuuucacuuauaccucuagcagcuguuuauuuacuuauuuaucuuugagauagaaucucacucugucacccaggcuggggugcaguggcacaaucuuggcucacuguaaccucugccucccggguucaagcgauucuccugccucagccucccgaguagcugagauuacaggcaugcaccaccacacccagcuaauuuucuuaucuuuaguagagaugggguuuggccauguuggccagguuggucuugaacuccugaccucaagcuauccgcccccuuggccucccuaaauauugggauuacaggcgugagccacugcgcccagccucuagcaguuaauuuccaauccaaacaagucaaaauuccuuagccaguucucaggguccuccauaauuucacaccacccuaaauuauaacccuauguuauauauugccccguaugcuggacagcaaccuguaaacucaugagaacaggaacgguuucuaucuugcuaaccucuguaucuccagguaucuaagcgaaugcuuaguuuucagugauuaucucccaaaugaaugaauacaugauaaacauuuguuacuggacugauuaaagaagaugcagaaguauuugcugaucacuugauuuggugaucugagauaccgguaagucacucagucucuaagaaaguaaaggagagagaaacaagaugucuagcagguuguacccacaaauaucuguaauccuaagcucccacagaugccaacagaauccaugacaaugccaccuugagguuaaaaaaauguccucaaauaaaaggugacugaaucucuggaagcuccuaaaguugucugaauucaagugaaaccaugguuuuaaggucuuuaaaaggugaguuaaucccacagaagucuguagcacugauccuacggaaaaggagacaaaauggagacucccaugggggccuaggguagcuacagaaagggacaggggaggaagcagggcagaaccagggacaaggaggcagagucaugaagacugggguggcuguggcaguuucuuaaaauaagacaauaaugaaguuugccacauugauugacucuuuuauuuauuuauuuauuuuuuuggugagaugcgaguuucgcucuuguuguccaggcuggagugcgguggcgugaucucggcucaucacaaccuccaccucccagguucaagugauucuccugccucaggcucccaaguagugggauuacaggcaucugccaccaaaccuggcuaauuuuuguacuuuuaguagagacgggguuuugccauguuggccaggcuggucuugaacuccugaccucaggugauccacccgccuuggccucccaaagugcugcgauuacaggcgugagccagcgcaccuggcccaauugauuauuccuuucaugaaagauuucucuauggcaugugaugcuguuugauagcauuuuacccagaguagaacuucuuucaaaauuggagucaauccucucaaacccugccgcugcuuuaucaacuaaguaauguaauguaaaguuauguaauauucucaguccuuuguugucauuucaacaauauucacagcgucuucaacaggaguagauucuaucucaagaaaccacuuucucugcucaucugugagaagcaacuacucacccaaucaaguuugaucaauaaauugcagcaauuugguugcaucuccaggcuccacuucuaaugcuaguucucuugcuauuucuaccacaucugcaguucccuccuccaaugaagucuugaacccuucaaagugauccaugagggcuggaaucaguuucuuccaaacuccuguuaauguugauauuuugaccuccucccaugaaucaugaauauucuuaauagcaucuaggauggugacuccuuuccagaagguuuucaauugacuuugcccagauccaucagaggaaucacuaucuauggcagcuguagcuuuaugaaauguauuuauuaaguaauaagacuugaaagucaaaauuacuccuugacuucuggguuguagaauggauguuguauuugcaggcaugaaaaauauuaaucuucuuguauaucuccaugagagcucuuggguaaccagaugcacuguaaugagcaguaauauuuugaaaggaaucuuuuuucugaguaguaggucucaccugggcuuaaacuauuccauaaacugugaaaacagaugugcugucguccagacuuuguuguuccauuuacagagcacaggcagaguguauuuaguagcacuggcuucaacuuaaagucacaagcuguacuaacaagacucagccuguccuuugaagcucugaagccaggcauggacuucucuucuccagcuaugaaaguccuagauggcaucuucuuccaguagaaggccguuucaccuacagugaagcuguuugacguagccaccuucaucaaugagcguagcuagaucuucuggacagcuuacugcagcuucuccauuagcacucgcugcuucaccuugcacuuuuauguuauggagauggcuuuuuucuuuaaaccucaugaaccaaccucugcuagcuucacacuuuucuucugcagcuucuucgccucucucagcauucaaagaauugaagaguuagggccuugcucuggguuagccugaaaggaauguuguggcugguuugaucuucuauccagaccacuaaaacuuucuccauaucaacaaucaggaugucccacuuucuuaucauucauguuuucacugacguagcacuuucauuuccuucaggaacucuuccuuuacauuuacauacuuaacugguauaagagcccccuagcuuuaggccugucucgguuuuggacaugccuucaccgucaucauucuagcuuuggauuuaaaaugagagaugcgcagcucuuccuuucucuugaacacuuuauaggccacuauaggguuaucaauuggccuaauuucaaaauuguuguguuucagggaauagggagacccaaggagagggagacacaggagagcaguugggacacacacaacacugaucaaguuugacacaggagagcaguugggacacacacaacacugaucaaguuugcugucuuauacaggugugguucauggugccccaaaacaaugacaauaguaguaucaaagcucgcugaucucagagcacuauaacagacauaauaguaaggaaaaaguuggaaauguuugagaauuaccaaaaugugacauugaaacacggagugagugugugcuguuggaagaacagacuggcgcugacaagacuugcucagcgccagguugccacaaaccuucgauuuguaaaaaccaccaauuaauugugaaacguaauaaagcaaaguacaguaaaaugagggaugccuguaugaggugugauaagguaaccacgugacacaggccaugccaaggcucccuuacuucuccccuucuuccugccaugauucuagcuggaaauaaccaaccuucggaauuuguaccuucaggguaucggguuauuacagcacacacagcuuucaccucuuccaaagcccaccacuaagcaaagcugacagcccacagauuaucaaauguuuaugugcacacagcaucacacugcacacagcacaccccccacacacagagaaaaggagaguuucugugacaaagugcucagguaagaggaaaaccacugaagccucacugcugccuguggaacacccugaaccccacaguuguccuucacuccugaggccgaaaggaauuccacagaaugccuggcuguugagagccacgcuguuucuggcugucaccuggaagacaaacuacugagcuggugcuggugggugaguuucuggggcacccccugaagcagcucccaggggagggaaucugagaguccaaaucugacacugacauacccuaauccuaaaccaccccuggcuucaagauauccuaucugaucucagggaauccgccugggugaaaccggcugcaagaacucaacucugaauaaguaccacaccccugacuaccacccgggccccucuggugucucccucauugccccuucucucccucccuguuggccacccauggccaugccaggagcagagcccacacucugggaaugugagggaaguucaaaguggggucugagucccgaggcucuaccaucucccaguguagcuggugacccccuuaguuuugcgugguuuagaggacugccuggugccccuccuccuccuuugacccgaaggcccucucugagccaggucccuuuacuuccacucuccugcccuggguccagaugcugccuguugccucccuccccucaggaccauuucugggcuuccuggcacuaaaucaucacagccccacccucacagcuuggcugaggaccaggcacccucacugccuaaggcacagguccucuuguaaagauccuggcuuuccuacgccuucccaccuaguuucaggccaugcugguggcuucuggcuccuggucgugcccucugcauccauuuguugggcauccacccuugauccuucucucacgcccucagccccaccgaugggagccaccacuccauccacauuauccacagggcuggcugagcugacuuccucugagacagggcuggcaucugccucacucuguucugagaaggugauccaggcucccagggaacacagacaccuaaaucagagucagcccuggccuggcuucggaccuuucucacccugacaguuguaaacacacaggaggccaggggaggagaugcucagaucaucuacccuggcccugccucucaagauacuccccugagcuacaucaggagcugcuguuucugagccauuugcucagcagcccuuggucacuggacagccuugcuuaacuggaagaugccugauuuaagagcacacgugcucacucugaccuauauccugauccccuggcccucccccuccgcaguggcgcgcgucaccaccagcucacaggcuugagcugucaugaaauccugggcagaauccaguccagagaaagcguggagaggacaguggcccagagcugcuuucaggugcuccauggacggccaucgugaucagggacacugccuucucgcagcgggaaugcauuucauuugagagcauggauucuggaggcagacacuggauccaaagccaccucuaccaccuauuggcugugggacccuggacgaacuacuuuaccucugugccucauuuaucucagcugggaaacaggaugauaauaauagcacaggcucagcaucccaaauccaaaaauucccaaaucccaaauccuccagaaucugaaacuuucugaguccugacaugacacuccaaggaaaugcucauugcaacauuuuggauuucagauuuucagaugugggauauucaacuggcaaguaucaugcaaauauuccaaaaucugaaaacaucugaacucugaaaugcuucuggucacaagcauuuuggaaacaggaugcucaaccuguauccacgugacagggcugcuguaaguguggauacaggcaaugcauguaaagcaucuggagcagugccuggcacacguggggagcccgucauaugcugccgcggcugcugcuaaugacaacagggacaacuacgaugagauuacagaggcaggggacgggugcagcuccacgguuaacaaugcuaccagguguccccagcucacaaagccuguccauggucccauuuuccacacauggaaccuggcccagagagcaaccgcccacagucccacuccuaggaagcaggguagccaggaacugaaugcaggucugugaaccuaaaacgaauacucuuuuaaccucugccacuaaaauugcauccaauuuucaaggggaaggagaaauaugguuucccagcaccuacuacgccuuugcacugcaauugucagcuggacaagaaagagcaucugaauaucugauuuaaaggaaaaggcugcuuucucuuugggacuaauaacaacgaaggcuuuuuuggcucugcaaguuugcuguccucucgccagugcuguggacuggggcuuucucagaguagugcugcuuucagcgaagcagcuguuugggguggccccuuuguuucuuauuaccuacgcuaugaccacagcuccacacugacaugcgauggcggcaucaguugacaucuauuuucuuguuaacagaacacaaguggcuccuuauuaagcgcccccagagaagauucugccauaaaaauuucauaaagcccaagcgccucccgaaauguaaacuggcccgcucaacuuucccuuggaaaucgcuggugagaucugcuuugucggccagugugcguguuccaccuauggucacuuuaggccgcuaaaagcaagaaaccaaucaagcaucccacuagagucgacaaaccaaacccugucucaugugcaccccuuggucugaggauggaaaagcagcuucccuucacauuuacacagugaccucgguacgagucauaggacaacguuuugagggacagaaggaagucucuuuaguugcucuuccuuuuuugcuaagccacugaagcuggcuguggcuuagaugacaggaaugacucuuaccugugcggugaagaaggcuggggugagggaucccgaggggagggcugggcuguugagggcgauggagccgaugucggugccggagagcaccagcgggggcgcugagauuuccaagccuuuggguuuuuuggccuuugggggaagagauggagacuuggucuuggagcccgaugacagguucaagggcuccagggaaucggagucauggcaggcggccuccaggaagaggcuucuguguucagaagggaggggugaguugggggacagggacggggaccgagaugagaagggugaggcggaugaaauacuggcagcguuuggcaacauuaaagaggagaucuuggccgagacggacgaggccaggaaggcggacgccgccgcagccucugacguggaaggcagggacaccaccggccuggugacgugcuugucgguuuuauuggucacaaaccugaucacaguccugacuucuuccacgggggggcugucuucgggcggcuccuccagcuucuccgucuugauggccuugaaggcgucugguggguucugcagggaauuaauggugaaggacgaguacaggccugaguggauguauucguugcggcucgugcuucugagggcggccaggccguguuugugggccucgcggcccuccggagacgccuugcagucgcuguccugcagcagaaggcucucccggcugaucuccaccgcgugaggauccaucuucaggaucuccgggaaagagacaaacuuguacacaaacuucugcccgaucaccuucuugaugauguucugcaaauacaaaaguagacguugaaaaucugagugcacccgagaaaccauguaagagcucaugauaaugguaaaugucgcuggcagaagcaccaaaauguuccugauuuacauucuuggcuaaggaaaaguggaaggaggaaugaaguuggaaguagaauuagaugugcauuccaguucugccauuacuagaucuuugugaucuuuggcaaauuaagugccacuuugaguuuccucgucuguaaaguaaggaagaugaugaugaugaugaugauuucuuagacagggucucacucugucgcacaggcuggagugcaguggcacgaacauggcucacugcagccucaaccuccuggacucaagcaauccuccugccuccaccuccugaguggcugggacuacagguacaugccaccacacccugcuaauuuuuacauuuuuauuuuuuguggagacagcaucucacuugguugcucaggcuggucucaaacuccuggacucaagcaaucccccaaccuuggccgagugaggauuauucuauguaauaacauaguaacagcugccauuuaugaagccuuuacuauguggaugggauuauucauaucuuaucucauacaaucugaacagcaauccuaaaaggaagguguugugacuccuauuuuaaaaauuuggaaaauaagcuuagagcacuucccuaacucacaugaccaccugcuaggaagugaagugguagaggcagcauguccugaaccauaacacaguauugucuuaccuaccucugcgagucagaagaauucaaugaaauaauaaugagaaagcauucuguaagcuggaaagcauuauaaaaugcaaguuaucaucaucaaacacuacaacguuuucuuaacucagucauuuuuuuccuuuuuaauuuuuauuuuuuuugccaagaaagccacuggaaggaaaacgaauugucuacuuuggauaucugugacauucauugacaguauuuuuaguugcuagcgucuacuucuggcucuucaguuuauggcuccaguccucaaacauuaggcuauaaaugaaaagcaauaaucauugcaaaaguuuuugcaacccuuugggagaagggacuuuauauuaaaggcuaugcuguucuugagguuuauuaaauggauacuuuaauucccugccgaacccacuggguucuauauuuaccuaccaaaugcuugcgugugccuugcccuguggaugcaucuuggcguccaaggggcucagagagacaaagauggucucucucaagcacaaaaacccagcaccauccuaugggaaaaggacucuguuuccuuagaaacuauuccaccuaaaaccaggguaugagugaggauuaaaaaaagaucauuucaaguagaagagcuuuagaagcagcucugauugagugccucucuucuguaccagggguuguacauaaggcaccucauuagauccccacauuagcccugauggagguggaggaugucauccuucugacacaaacaagaucccagggauggagagucauuugcccaagaaccaccaagaucgacagauucuaaagcguaagcuuuuucacauccccacacaaauuuagggggagagaaaucaaagaucccccaauagacaugaaauucaacugaauguugaugugccuuuugaaaucauagugugguucuaaa
